(12) United States Patent
Griffais et al.

(10) Patent No.: US 6,559,294 B1
(45) Date of Patent: May 6, 2003

(54) CHLAMYDIA PNEUMONIAE POLYNUCLEOTIDES AND USES THEREOF

(75) Inventors: Remy Griffais, Momtrouge (FR); Susan K. Hoiseth, Fairport, NY (US); Robert John Zagursky, Victor, NY (US); Benjamin J. Metcalf, Rochester, NY (US); Joel A. Peek, Pittsford, NY (US); Banumathi Sankaran, Penfield, NY (US); Leah Diane Fletcher, Geneseo, NY (US)

(73) Assignee: Genset, S.A. (FR)

(*) Notice: Subject to any disclaimer, the term of this patent is extended or adjusted under 35 U.S.C. 154(b) by 0 days.

(21) Appl. No.: 09/198,452

(22) Filed: Nov. 23, 1998

(30) Foreign Application Priority Data

Nov. 21, 1997 (FR) .............................. 97-14673

(51) Int. Cl.$^7$ ......................... C07H 21/02; C07H 21/04; C12P 21/06; C12P 21/04; C12N 15/00
(52) U.S. Cl. .................... 536/23.1; 536/24.1; 435/69.1; 435/70.1; 435/320.1
(58) Field of Search .............................. 435/320.1, 325, 435/252.3, 69.1, 70.1; 536/23.1, 24.1

(56) References Cited

PUBLICATIONS

GIBCO GRL, Random Primers DNA Labeling System, GIBCO BRL Catalogue and Reference Guide, Life Technologies, Inc., Gaithersburg, MC 20877, USA, p. 404. 1990.*

Watson et al., Recombinant DNA, Chapter 5, pp. 63–77, Scientific American Books, 1994.*

Databae GenBank acc. #: L23921, 1994.

Belunis CJ et al., "Inhibition of lipopolysaccharide biosynthesis and cell growth following inactivation of the kdtA gene in *Escherichia coli*", J Biol Chem. Nov. 17, 1995;270(46):27646–52.

Brade H et al., "Chemical and serological investigations on the genus–specific lipopolysaccharide epitope of Chlamydia", Proc Natl Acad Sci U S A. Apr. 1987;84(8):2508–12.

Caldwell HD et al., "Monoclonal antibody against a genus–specific antigen of Chlamydia species: location of the epitope on chlamydial lipopolysaccharide", Infect Immun. May 1984;44(2):306–14.

Fu Y et al., "A synthetic glycoconjugate representing the genus–specific eptiope of chlamydial lipopolysaccharide exhibits the same specificity as its natural counterpart", Infect Immun. 1992 Apr;60(4):1314–21.

Girjes AA et al., "Lipopolysaccharide biosynthesis genes in koala type I Chlamydia: cloning and characterization", Res Microbiol. Jun. 1997;148(5):413–25.

Holst O et al., "Structure, serological specificity, and synthesis of artificial glycoconjugates representing the genus–specific lipopolysaccharide epitope of Chlamydia spp", J Bacteriol. Mar. 1991;173(6):1862–6.

Lobau S et al., "Molecular cloning, sequence analysis, and functional characterization of the lipopolysaccharide biosynthetic gene kdtA encoding 3–deoxy–alpha–D–manno octulosinic acid transferase of *Chlamydia pneumoniae* strain TW–183", Mol Microbiol. Nov. 1995;18(3):391–9.

Mamat U et al., "The genus–specific lipopolysaccharide epitope of Chlamydia is assembled in *C. psittaci* and *C. trachomatis* by glycosyltransferases of low homology", Mol Microbiol. Dec. 1993;10(5):935–41.

Nano FE et al., "Expression of the chlamydial genus–specific lipopolysaccharide epitope in *Escherichia coli*", Science. May 10, 1985;228(4700):742–4.

Aldous, M.B. et al., 1992, "Seroepidemiology of *Chlamydia pneumoniae* TWAR infection in Seattle families, 1966–1979", J. Infect. Dis. 166:646–649.

Altschul, S.F. et al., 1990, "Basic local alignment search tool", J. Mol. Biol. 215:403–410.

Altschul et al., 1997, "Gapped Blast and PSI–Blast: a new generation of protein database search programs", Nucl. Acids Res. 25:3389–3402.

Bai, M. et al., 1993, "Mutations that alter an Arg–Gly–Asp (RGD) sequence in the adenovirus type 2 penton base protein abolish its cell–rounding activity and delay virus reproduction in flat cells", J. Virol. 67:5198–5205.

Braun, J. et al., 1994, "*Chlamydia pneumoniae*– a new causative agent of reactive arthritis and undifferentiated oligoarthritis", Ann. Rheum. Dis. 53:100–105.

Campbell et al., 1992, "Detection of *Chlamydia pneumoniae* by polymerase chain reaction", J. Clin. Microbiol. 30:434–439.

Casas–Ciria, J. et al., 1996, "*Chlamydia pneumoniae* and artherosclerotic plaque", J. Infect. Dis. 173(6):1519–1520.

(List continued on next page.)

*Primary Examiner*—Michael Borin
*Assistant Examiner*—Shubo Zhou
(74) *Attorney, Agent, or Firm*—Saliwanchik, Lloyd & Saliwanchik

(57) ABSTRACT

The subject of the invention is the genomic sequence and the nucleotide sequences encoding polypeptides of *Chlamydia pneumoniae*, such as cellular envelope polypeptides, which are secreted or specific, or which are involved in metabolism, in the replication process or in virulence, polypeptides encoded by such sequences, as well as vectors including the said sequences and cells or animals transformed with these vectors. The invention also relates to transcriptional gene products of the *Chlamydia pneumoniae* genome, such as, for example, antisense and ribozyme molecules, which can be used to control growth of the microorganism. The invention also relates to methods of detecting these nucleic acids or polypeptides and kits for diagnosing *Chlamydia pneumoniae* infection. The invention also relates to a method of selecting compounds capable of modulating bacterial infection and a method for the biosynthesis or biodegradation of molecules of interest using the said nucleotide sequences or the said polypeptides. The invention finally comprises, pharmaceutical, in particular vaccine, compositions for the prevention and/or treatment of bacterial, in particular *Chlamydia pneumoniae*, infections.

13 Claims, 3 Drawing Sheets

PUBLICATIONS

Figure 1:
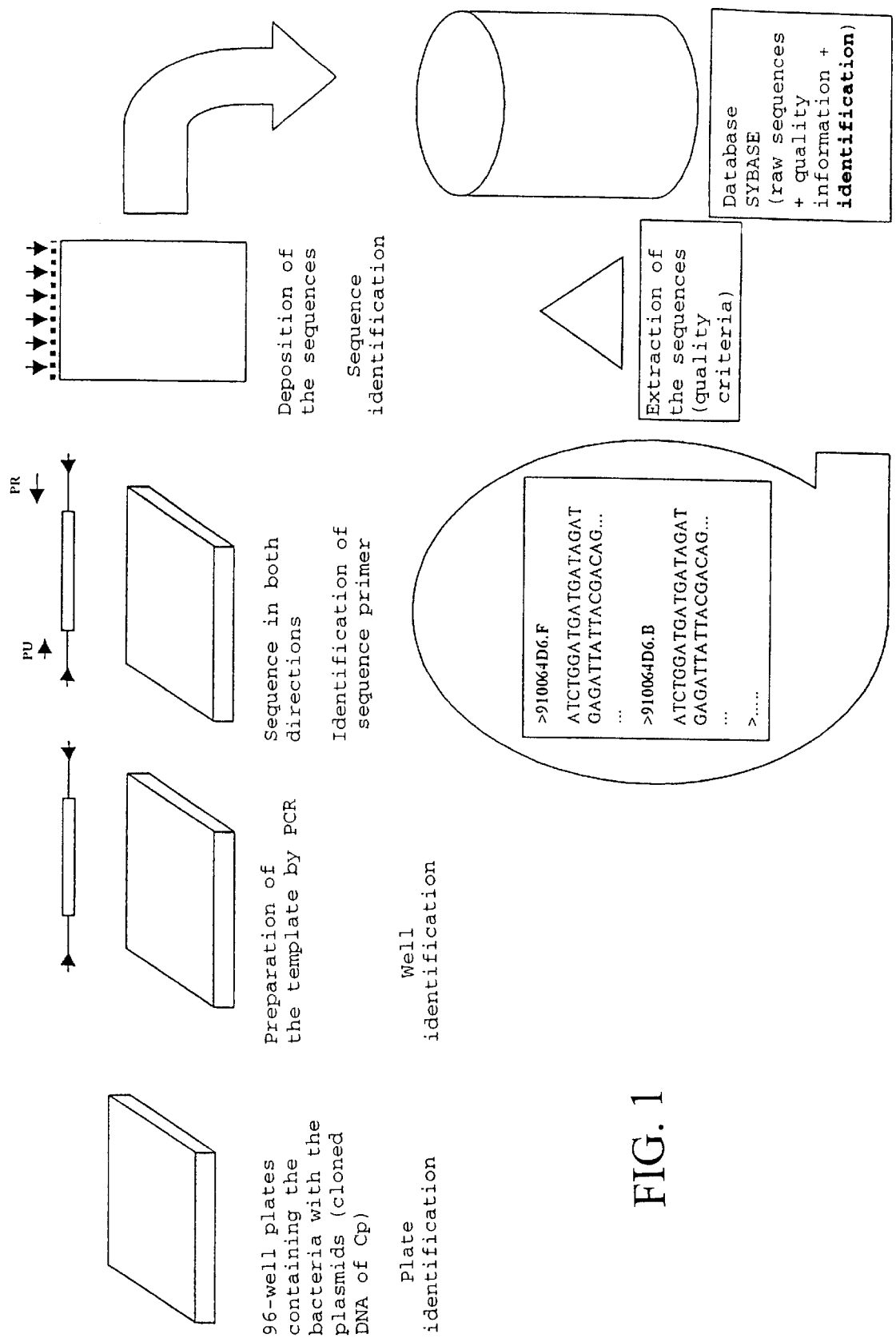

Derisi, J. et al., 1996, "Use of a cDNA microarray to analyse gene expression patterns in human cancer", Nature Genet. 14:457–460.

Falsey et al., 1993, "Transmission of *Chlamydia pneumoniae*", J. Infect. Dis. 168(2):493–496.

Fox, G. et al., 1989, "The cell attachment site on foot–and–mouth disease virus includes the amino acid sequence RGD (Arginine–Glycine–Aspartic Acid)", J. Gen. Virol. 70:625–637.

Gaydos, C.A. et al., 1994, "Diagnostic utility of PCR–enzyme immunoassay, culture, and serology for detection of *Chlamydia pneumoniae* in symptomatic and asymptomatic patients", J. Clin. Microbiol. 32:903–905.

Gish et al., 1993, "Identification of protein coding regions by database similarity search", Nature Genetics 3:266–272.

Gonnet et al., 1992, "Exhaustive matching of the entire protein sequence database", Science 256:1443–1445.

Grayston, J.T. et al., 1986, "A new *Chlamydia psittaci* strain, TWAR, isolated in acute respiratory tract infections", N. Engl. J. Med. 315:161–168.

Grayston, J.T. et al., 1996 "*Chlamydia pneumoniae* and artherosclerosis", Rev. Med. Interne. 17:45S–47S.

Hahn, D.L. et al., 1991, "Association of *Chlamydia pneumoniae* (Strain TWAR) infection with wheezing, asthmatic bronchitis, and adult–onset asthma", JAMA 266:225–230.

Hashiguchi, K. et al., 1992, "Seroprevalence of *Chlamydia pneumoniae* infections in otolaryngeal diseases", J. Laryngol. Otol. 106:208–210.

Hayashi, S. & Wu, H.C., 1992, in N.M. Hooper and A.J. Turner (ed.), *Lipid Modification of Proteins: A Practical Approach*, Oxford University Press, New York, pp. 261–285.

Heinkoff & Heinkoff, 1993, "Performance evaluation of amino acid substitution matrices", Proteins 17:49–61.

Higgins et al., 1996, "Using Clustal for multiple sequence alignments", Meth. Enzymol. 266:383–402.

Hueck, C.J., 1998, "Type III protein secretion systems in bacterial pathogens of animals and plants", Molec. Biology Rev. 62:379–433.

Huovinen, P. et al., 1989, "Pharyngitis in adults: the presence and coexistence of viruses and bacterial organisms", Ann. Intern. Med. 110:612–616.

Jackson, L.A. et al., 1997, "Specifically of detection of *Chlamydia pneumoniae* in cardiovascular artheroma", Am. J. Pathol. 150:1785–1790.

Jantos et al., 1997, "Antigenic and molecular analyses of different *Chlamydia pneumoniae* strains", J. Clin. Microbiol. 35(3):620–623.

Karlin & Altschul, 1990, "Methods for assessing the statistical significance of molecular sequence features by using general scoring schemes", PNAS USA 87:2264–2268.

Kleemola, M. et al., 1988, "Epidemics of pneumoniae caused by TWAR, a new Chlamydia organism, in military trainees in finland", J. Infect. Dis. 157:230–236.

Kuo, C.C. et al., 1988, "Factors affecting viability and growth in HeLa 229 cells of Chlamydia sp. Strain TWAR", J. Clin. Microbiol. 26:812–815.

Kuo, C.C. et al., 1993, "Demonstration of *Chlamydia pneumoniae* in artherosclerotic lesions of coronary arteries", J. Infect. Dis. 167:841–849.

Laitinen, K. et al., 1997, "*Chlamydia pneumoniae* infection induces inflammatory changes in the aortas of rabbit", Infect. Immun. 65:4832–4835.

Lee, C.A., 1997, "Type III secretion systems: machines to deliver bacterial proteins into eukaryotic cells?", Trends Microbiol. 5:148–156.

Leininger, E. et al., 1991, "Pertactin, an Arg–Gly–Asp–containing *Bordetella pertussis* surface protein that promotes adherence of mammalian cells", PNAS USA 88:345–349.

Longbottom et al., 1998, "Molecular cloning and characerization of the genes coding for the highly immunogenic cluster of 90–kilodalton envelope proteins from the *Chlamydia psittaci* subtype that causes abortion in sheep", Infect. Immunol. 66:1317–1324.

Lukacova, M. et al., 1994, "Lipopolysaccharide smooth–rough phase variation in bacteria of the genus Chlamydia", Infect. Immunol. 62(6):2270–2276.

Moazed T. C. et al., 1997, "Murine model of *Chlamydia pneumoniae* infection and artherosclerosis", J. Infect. Dis. 175:883–890.

Mordhorst, C.H. et al., 1992, "Outbreak of *Chlamydia pneumoniae* infection in four farm families", Eur. J. Clin. Microbiol. Infect. Dis. 11:617–620.

Nakai, K. & Kanehisa, M., 1991, "Expert system for predicting protein localization sites in gram–negative bacteria", Proteins 11:95–110.

Nielsen, H. et al., 1997, "Identification of prokaryotic and eukaryotic signal peptides and prediction of their cleavage sites", Protein Engin. 10:1–6.

Pearson & Lipman, 1988, "Improved tools for biological sequence comparison", PNAS USA 85(8):2444–2448.

Peterson et al., 1988, "Protective role of magnesium in the neutralization by antibodies of *Chlamydia trachomatis* infectivity", Infect. Immun. 56(4):885–891.

Peterson, E.M. et al., 1998, "Characterization of a neutralizing monoclonal antibody directed at the lipopolysaccharaide of *Chlamydia pneumoniae*", Infect. Immunol. Aug., 66(8):3848–3855.

Pierschbacher & Ruoslahti, 1987, "Influence of stereochemistry of the sequence Arg–Gly–Asp–Xaa on binding specificity in cell adhesion", J. Biol. Chem. 262:17294–17298.

Pugsley, A.P., 1993, "The complete general secretory pathway in gram–negative bacteria", (abstract) Microbiol. Rev. 57:50–108.

Puolakkainen, M. et al., 1993, "Serological response to *Chlamydia pneumoniae* in adults with coronary arterial fatty streaks and fibrolipid plaques", J. Clinical Microbiol. 31:2212–2214.

Reeves, P.R. et al., 1996, in *Bacterial Polysaccharide Synthesis and Gene Nomenclature*, Elsevier Science Ltd., pp. 10071–10078, from Trends in Microbiology, 1996, 4(12):495–503.

Relman,D. et al., 1990, "Recognition of a bacterial adhesin by an integrin: macrophage CR3 ($\alpha_M\beta_2$, CD11b/CD18) binds filamentous hemagglutinin of bordetella pertussis", Cell 61:1375–1382.

Roivainen, M. et al., 1994, "Entry of coxsackievirus A9 into host cells: specific interactions with $\alpha v\beta 3$ integrin, the vitronectin receptor", Virology 203:357–365.

Salzberg et al., 1988, "Microbial gene identification using interpolated Markov models", Nucl. Acids Res. 26:544–548.

Schnaitman, C.A. & Klena, J.D., 1993, "Genetics of lipopolysaccharide biosynthesis in enteric bacteria", Microbiol. Rev. 57:655–682.

Schneewind, O. et al., 1995, "Structure of the cell wall anchor of surface proteins in *Staphylococcus aureus*", Science 268:103–106.

Shor, A. et al., 1992, "Detection of *Chlamydia pneumoniae* in coronary arterial fatty streaks and artheromatous plaques", S. Afr. Med. J. 82:158–161.

Struyve, M. et al., 1991, "Carboxy–terminal phenylalanine is essential for the correct assembly of a bacterial outer membrane protein", J.Mol. Biol. 218:141–148.

Sundelof et al., 1993, "An unusual manifestation of *Chlamydia pneumoniae* infection: meningitis, hepatitis, iritis, and atypical erythema nodosum", Scand. J. Infect. Dis. 25:259–261.

Sutcliffe, I.C. & Russel, R.R.B., 1995, "Lipoproteins of gram–positive bacteria", J. Bacteriol. 177:1123–1128.

Thom, D.H. et al., 1990, "*Chlamydia pneumoniae* strain twar, mycoplasma pneumoniae, and viral infections in acute respiratory disease in a university student health clinic population", Am. J. Epidemiol. 132:248–256.

Thomas, G.N. et al., 1997, "Respiratory chlamydial infections in a Hong Kong teaching hospital and association with coronary heart disease", Scand. J. Infect. Dis. Suppl. 104:30–33.

Thompson et al., 1994, "Clustal W: improving the sensitivity of progressive multiple sequence alignment through sequence weighting, position–specific gap penalties and weight matrix choice", Nucl. Acids Res. 22(2):4673–4680.

* cited by examiner

CHLAMYDIA PNEUMONIAE POLYNUCLEOTIDES AND USES THEREOF

CROSS REFERENCE TO RELATED APPLICATION

The present application claims the benefit of U.S. Provisional Application Ser. No. 60/107,078, filed Nov. 4, 1998.

The Sequence Listing for this application is on duplicate compact discs labeled "Copy 1" and "Copy 2." Copy 1 and 2 each contain only one file named "seqlist-28July2001.txt" which was created on Jul. 30, 2001, and is 5,284 KB. The entire contents of each of the computer discs are incorporated herein by reference in their entireties.

The subject of the invention is the genomic sequence and the nucleotide sequences encoding polypeptides of *Chlamydia pneumoniae,* such as cellular envelope polypeptides, which are secreted or specific, or which are involved in metabolism, in the replication process or in virulence, polypeptides encoded by such sequences, as well as vectors including the said sequences and cells or animals transformed with these vectors. The invention also relates to transcriptional gene products of the *Chlamydia pneumoniae* genome, such as, for example, antisense and ribozyme molecules, which can be used to control growth of the microorganism. The invention also relates to methods of detecting these nucleic acids or polypeptides and kits for diagnosing *Chlamydia pneumoniae* infection. The invention also relates to a method of selecting compounds capable of modulating bacterial infection and a method for the biosynthesis or biodegradation of molecules of interest using the said nucleotide sequences or the said polypeptides. The invention finally comprises, pharmaceutical, in particular vaccine, compositions for the prevention and/or treatment of bacterial, in particular *Chlamydia pneumoniae,* infections.

Comparative analysis of the sequence of the gene encoding the ribosomal 16S RNA has been widely used for the phylogenetic study of prokaryotes. This approach has made it possible to classify the Chlamydiae among the eubacteria, among which they represent a well-isolated group, with, nevertheless, a very weak link with the planctomyces. The Chlamydiae thus exhibit some unique characteristics within the eubacteria, in particular their development cycle and the structure of their membranes. They have a unique two-phase cell cycle: the elementary body, a small extracellular form, attaches to the host and is phagocytosed; in the phagosome, it is converted to the replicative intracellular form, the reticulate body. The Chlamydiae are obligate intracellular bacteria which multiply in eukaryotic cells at the expense of their energy reserves and nucleotide pools; they are responsible for a wide variety of diseases in mammals and birds. The Chlamydiae are the only members of the order Chlamydiales, of the family Chlamydiaceae and of the genus Chlamydia. Within the genus Chlamydia, four species are currently described: *Chlamydia trachomatis, Chlamydia psittaci, Chlamydia pneumoniae* and *Chlamydia pecorum.* These bacteria are grouped together and share biological and biochemical properties. Among them, only the first three infect humans, *Chlamydia pecorum* being a pathogen of ruminants.

The species *Chlamydia psittaci* infects many animals, in particular birds, and is transmissible to humans. It is responsible for atypical pneumonia, for hepatic and renal dysfunction, for endocarditis and for conjunctivitis.

The species *Chlamydia trachomatis* is the best characterized. Besides a murine strain, it is divided into two groups which are distinguishable by the nature of the diseases for which they are responsible: trachoma, genital attack and venereal lymphogranulomatosis. There are fifteen human serotypes of *Chlamydia trachomatis* (A, K) and LGV (L1, L2, L3). Strains A to C are mainly found in eye infections, whereas strains D to K and LGV are essentially responsible for genital entry infections. It should be mentioned that the LGV strains are responsible for systemic diseases. Historically, it was in 1906 that Halberstaeder and on Provaseck discovered, in trachoma patients, the presence of inclusions in the cytoplasm of the cells derived from conjunctival scrapings. In 1940, Rake and Jones described these same inclusions in certain cells obtained by puncturing the ganglia from a patient suffering from venereal granulomatosis. Characterization of the *Chlamydia trachomatis* microorganism was only successfully carried out in 1957, after a series of isolations in cell cultures.

It was in 1983 that *Chlamydia pneumoniae* was recognized as a human pathogen (Grayston J T et al., 1986); since then, special attention has been paid to this bacterium and it is estimated (Gaydos C A et al., 1994) that 10% of pneumonias, and 5% of bronchitides and sinusites are attributable to *Chlamydia pneumoniae* (Aldous M B et al., 1992). More recently, the association of this bacterium with the pathogenesis of asthmatic disease and of cardiovascular impairments is increasingly of interest.

Serological studies have made it possible to observe that *Chlamydia pneumoniae* infection is common in children between 5 and 16 years of age. Before this age, it is rare to find antibodies; the increase in the number of individuals carrying antibodies is then correlated with age up to 20 years. Accordingly, 50% of adults are carriers of antibodies, it being possible for this prevalence to be as high as 75%. These figures are all the more striking since a first infection induces antibody levels of which the persistence over time is limited to 3 or at most 5 years, which suggests frequent reinfection during the entire lifespan. The annual seroconversion rate is about 8% between 8 and 12 years and about 6% between 12 and 16 years (Haidl et al., 1994). Before the age of 15 years, the seroprevalence of the disease is identical between both sexes. After this age, men are more frequently infected than women; this is true in all regions worldwide where such studies have been carried out.

These infections are geographically highly widespread, as shown by numerous studies carried out throughout the world (Kanamoto Y et al., 1991; Tong C Y et al., 1993). Developed countries of the north such as Canada, Denmark and Norway have the lowest infection rates; conversely, the highest prevalence rates are found in the less developed countries of tropical regions where the infection may occur before the age of 5 years.

Humans are the only known reservoir for *Chlamydia pneumoniae* and it is probable that the infection is caused by direct transmission, respiratory secretions probably being responsible for this low-yield transmission (Aldous et al., 1992). The chain of transmission may also appear to be indirect (Kleemola M et al., 1988), suggesting that the infection is caused by an effective transmission, but also that asymptomatic carriers exist, which could explain the high prevalence of the disease. Other studies (Mordhorst C H et al., 1992) show that the efficiency of the transmission varies according to the individuals and list cases of infection affecting all or the majority of members of one family or of a group of families. The period of incubation is several weeks, significantly longer in this regard than that of many other respiratory pathogenic agents. Although under conditions of high relative humidity the infectivity of *Chlamydia pneumoniae* in the open air decreases rapidly, suggesting a direct mode of transmission under these conditions, it is probable that the transmission occurs in some cases indirectly since the microorganism can survive for up to 30 hours in a hostile environment (Falsey et al., 1993).

Clinical manifestations due to *Chlamydia pneumoniae* are essentially respiratory diseases. Pneumonia and bronchitis are the most frequent because they are clinically patent: since etiological diagnosis is evoked in this case, the infectious agent is identified. The asymptomatic diseases are probably numerous (Grayston J T et al., 1992; Grayston J T et al., 1986; Thom D H et al., 1990). The disease then progresses via bronchitis or pneumonia; fever is absent at the time of examination but is sometimes reported by the patient. The degree of seriousness of the disease is variable and in hospitalized patients, it is common to observe pleural effusion; a generalized infection may also be observed and, in severe cases, anatomicopathological examination shows *Chlamydia pneumoniae* diseases.

Other syndromes such as sinusitis (Hashiguchi K et al., 1992), purulent otitis media (Ogawa H et al., 1992), or pharyngitis (Huovinen P et al., 1989) have been described, as well as infections with respiratory impairments similar to asthma (Hahn D L et al., 1991). *Chlamydia pneumoniae* has also been associated with sarcoidosis, with erythema nodosum (Sundelof et al., 1993) and one case of Guillain-Barrésyndrome has even been described (Haidl et al., 1992). The involvement of *Chlamydia pneumoniae* in Reiter's syndrome has also been evaluated (Braun J et al., 1994).

The association of *Chlamydia pneumoniae* with coronary diseases and with myocardial infarction was first suspected from the observation of the high antibody level in 71% of patients having a heart disease (Shor A et al., 1992; Kuo C C et al., 1993; Puolakkainen M et al., 1993; Thomas G N et al., 1997). Studies carried out in several countries have shown similar results in patients with atheromatous impairments (Shor A et al., 1992; Kuo C C et al., 1993; Puolakkainen M et al., 1993; Grayston J T et al., 1996; Casas-Ciria J et al., 1996; Thomas G N et al., 1997; Jackson L A et al., 1997) and in patients with carotid impairments. Anatomicopathological and microbiological studies have detected *Chlamydia pneumoniae* in the vessels. The electron microscope has made it possible to visualize the bacterium (Ladany S et al., 1989), which has in fact been demonstrated by other techniques such as PCR (Campbell L A et al., 1992; Kuo C C et al., 1993; Kuo C C et al., 1988). It also appears that the bacterium is more frequently found in old atheromatous lesions. Other studies carried out on young subjects from 15 to 35 years have given the opportunity to study the coronary arteries of people without atherosclerosis, this observation not being possible in older subjects (the onset of the atheromatous disease is early). In these young subjects, the PCR studies did not find *Chlamydia pneumoniae* in subjects free of atheromatous disease, but revealed the presence of *Chlamydia pneumoniae* in two of the eleven subjects who showed early lesions and in six of the seven subjects who developed atheroma plaques. These studies therefore show that the atheroma plaque is very strongly correlated with the presence of *Chlamydia pneumoniae,* but the role played by the bacterium in vascular pathology is not yet defined.

The data relating to controlled clinical studies analysing the effect of treatments in *Chlamydia pneumoniae* infections are limited in number. Unlike penicillin, ampicillin or the sulphamides, erythromycin, tetracycline or doxycycline show an antibiotic activity in vitro against *Chlamydia pneumoniae*. However, a treatment at high doses should be continued for several weeks in order to avoid a recurrence of the infection. Accordingly, the use of two new macrolides, clarithromycin and azithromycin, whose diffusion, bioavailability and half-life allow shorter and better tolerated cures, is nowadays preferred. In the absence of definitive proof based on the results of clinical studies, an effective, without recurrences, and well-tolerated treatment of *Chlamydia pneumoniae* infections therefore remains desirable.

An even more important need up until now relates to a specific and sensitive diagnosis, which can be carried out conveniently and rapidly, allowing early screening for the infection. Methods based on *Chlamydia pneumoniae* culture are slow and require a considerable know-how because of the difficulty involved in the collection, preservation and storage of the strain under appropriate conditions. Methods based on antigen detection (EIA, DFA) or on nucleic acid amplification (PCR) provide tests which are more suitable for laboratory practice. A reliable, sensitive and convenient test, which allows distinction between serogroups and a fortiori between *Chlamydia pneumoniae* species is therefore highly desirable.

This is all the more important since the symptoms of *Chlamydia pneumoniae* infection appear slowly, since all the pathologies associated with these infections have not yet been identified, and since, as has been mentioned above, an association is suspected between these infections and serious chronic infections, asthma or atherosclerosis.

No vaccine is yet available against *Chlamydia pneumoniae:* this is due to the labile nature of the antigens specific to the strain, which has so far prevented their specific identification.

Although the number of studies and of animal models developed is high, the antigens used have not induced sufficient protective immunity to lead to the development of human vaccines. In the case of *Chlamydia pneumoniae,* the role of the immune defense in the physiology and pathology of the disease should probably be understood in order to develop satisfactory vaccines.

More detailed information relating to the biology of these strains, their interactions with their hosts, the associated phenomena of infectivity and those of escaping the immune defenses of the host in particular, and finally their involvement in the development of the these associated pathologies, will allow a better understanding of these mechanisms. In the light of the preceding text which shows in particular the limitations of the means of controlling *Chlamydia pneumoniae* infection, it is therefore at present essential, on the one hand, to develop molecular tools, in particular from a better genetic knowledge of *Chlamydia pneumoniae,* but also to develop new preventive and therapeutic treatments, new diagnostic methods and new vaccine strategies which are specific, effective and tolerated. This is precisely the object of the present invention.

The subject of the present invention is the nucleotide sequence having the sequence SEQ ID No. 1 of the *Chlamydia pneumoniae* genome. However, the invention is not limited to SEQ ID No. 1, but encompasses genomes and nucleotides encoding polypeptides of strain variants, polymorphisms, allelic variants, and mutants.

Thus, the subject of the present invention encompasses nucleotide sequences characterized in that they are chosen from:

a) the nucleotide sequence of SEQ ID No. 1, a nucleotide sequence exhibiting at least 99.9% identity with the sequence SEQ ID No. 1, the nucleotide sequence of the genomic DNA contained within ATCC Deposit No. VR2634, the nucleotide sequence of a clone insert within ATCC Deposit No. 207000: 207001 and 207002;

b) a nucleotide sequence homologous to the sequence SEQ ID No. 1;
c) a polynucleotide sequence that hybridizes to the nucleotide sequence of a) under conditions of high or intermediate stringency as described below:
   (i) By way of example and not limitation, procedures using conditions of high stringency are as follows: Prehybridization of filters containing DNA is carried out for 8 h to overnight at 65° C. in buffer composed of 6×SSC, 50 mM Tris-HCl (pH 7.5), 1 mM EDTA, 0.02% PVP, 0.02% Ficoll, 0.02% BSA, and 500 µg/ml denatured salmon sperm DNA. Filters are hybridized for 48 h at 65° C., the preferred hybridization temperature, in prehybridization mixture containing 100 µg/ml denatured salmon sperm DNA and 5–20×10$^6$ cpm of $^{32}$P-labeled probe. Alternatively, the hybridization step can be performed at 65° C. in the presence of SSC buffer, 1×SSC corresponding to 0.15M NaCl and 0.05 M Na citrate. Subsequently, filter washes can be done at 37° C. for 1 h in a solution containing 2×SSC, 0.01% PVP, 0.01% Ficoll, and 0.01% BSA, followed by a wash in 0.1×SSC at 50° C. for 45 min. Alternatively, filter washes can be performed in a solution containing 2×SSC and 0.1% SDS, or 0.5×SSC and 0.1% SDS, or 0.1×SSC and 0.1% SDS at 68° C. for 15 minute intervals. Following the wash steps, the hybridized probes are detectable by autoradiography. Other conditions of high stringency which may be used are well known in the art and as cited in Sambrook et al., 1989, Molecular Cloning, A Laboratory Manual, Second Edition, Cold Spring Harbor Press, N.Y., pp. 9.47–9.57; and Ausubel et al., 1989, Current Protocols in Molecular Biology, Green Publishing Associates and Wiley Interscience, N.Y. are incorporated herein in their entirety.
   (ii) By way of example and not limitation, procedures using conditions of intermediate stringency are as follows: Filters containing DNA are prehybridized, and then hybridized at a temperature of 60° C. in the presence of a 5×SSC buffer and labeled probe. Subsequently, filters washes are performed in a solution containing 2×SSC at 50° C. and the hybridized probes are detectable by autoradiography. Other conditions of intermediate stringency which may be used are well known in the art and as cited in Sambrook et al., 1989, Molecular Cloning, A Laboratory Manual, Second Edition, Cold Spring Harbor Press, N.Y., pp. 9.47–9.57; and Ausubel et al., 1989, Current Protocols in Molecular Biology, Green Publishing Associates and Wiley Interscience, N.Y. are incorporated herein in their entirety.
d) a nucleotide sequence complementary to the sequence SEQ ID No. 1 or complementary to a nucleotide sequence as defined in a), b) or c) and a nucleotide sequence of their corresponding RNA;
e) a nucleotide sequence of a representative fragment of the sequence SEQ ID No. 1, or of a representative fragment of the nucleotide sequence as defined in a), b), c) or d);
f) a nucleotide sequence comprising a sequence as defined in a), b), c), d) or e);
g) a nucleotide sequence capable of being obtained from a nucleotide sequence as defined in a), b), c), d), e) or f); and
h) a modified nucleotide sequence of a nucleotide sequence as defined in a), b), c), d), e), f) or g).

Nucleotide sequence, polynucleotide or nucleic acid are understood to mean, according to the present invention, either a double-stranded DNA, a single-stranded DNA or products of transcription of the said DNAs.

It should be understood that the present invention does not relate to the genomic nucleotide sequences of *Chlamydia pneumoniae* taken in their natural environment, that is to say in the natural state. They are sequences which may have been isolated, purified or partially purified, by separation methods such as, for example, ion-exchange chromatography, molecular size exclusion chromatography or affinity chromatography, or alternatively fractionation techniques based on solubility in various solvents, or by genetic engineering methods such as amplification, cloning or subcloning, it being possible for the sequences of the invention to be carried by vectors.

The nucleotide sequence SEQ ID No. 1 was obtained by sequencing the *Chlamydia pneumoniae* genome by the method of directed sequencing after fluorescent automated sequencing of the inserts of clones and assembling of these sequences of nucleotide fragments (inserts) by means of softwares (cf. Examples). In spite of the high precision of the sequence SEQ ID No. 1, it is possible that it does not perfectly, 100% represent the nucleotide sequence of the *Chlamydia pneumoniae* genome and that a few rare sequencing errors or uncertainties still remain in the sequence SEQ ID No. 1. In the present invention, the presence of an uncertainty for an amino acid is designated by "Xaa" and that for a nucleotide is designated by "N" in the sequence listing below. These few rare errors or uncertainties could be easily detected and corrected by persons skilled in the art using the entire chromosome and/or its representative fragments according to the invention and standard amplification, cloning and sequencing methods, it being possible for the sequences obtained to be easily compared, in particular by means of a computer software and using computer-readable media for recording the sequences according to the invention as described, for example, below. After correcting these possible rare errors or uncertainties, the corrected nucleotide sequence obtained would still exhibit at least 99.9% identity with the sequence SEQ ID No. 1. Such rare sequencing uncertainties are not present within the DNA contained within ATCC Deposit No. VR2634, 207000, 207001 or 207002, and whatever rare sequence uncertainties that exist within SEQ ID No. 1 can routinely be corrected utilizing the DNA of the ATCC deposits.

Homologous nucleotide sequence for the purposes of the present invention is understood to mean a nucleotide sequence having a percentage identity with the bases of the nucleotide sequence SEQ ID No. 1 of at least 80%, preferably 90% and 95%, this percentage being purely statistical and it being possible for the differences between the two nucleotide sequences to be distributed randomly and over their entire length. The said homologous sequences exhibiting a percentage identity with the bases of the nucleotide sequence SEQ ID No. 1 of at least 80%, preferably 90% and 95%, may comprise, for example, the sequences corresponding to the genomic sequence or to the sequences of its representative fragments of a bacterium belonging to the Chlamydia family, including the species *Chlamydia trachomatis, Chlamydia psittaci* and *Chlamydia pecorum* mentioned above, as well as the sequences corresponding to the genomic sequence or to the sequences of its representative fragments of a bacterium belonging to the variants of the species *Chlamydia pneumoniae*. In the present invention, the terms family and genus are mutually interchangeable, the terms variant, serotype, strain and subspecies are also mutually interchangeable. These homologous sequences may thus correspond to variations linked to mutations within the same species or between species and may correspond in particular to truncations, substitutions, deletions and/or additions of at least one nucleotide. The said homologous sequences may also correspond to variations linked to the degeneracy of the genetic code or to a bias in the genetic code which is specific to the family, to the species or to the variant and which are likely to be present in Chlamydia.

Protein and/or nucleic acid sequence homologies may be evaluated using any of the variety of sequence comparison algorithms and programs known in the art. Such algorithms and programs include, but are by no means limited to, TBLASTN, BLASTP, FASTA, TFASTA, and CLUSTALW (Pearson and Lipman, 1988, *Proc. Natl. Acad. Sci. USA* 85(8):2444–2448; Altschul et al., 1990, *J. Mol. Biol.* 215(3):403–410; Thompson et al., 1994, *Nucleic Acids Res.* 22(2):4673–4680; Higgins et al., 1996, *Methods Enzymol.* 266:383–402; Altschul et al., 1990, *J. Mol. Biol.* 215(3):403–410; Altschul et al., 1993, *Nature Genetics* 3:266–272).

In a particularly preferred embodiment, protein and nucleic acid sequence homologies are evaluated using the Basic Local Alignment Search Tool ("BLAST") which is well known in the art (see, e.g., Karlin and Altschul, 1990, *Proc. Natl. Acad. Sci. USA* 87:2267–2268; Altschul et al., 1990, *J. Mol. Biol.* 215:403–410; Altschul et al., 1993, *Nature Genetics* 3:266–272; Altschul et al., 1997, *Nuc. Acids Res.* 25:3389–3402). In particular, five specific BLAST programs are used to perform the following task:

(1) BLASTP and BLAST3 compare an amino acid query sequence against a protein sequence database;

(2) BLASTN compares a nucleotide query sequence against a nucleotide sequence database;

(3) BLASTX compares the six-frame conceptual translation products of a query nucleotide sequence (both strands) against a protein sequence database;

(4) TBLASTN compares a query protein sequence against a nucleotide sequence database translated in all six reading frames (both strands); and (5) TBLASTX compares the six-frame translations of a nucleotide query sequence against the six-frame translations of a nucleotide sequence database.

The BLAST programs identify homologous sequences by identifying similar segments, which are referred to herein as "high-scoring segment pairs," between a query amino or nucleic acid sequence and a test sequence which is preferably obtained from a protein or nucleic acid sequence database. High-scoring segment pairs are preferably identified (i.e., aligned) by means of a scoring matrix, many of which are known in the art. Preferably, the scoring matrix used is the BLOSUM62 matrix (Gonnet et al., 1992, *Science* 256:1443–1445; Henikoff and Henikoff, 1993, *Proteins* 17:49–61). Less preferably, the PAM or PAM250 matrices may also be used (see, e.g., Schwartz and Dayhoff, eds., 1978, *Matrices for Detecting Distance Relationships: Atlas of Protein Sequence and Structure,* Washington: National Biomedical Research Foundation).

The BLAST programs evaluate the statistical significance of all high-scoring segment pairs identified, and preferably selects those segments which satisfy a user-specified threshold of significance, such as a user-specified percent homology. Preferably, the statistical significance of a high-scoring segment pair is evaluated using the statistical significance formula of Karlin (see, e.g., Karlin and Altschul, 1990, *Proc. Natl. Acad. Sci. USA* 87:2267–2268).

Nucleotide sequence complementary to a sequence of the invention is understood to mean any DNA whose nucleotides are complementary to those of the sequence of the invention, and whose orientation is reversed (antiparallel sequence).

The present invention further comprises fragments of the sequences of a) through h), above. Representative fragments of the sequences according to the invention will be understood to mean any nucleotide fragment having at least 8 successive nucleotides, preferably at least 12 successive nucleotides, and still more preferably at least 15 or at least 20 successive nucleotides of the sequence from which it is derived. It is understood that such fragments refer only to portions of SEQ ID No. 1 that are not currently listed in a publicly available database.

Among these representative fragments, those capable of hybridizing under stringent conditions with a nucleotide sequence according to the invention are preferred. Hybridization under stringent conditions means that the temperature and ionic strength conditions are chosen such that they allow hybridization to be maintained between two complementary DNA fragments.

By way of illustration, high stringency conditions for the hybridization step for the purposes of defining the nucleotide fragments described above, are advantageously the following.

The hybridization is carried out at a preferred temperature of 65° C. in the presence of SSC buffer, 1×SSC corresponding to 0.15 M NaCl and 0.05 M Na citrate. The washing steps may be, for example, the following: 2×SSC, 0.1% SDS at room temperature followed by three washes with 1×SSC, 0.1% SDS; 0.5×SSC, 0.1% SDS; 0.1×SSC, 0.1% SDS at 68° C. for 15 minutes.

Intermediate stringency conditions, using, for example, a temperature of 60° C. in the presence of a 5×SSC buffer, or of low stringency, for example a temperature of 50° C. in the presence of a 5×SSC buffer, respectively require a lower overall complementarity for the hybridization between the two sequences.

The stringent hybridization conditions described above for a polynucleotide of about 300 bases in size will be adapted by persons skilled in the art for larger- or smaller-sized oligonucleotides, according to the teaching of Sambrook et al., 1989.

Among the representative fragments according to the invention, those which can be used as primer or probe in methods which make it possible to obtain homologous sequences or their representative fragments according to the invention, or to reconstitute a genomic fragment found to be incomplete in the sequence SEQ ID No. 1 or carrying an error or an uncertainty, are also preferred, these methods, such as the polymerase chain reaction (PCR), cloning and sequencing of nucleic acid being well known to persons skilled in the art. These homologous nucleotide sequences corresponding to mutations or to inter- or intra-species variations, as well as the complete genomic sequence or one of its representative fragments capable of being reconstituted, of course form part of the invention.

Among the said representative fragments, those which can be used as primer or probe in methods allowing diagnosis of the presence of *Chlamydia pneumoniae* or one of its associated microorganisms as defined below are also preferred.

The representative fragments capable of modulating, regulating, inhibiting or inducing the expression of a gene of *Chlamydia pneumoniae* or one of its associated microorganisms, and/or capable of modulating the replication cycle of *Chlamydia pneumoniae* or one of its associated microorganisms in the host cell and/or organism, are also preferred. Replication cycle is intended to designate invasion, multiplication, intracellular localization, in particular retention in the vacuole and inhibition of the process of fusion to the lysosome, and propagation of *Chlamydia pneumoniae* or one of its associated microorganisms from host cells to host cells.

Among the said representative fragments, those corresponding to nucleotide sequences corresponding to open reading frames, called ORF sequences (ORF for open reading frame), and encoding polypeptides, such as for example, but without being limited thereto, the ORF sequences which will be later described, are finally preferred.

The representative fragments according to the invention may be obtained, for example, by specific amplification, such as PCR, or after digestion, with appropriate restriction enzymes, of nucleotide sequences according to the invention; these methods are in particular described in the manual by Sambrook et al., 1989. The said representative fragments may also be obtained by chemical synthesis when they are not too large in size and according to methods well known to persons skilled in the art. For example, such fragments can be obtained by isolating fragments of the genomic DNA of ATCC Deposit No. VR2634 or a clone insert present at this ATCC Deposit No. 207000: 207001 and 207002.

The representative fragments according to the invention may be used, for example, as primer, to reconstitute some of the said representative fragments, in particular those in which a portion of the sequence is likely to be missing or imperfect, by methods well known to persons skilled in the art such as amplification, cloning or sequencing techniques.

Modified nucleotide sequence will be understood to mean any nucleotide sequence obtained by mutagenesis according to techniques well known to persons skilled in the art, and exhibiting modifications in relation to the normal sequences, for example mutations in the regulatory and/or promoter sequences for the expression of a polypeptide, in particular leading to a modification of the level of expression of the said polypeptide or to a modulation of the replicative cycle.

Modified nucleotide sequence will also be understood to mean any nucleotide sequence encoding a modified polypeptide as defined below.

The subject of the present invention also includes *Chlamydia pneumoniae* nucleotide sequences characterized in that they are chosen from a nucleotide sequence of an open reading frame (ORF), that is, the ORF2 to ORF1297 sequences.

The ORF2 to ORF1297 nucleotide sequences are defined in Tables 1 and 2, infra, by their position on the sequence SEQ ID No. 1. For example, the ORF2 sequence is defined by the nucleotide sequence between the nucleotides at position 42 and 794 on the sequence SEQ ID No. 1, ends included. ORF2 to ORF1297 have been identified via homology analyses as well as via analyses of potential ORF start sites, as discussed in the examples below. It is to be understood that each identified ORF of the invention comprises a nucleotide sequence that spans the contiguous nucleotide sequence from the codon immediately 3' to the stop codon of the preceding ORF and through the 5' codon to the next stop codon of SEQ ID No.:1 in-frame to the ORF nucleotide sequence. Table 2, infra, lists the beginning, end and potential start site of each of ORFs 1–1297. In one embodiment, the ORF comprises the contiguous nucleotide sequence spanning from the potential ORF start site downstream (that is, 3') to the ORF stop codon (or the ORF codon immediately adjacent to and upstream of the ORF stop codon). ORF2 to ORF1297 encode the polypeptides of SEQ ID No. 2 to SEQ ID No. 1291 and of SEQ ID No. 6844 to SEQ ID No. 6849, respectively.

Upon introduction of minor frameshifts, certain individual ORFs can comprise larger "combined" ORFs. A list of such putative "combined" ORFs is shown in Table 3, below. For example, a combined ORF can comprise ORF 25, ORF 26 and ORF 27, including intervening in-frame, nucleotide sequences. The order of ORFs (5' to 3'), within each "combined" ORF is as listed. It is to be understood that when ORF2 to ORF1297 are referred to herein, such reference is also meant to include "combined" ORFs. Polypeptide sequences encoded by such "combined" ORFs are also part of the present invention.

TABLE 3

| |
|---|
| ORF 25, ORF 26, ORF 27; |
| ORF 28, ORF 29, ORF 30; |
| ORF 31, ORF 32; |
| ORF 33, ORF 35; |
| ORF 466, ORF 467; |
| ORF 468, ORF 469; |
| ORF 477, ORF 476, ORF 474; |
| ORF 480, ORF 482; |
| ORF 483, ORF 485, ORF 486, ORF 500; |
| ORF 503, ORF 504, ORF 505; |
| ORF 506, ORF 507; |
| ORF 1211, ORF 647; |
| ORF 1286, ORF 1039; |
| ORF 691, ORF 690; |
| ORF 105, ORF 106; |
| ORF 170, ORF 171; ORF 394, ORF 393; |
| ORF 453, ORF 452, ORF 451; |
| ORF 526, ORF 525; |
| ORF 757, ORF 756, ORF 755; |
| ORF 856, ORF 855; |
| CRF 958, ORF 957; |
| ORF 915, ORF 914, ORF 913; |
| ORF 543, ORF 544; |
| ORF 1266, ORF 380; |
| ORF 745, ORF 744; |
| ORF 777, ORF 776; |
| ORF 343, ORF 1297, and representative fragments. |

Table 1 also depicts the results of homology searches that compared the sequences of the polypeptides encoded by each of the ORFs to sequences present in public published databases. It is understood that those polypeptides listed in Table 1 as exhibiting greater than about 95% identity to a polypeptide present in a publicly disclosed database are not considered part of the present invention; likewise in this embodiment, those nucleotide sequences encoding such polypeptides are not considered part of the invention. In another embodiment, it is understood that those polypeptides listed in Table 1 as exhibiting greater than about 99% identity to a polypeptide present in a publicly disclosed database are not considered part of the invention; likewise, in this embodiment, those nucleotide sequences encoding such polypeptides are not considered part of the invention.

The invention also relates to the nucleotide sequences characterized in that they comprise a nucleotide sequence chosen from:

a) an ORF2 to ORF1297, a "combined" ORF nucleotide sequence, the nucleotide sequence of the genomic DNA contained within ATCC Deposit No. VR2634 or the nucleotide sequence of a clone insert in ATCC Deposit No. 207000: 207001 and 207002 according to the invention;

b) a homologous nucleotide sequence exhibiting at least 80% identity across an entire ORF2 to ORF1297 nucleotide sequence according to the invention or as defined in a);

c) a polynucleotide sequence that hybridizes to ORF2 to ORF1297 under conditions of high or intermediate stringency as described below:
   (i) By way of example and not limitation, procedures using conditions of high stringency are as follows: Prehybridization of filters containing DNA is carried out for 8 h to overnight at 65° C. in buffer composed of 6×SSC, 50 mM Tris-HCl (pH 7.5), 1 mM EDTA, 0.02% PVP, 0.02% Ficoll, 0.02% BSA, and 500 µg/ml denatured salmon sperm DNA. Filters are hybridized for 48 h at 65° C., the preferred hybridization temperature, in prehybridization mixture containing 100 µg/ml denatured salmon sperm DNA and 5–20×10$^6$ cpm of $^{32}$P-labeled probe. Alternatively, the hybridization step can be performed at 65° C. in the presence of SSC buffer, 1×SSC corresponding to 0.15M NaCl and 0.05 M Na citrate. Subsequently, filter washes can be done at 37° C. for 1 h in a solution containing 2×SSC, 0.01% PVP, 0.01% Ficoll, and 0.01% BSA, followed by a wash in 0.1×SSC at 50° C. for 45 min. Alternatively, filter washes can be performed in a solution containing 2×SSC and 0.1% SDS, or 0.5×SSC and 0.1% SDS, or 0.1×SSC and 0.1% SDS at 68° C. for 15 minute intervals. Following the wash steps, the hybridized probes are detectable by autoradiography. Other conditions of high stringency which may be used are well known in the art and as cited in Sambrook et al., 1989, Molecular Cloning, A Laboratory Manual, Second Edition, Cold Spring Harbor Press, N.Y., pp. 9.47–9.57; and Ausubel et al., 1989, Current Protocols in Molecular Biology, Green Publishing Associates and Wiley Interscience, N.Y. are incorporated herein in their entirety. Preferably, such sequences encode a homolog of a polypeptide encoded by one of ORF2 to ORF1297. In one embodiment, such sequences encode a *Chlamydia pneumoniae* polypeptide.
   (ii) By way of example and not limitation, procedures using conditions of intermediate stringency are as follows: Filters containing DNA are prehybridized, and then hybridized at a temperature of 60° C. in the presence of a 5×SSC buffer and labeled probe. Subsequently, filters washes are performed in a solution containing 2×SSC at 50° C. and the hybridized probes are detectable by autoradiography. Other conditions of intermediate stringency which may be used are well known in the art and as cited in Sambrook et al., 1989, Molecular Cloning, A Laboratory Manual, Second Edition, Cold Spring Harbor Press, N.Y., pp. 9.47–9.57; and Ausubel et al., 1989, Current Protocols in Molecular Biology, Green Publishing Associates and Wiley Interscience, N.Y. are incorporated herein in their entirety. Preferably, such sequences encode a homolog of a polypeptide encoded by one of ORF2 to ORF1297. In one embodiment, such sequences encode a *Chlamydia pneumoniae* polypeptide.

d) complementary or RNA nucleotide sequence corresponding to an ORF2 to ORF1297 sequence according to the invention or as defined in a), b) or c);

e) a nucleotide sequence of a representative fragment of an ORF2 to ORF1297 sequence according to the invention or of a sequence as defined in a), b), c) or d);

f) a nucleotide sequence capable of being obtained from an ORF2 to ORF1297 sequence according to the invention or as defined in a), b), c), d) or e); and g) a modified nucleotide sequence of an ORF2 to ORF1297 sequence according to the invention or as defined in a), b), c), d), e) or f);

As regards the homology with the ORF2 to ORF1297 nucleotide sequences, the homologous sequences exhibiting a percentage identity with the bases of one of the ORF2 to ORF1297 nucleotide sequences of at least 80%, preferably 90% and 95%, are preferred. Such homologous sequences are identified routinely via, for example, the algorithms described above and in the examples below. The said homologous sequences correspond to the homologous sequences as defined above and may comprise, for example, the sequences corresponding to the ORF sequences of a bacterium belonging to the Chlamydia family, including the species *Chlamydia trachomatis, Chlamydia psittaci* and *Chlamydia pecorum* mentioned above, as well as the sequences corresponding to the ORF sequences of a bacterium belonging to the variants of the species *Chlamydia pneumoniae*. These homologous sequences may likewise correspond to variations linked to mutations within the same species or between species and may correspond in particular to truncations, substitutions, deletions and/or additions of at least one nucleotide. The said homologous sequences may also correspond to variations linked to the degeneracy of the genetic code or to a bias in the genetic code which is specific to the family, to the species or to the variant and which are likely to be present in Chlamydia.

The invention comprises polypeptides encoded by a nucleotide sequence according to the invention, preferably by a representative fragment of the sequence SEQ ID No. 1 and corresponding to an ORF sequence, in particular the *Chlamydia pneumoniae* polypeptides, characterized in that they are chosen from the sequences SEQ ID No. 2 to SEQ ID No. 1291 or SEQ ID No. 6844 to SEQ ID No. 6849 and representative fragments thereof. However, the invention is not limited to polypeptides encoded by ORFs in SEQ ID No. 1 and its corresponding ORF sequences, but encompasses polypeptides of strain variants, polymorphisms, allelic variants, and mutants.

Thus, the invention also comprises the polypeptides characterized in that they comprise a polypeptide chosen from:

a) a polypeptide encoded by a polynucleotide sequence in SEQ ID No. 1 (e.g., any polypeptide encoded by a polynucleotide sequence corresponding to ORF2 to ORF1297 and/or representative fragments thereof) according to the invention;

b) a polypeptide homologous to a polypeptide according to the invention, or as defined in a);

c) a polypeptide encoded by a polynucleotide sequence that hybridizes to SEQ ID No. 1 or ORF2 to ORF1297 under high or intermediate stringency as described below:

(i) By way of example and not limitation, procedures using conditions of high stringency are as follows: Prehybridization of filters containing DNA is carried out for 8 h to overnight at 65° C. in buffer composed of 6×SSC, 50 mM Tris-HCl (pH 7.5), 1 mM EDTA, 0.02% PVP, 0.02% Ficoll, 0.02% BSA, and 500 μg/ml denatured salmon sperm DNA. Filters are hybridized for 48 h at 65° C., the preferred hybridization temperature, in prehybridization mixture containing 100 μg/ml denatured salmon sperm DNA and 5–20×$10^6$ cpm of $^{32}$P-labeled probe. Alternatively, the hybridization step can be performed at 65° C. in the presence of SSC buffer, 1×SSC corresponding to 0.15M NaCl and 0.05 M Na citrate. Subsequently, filter washes can be done at 37° C. for 1 h in a solution containing 2×SSC, 0.01% PVP, 0.01% Ficoll, and 0.01% BSA, followed by a wash in 0.1×SSC at 50° C. for 45 min. Alternatively, filter washes can be performed in a solution containing 2×SSC and 0.1% SDS, or 0.5×SSC and 0.1% SDS, or 0.1×SSC and 0.1% SDS at 68° C. for 15 minute intervals. Following the wash steps, the hybridized probes are detectable by autoradiography. Other conditions of high stringency which may be used are well known in the art and as cited in Sambrook et al., 1989, Molecular Cloning, A Laboratory Manual, Second Edition, Cold Spring Harbor Press, N.Y., pp. 9.47–9.57; and Ausubel et al., 1989, Current Protocols in Molecular Biology, Green Publishing Associates and Wiley Interscience, N.Y. are incorporated herein in their entirety. Preferably such polypeptide represents a homolog of a polypeptide encoded by ORF2 to ORF1297. Preferably, such sequences encode a homolog of a polypeptide encoded by one of ORF2 to ORF1297. In one embodiment, such sequences encode a *Chlamydia pneumoniae* polypeptide.

(ii) By way of example and not limitation, procedures using conditions of intermediate stringency are as follows: Filters containing DNA are prehybridized, and then hybridized at a temperature of 60° C. in the presence of a 5×SSC buffer and labeled probe. Subsequently, filters washes are performed in a solution containing 2×SSC at 50° C. and the hybridized probes are detectable by autoradiography. Other conditions of intermediate stringency which may be used are well known in the art and as cited in Sambrook et al., 1989, Molecular Cloning, A Laboratory Manual, Second Edition, Cold Spring Harbor Press, N.Y., pp. 9.47–9.57; and Ausubel et al., 1989, Current Protocols in Molecular Biology, Green Publishing Associates and Wiley Interscience, N.Y. are incorporated herein in their entirety. Preferably, such sequences encode a homolog of a polypeptide encoded by one of ORF2 to ORF1297. In one embodiment, such sequences encode a *Chlamydia pneumoniae* polypeptide.

d) a fragment of at least 5 amino acids of a polypeptide according to the invention, or as defined in a), b) or c);

e) a biologically active fragment of a polypeptide according to the invention, or as defined in a), b), c) or d); and f) a modified polypeptide of a polypeptide according to the invention, as defined in a), b), c), d) or e).

In the present description, the terms polypeptide, peptide and protein are interchangeable.

It should be understood that the invention does not relate to the polypeptides in natural form, that is to say hat they are not taken in their natural environment but that they may have been isolated or obtained by purification from natural sources, or alternatively obtained by genetic recombination, or else by chemical synthesis and that they may, in this case, comprise nonnatural amino acids, as will be described below.

Homologous polypeptide will be understood to designate the polypeptides exhibiting, in relation to the natural polypeptide, certain modifications such as in particular a deletion, addition or substitution of at least one amino acid, a truncation, an extension, a chimeric fusion, and/or a mutation, or polypeptides exhibiting post-translational modifications. Among the homologous polypeptides, those whose amino acid sequence exhibits at least 80%, preferably 90%, homology or identity with the amino acid sequences of the polypeptides according to the invention are preferred. In the case of a substitution, one or more consecutive or nonconsecutive amino acids are replaced by "equivalent" amino acids. The expression "equivalent" amino acid is intended here to designate any amino acid capable of being substituted for one of the amino acids in the basic structure without, however, essentially modifying the biological activities of the corresponding peptides and as will be defined later.

Protein and/or nucleic acid sequence homologies may be evaluated using any of the variety of sequence comparison algorithms and programs known in the art. Such algorithms and programs include, but are by no means limited to, TBLASTN, BLASTP, FASTA, TFASTA, and CLUSTALW (Pearson and Lipman, 1988, *Proc. Natl. Acad. Sci. USA* 85(8):2444–2448; Altschul et al., 1990, *J. Mol. Biol.* 215(3):403–410; Thompson et al., 1994, *Nucleic Acids Res.* 22(2):4673–4680; Higgins et al., 1996, *Methods Enzymol.* 266:383–402; Altschul et al., 1990, *J. Mol. Biol.* 215(3):403–410; Altschul et al., 1993, *Nature Genetics* 3:266–272).

In a particularly preferred embodiment, protein and nucleic acid sequence homologies are evaluated using the Basic Local Alignment Search Tool ("BLAST") which is well know in the art (see, e.g., Karlin and Altschul, 1990, *Proc. Natl. Acad. Sci. USA* 87:2267–2268; Altschul et al., 1990, *J. Mol. Biol.* 215:403–410; Altschul et al., 1993, *Nature Genetics* 3:266–272; Altschul et al., 1997, *Nuc. Acids Res.* 25:3389–3402). In particular, five specific BLAST programs are used to perform the following task:

(1) BLASTP and BLAST3 compare an amino acid query sequence against a protein sequence database;

(2) BLASTN compares a nucleotide query sequence against a nucleotide sequence database;

(3) BLASTX compares the six-frame conceptual translation products of a query nucleotide sequence (both strands) against a protein sequence database;

(4) TBLASTN compares a query protein sequence against a nucleotide sequence database translated in all six reading frames (both strands); and (5) TBLASTX compares the six-frame translations of a nucleotide query sequence against the six-frame translations of a nucleotide sequence database.

The BLAST programs identify homologous sequences by identifying similar segments, which are referred to herein as "high-scoring segment pairs," between a query amino or nucleic acid sequence and a test sequence which is preferably obtained from a protein or nucleic acid sequence database. High-scoring segment pairs are preferably identified (i.e., aligned) by means of a scoring matrix, many of which are known in the art. Preferably, the scoring matrix used is the BLOSUM62 matrix (Gonnet et al., 1992, *Science* 256:1443–1445; Henikoff and Henikoff, 1993, *Proteins* 17:49–61). Less preferably, the PAM or PAM250 matrices may also be used (see, e.g., Schwartz and Dayhoff, eds., 1978, *Matrices for Detecting Distance Relationships: Atlas of Protein Sequence and Structure,* Washington: National Biomedical Research Foundation).

The BLAST programs evaluate the statistical significance of all high-scoring segment pairs identified, and preferably selects those segments which satisfy a user-specified threshold of significance, such as a user-specified percent homology. Preferably, the statistical significance of a high-scoring segment pair is evaluated using the statistical significance formula of Karlin (see, e.g., Karlin and Altschul, 1990, *Proc. Natl. Acad. Sci. USA* 87:2267–2268).

Equivalent amino acids may be determined either based on their structural homology with the amino acids for which they are substituted, or on results of comparative tests of biological activity between the various polypeptides which may be carried out.

By way of example, there may be mentioned the possibilities of substitutions which may be carried out without resulting in a substantial modification of the biological activity of the corresponding modified polypeptides; the replacements, for example, of leucine with valine or isoleucine, of aspartic acid with glutamic acid, of glutamine with asparagine, of arginine with lysine, and the like, the reverse substitutions naturally being feasible under the same conditions.

The homologous polypeptides also correspond to the polypeptides encoded by the homologous nucleotide sequences as defined above and thus comprise in the present definition the mutated polypeptides or polypeptides corresponding to inter- or intra-species variations which may exist in Chlamydia, and which correspond in particular to truncations, substitutions, deletions and/or additions of at least one amino acid residue.

Biologically active fragment of a polypeptide according to the invention will be understood to designate in particular a polypeptide fragment, as defined below, exhibiting at least one of the characteristics of the polypeptides according to the invention, in particular in that it is:

capable of eliciting an immune response directed against Chlamydia pneumoniae; and/or capable of being recognized by an antibody specific for a polypeptide according to the invention; and/or capable of binding to a polypeptide or to a nucleotide sequence of Chlamydia pneumoniae; and/or capable of modulating, regulating, inducing or inhibiting the expression of a gene of Chlamydia pneumoniae or one of its associated microorganisms, and/or capable of modulating the replication cycle of Chlamydia pneumoniae or one of its associated microorganisms in the host cell and/or organism; and/or capable of generally exerting an even partial physiological activity, such as for example a structural activity (cellular envelope, ribosome), an enzymatic (metabolic) activity, a transport activity, an activity in the secretion or in the virulence.

A polypeptide fragment according to the invention is understood to designate a polypeptide comprising a minimum of 5 amino acids, preferably 10 amino acids or preferably 15 amino acids. It is to be understood that such fragments refer only to portions of polypeptides encoded by ORF2 to ORF1297 that are not currently listed in a publicly available database.

The polypeptide fragments according to the invention may correspond to isolated or purified fragments which are naturally present in Chlamydia pneumoniae or which are secreted by Chlamydia pneumoniae, or may correspond to fragments capable of being obtained by cleaving the said polypeptide with a proteolytic enzyme, such as trypsin or chymotrypsin or collagenase, or with a chemical reagent, such as cyanogen bromide (CNBr) or alternatively by placing the said polypeptide in a highly acidic environment, for example at pH 2.5. Such polypeptide fragments may be equally well prepared by chemical synthesis, using hosts transformed with an expression vector according to the invention containing a nucleic acid allowing the expression of the said fragments, placed under the control of appropriate elements for regulation and/or expression.

"Modified polypeptide" of a polypeptide according to the invention is understood to designate a polypeptide obtained by genetic recombination or by chemical synthesis as will be described below, exhibiting at least one modification in relation to the normal sequence. These modifications may in particular affect amino acids responsible for a specificity or for the efficiency of the activity, or responsible for the structural conformation, for the charge or for the hydrophobicity, and for the capacity for multimerization and for membrane insertion of the polypeptide according to the invention. It is thus possible to create polypeptides with an equivalent, an increased or a reduced activity, and with an equivalent, a narrower or a broader specificity. Among the modified polypeptides, there may be mentioned the polypeptides in which up to 5 amino acids may be modified, truncated at the N- or C-terminal end, or alternatively deleted, or else added.

As is indicated, the modifications of the polypeptide may have in particular the objective:

of making it capable of modulating, regulating, inhibiting or inducing the expression of a gene of Chlamydia, in particular of Chlamydia pneumoniae and its variants, or one of its associated microorganisms, and/or capable of modulating the replication cycle of Chlamydia, in particular of Chlamydia pneumoniae and its variants, or one of its associated microorganisms, in the host cell and/or organism, of allowing its use in methods of biosynthesis or of biodegradation, or its incorporation into vaccine compositions, of modifying its bioavailability as a compound for therapeutic use.

The said modified polypeptides may also be used on any cell or microorganism for which the said modified polypeptides will be capable of modulating, regulating, inhibiting or inducing gene expression, or of modulating the growth or the replication cycle of the said cell or of the said microorganism. The methods allowing demonstration of the said modulations on eukaryotic or prokaryotic cells are well known to persons skilled in the art. The said cells or microorganisms will be chosen, in particular, from tumour cells or infectious microorganisms and the said modified polypeptides may be used for the prevention or treatment of pathologies linked to the presence of the said cells or of the said microorganisms. It is also clearly understood that the nucleotide sequences encoding the said modified polypeptides may be used for the said modulations, for example by the intermediacy of vectors according to the invention and which are described below, so as to prevent or to treat the said pathologies.

The above modified polypeptides may be obtained using combinatory chemistry, in which it is possible to systematically vary portions of the polypeptide before testing them on models, cell cultures or microorganisms for example, so as to select the compounds which are the most active or which exhibit the desired properties.

Chemical synthesis also has the advantage of being able to use:

nonnatural amino acids, or nonpeptide bonds.

Accordingly, in order to extend the life of the polypeptides according to the invention, it may be advantageous to use nonnatural amino acids, for example in the D form, or alternatively amino acid analogues, in particular sulphur-containing forms for example.

Finally, the structure of the polypeptides according to the invention, its homologous or modified forms, as well as the corresponding fragments may be integrated into chemical structures of the polypeptide type and the like. Accordingly, it may be advantageous to provide at the N- and C-terminal ends compounds which are not recognized by proteases.

Also forming part of the invention are the nucleotide sequences encoding a polypeptide according to the invention. Described below are ORF nucleotide sequences encoding polypeptides exhibiting particularly preferable characteristics. For each group of preferred ORFS described below, it is to be understood that in addition to the individual ORFs listed, in instances wherein such ORFS are present as part of "combined" ORFs, the "combined" ORFs are also to be included within the preferred group.

More particularly, the subject of the invention is nucleotide sequences, characterized in that they encode a polypeptide of the cellular envelope, preferably of the outer cellular envelope of *Chlamydia pneumoniae* or one of its representative fragments, such as for example the predominant proteins of the outer membrane, the adhesion proteins or the proteins entering into the composition of the Chlamydia wall. Among these sequences, the sequences comprising a nucleotide sequence chosen from the following sequences are most preferred:

ORF15; ORF25; ORF26; ORF27; ORF28; ORF29; ORF30; ORF31; ORF32; ORF33; ORF35; ORF68; ORF124; ORF275; ORF291; ORF294; ORF327; ORF342; ORF364; ORF374; ORF380; ORF414; ORF439; ORF466; ORF467; ORF468; ORF469; ORF470; ORF472; ORF474; ORF476; ORF477; ORF478; ORF479; ORF480; ORF482; ORF485; ORF500; ORF501; ORF503; ORF504; ORF505; ORF506; ORF520; ORF578; ORF580; ORF581; ORF595; ORF596; ORF597; ORF737; ORF830; ORF834; ORF836; ORF893; ORF917; ORF932; ORF976; ORF1035; ORF1045; ORF1090 and one of their representative fragments.

The structure of the cytoplasmic membranes and of the wall of bacteria is dependent on the associated proteins. The structure of the cytoplasmic membrane makes it impermeable to water, to water-soluble substances and to small-sized molecules (ions, small inorganic molecules, peptides or proteins). To enter into or to interfere with a cell or a bacterium, a ligand must establish a special relationship with a protein anchored in the cytoplasmic membrane (the receptor). These proteins which are anchored on the membrane play an important role in metabolism since they control the exchanges in the bacterium. These exchanges apply to molecules of interest for the bacterium (small molecules such as sugars and small peptides) as well as undesirable molecules for the bacterium such as antibiotics or heavy metals.

The double lipid layer structure of the membrane requires the proteins which are inserted therein to have hydrophobic domains of about twenty amino acids forming an alpha helix. Predominantly hydrophobic and potentially transmembrane regions may be predicted from the primary sequence of the proteins, itself deduced from the nucleotide sequence. The presence of one or more putative transmembrane domains raises the possibility for a protein to be associated with the cytoplasmic membrane and to be able to play an important metabolic role therein or alternatively for the protein thus exposed to be able to exhibit potentially protective epitopes.

If the proteins inserted into the membrane exhibit several transmembrane domains capable of interacting with one another via electrostatic bonds, it then becomes possible for these proteins to form pores which go across the membrane which becomes permeable for a number of substances. It should be noted that proteins which do not have transmembrane domains may also be anchored by the intermediacy of fatty acids in the cytoplasmic membrane, it being possible for the breaking of the bond between the protein and its anchor in some cases to be responsible for the release of the peptide outside the bacterium.

Preferably, the invention relates to the nucleotide sequences according to the invention, characterized in that they encode a *Chlamydia pneumoniae* transmembrane polypeptide or one of its representative fragments, having between 1 and 3 transmembrane domains and in that they comprise a nucleotide sequence chosen from the following sequences:

ORF2; ORF3; ORF6; ORF9; ORF10; ORF11; ORF13; ORF14; ORF16; ORF18; ORF19; ORF20; ORF21; ORF22; ORF25; ORF27; ORF28; ORF29; ORF30; ORF31; ORF32; ORF33; ORF34; ORF35; ORF37; ORF39; ORF41; ORF42; ORF44; ORF45; ORF46; ORF47; ORF48; ORF49; ORF50; ORF53; ORF54; ORF56; ORF57; ORF59; ORF60; ORF61; ORF62; ORF63; ORF64; ORF65; ORF66; ORF69; ORF72; ORF73; ORF74; ORF76; ORF77; ORF78; ORF79; ORF80; ORF82; ORF84; ORF85; ORF86; ORF88; ORF89; ORF90; ORF91; ORF92; ORF93; ORF95; ORF96; ORF98; ORF99; ORF100; ORF101; ORF102; ORF103; ORF104; ORF105; ORF106; ORF107; ORF108; ORF114; ORF117; ORF118; ORF122; ORF123; ORF124; ORF125; ORF129; ORF130; ORF131; ORF132; ORF133; ORF134; ORF135; ORF137; ORF138; ORF139; ORF140; ORF141; ORF142; ORF143; ORF145; ORF146; ORF147; ORF150; ORF151; ORF152; ORF156; ORF157; ORF158; ORF159; ORF160; ORF161; ORF162; ORF164; ORF166; ORF167; ORF170; ORF173; ORF175; ORF176; ORF178; ORF179; ORF180; ORF182; ORF183; ORF184; ORF185; ORF186; ORF187; ORF188; ORF189; ORF190; ORF191; ORF192; ORF194; ORF195; ORF196; ORF197; ORF198; ORF199; ORF200; ORF201; ORF202; ORF205; ORF207; ORF208; ORF209; ORF210; ORF212; ORF215; ORF219; ORF220; ORF224; ORF226; ORF227; ORF228; ORF231; ORF232; ORF233; ORF234; ORF235; ORF236; ORF238; ORF239; ORF240; ORF241; ORF242; ORF244; ORF247; ORF251; ORF252; ORF253; ORF255; ORF256; ORF257; ORF258; ORF260; ORF262; ORF263; ORF266; ORF267; ORF268; ORF269; ORF270; ORF273; ORF274; ORF276; ORF278; ORF279; ORF280; ORF281; ORF282; ORF283; ORF284; ORF286; ORF287; ORF289; ORF290; ORF291; ORF293; ORF294; ORF297; ORF304; ORF305; ORF307; ORF308; ORF309; ORF310; ORF311; ORF313; ORF314; ORF315; ORF316; ORF318; ORF319; ORF320; ORF321; ORF322; ORF323; ORF324; ORF325; ORF326; ORF331; ORF332; ORF336; ORF338; ORF339; ORF341; ORF344; ORF345; ORF346; ORF350; ORF352; ORF353; ORF356; ORF357; ORF358; ORF359; ORF360; ORF362; ORF365; ORF366; ORF367; ORF370; ORF372; ORF373; ORF376; ORF377; ORF378; ORF379; ORF381; ORF382; ORF383; ORF384; ORF385; ORF386; ORF387; ORF390; ORF392; ORF393; ORF394; ORF396; ORF398; ORF399; ORF400; ORF404; ORF408; ORF410; ORF411; ORF413; ORF416; ORF417; ORF418; ORF420; ORF422; ORF424; ORF427; ORF428; ORF429; ORF430; ORF431; ORF433; ORF434; ORF437; ORF440; ORF441; ORF442; ORF443;

ORF444; ORF445; ORF447; ORF450; ORF451; ORF452; ORF455; ORF456; ORF459; ORF460; ORF461; ORF462; ORF463; ORF464; ORF465; ORF467; ORF469; ORF471; ORF474; ORF475; ORF476; ORF477; ORF479; ORF482; ORF483; ORF484; ORF485; ORF486; ORF487; ORF488; ORF491; ORF493; ORF494; ORF497; ORF498; ORF499; ORF503; ORF508; ORF509; ORF510; ORF512; ORF514; ORF515; ORF516; ORF517; ORF518; ORF520; ORF521; ORF523; ORF525; ORF527; ORF528; ORF529; ORF530; ORF531; ORF533; ORF534; ORF535; ORF536; ORF537; ORF540; ORF541; ORF543; ORF544; ORF545; ORF546; ORF548; ORF549; ORF551; ORF553; ORF554; ORF555; ORF556; ORF557; ORF558; ORF559; ORF560; ORF562; ORF563; ORF564; ORF565; ORF566; ORF569; ORF571; ORF573; ORF576; ORF577; ORF581; ORF583; ORF584; ORF585; ORF586; ORF588; ORF591; ORF592; ORF594; ORF595; ORF596; ORF597; ORF599; ORF600; ORF603; ORF605; ORF608; ORF614; ORF615; ORF620; ORF621; ORF622; ORF623; ORF624; ORF625; ORF629; ORF630; ORF631; ORF633; ORF634; ORF637; ORF642; ORF644; ORF645; ORF647; ORF648; ORF652; ORF654; ORF655; ORF657; ORF658; ORF659; ORF660; ORF661; ORF664; ORF665; ORF666; ORF667; ORF670; ORF671; ORF672; ORF673; ORF674; ORF676; ORF679; ORF681; ORF684; ORF687; ORF688; ORF689; ORF690; ORF693; ORF694; ORF695; ORF696; ORF697; ORF698; ORF699; ORF700; ORF701; ORF703; ORF705; ORF706; ORF707; ORF708; ORF710; ORF712; ORF715; ORF716; ORF717; ORF718; ORF719; ORF721; ORF722; ORF723; ORF725; ORF726; ORF727; ORF728; ORF729; ORF730; ORF731; ORF733; ORF736; ORF737; ORF738; ORF740; ORF741; ORF742; ORF743; ORF747; ORF748; ORF750; ORF752; ORF754; ORF755; ORF756; ORF757; ORF759; ORF760; ORF761; ORF762; ORF763; ORF764; ORF765; ORF766; ORF767; ORF768; ORF772; ORF774; ORF775; ORF777; ORF781; ORF783; ORF788; ORF791; ORF792; ORF793; ORF794; ORF795; ORF796; ORF797; ORF798; ORF799

Preferably, the invention relates to the nucleotide sequences according to the invention, characterized in that they encode a *Chlamydia pneumoniae* transmembrane polypeptide or one of its representative fragments, having between 4 and 6 transmembrane domains and in that they comprise a nucleotide sequence chosen from the following sequences:

ORF5; ORF7; ORF8; ORF15; ORF36; ORF38; ORF51; ORF55; ORF58; ORF67; ORF70; ORF81; ORF97; ORF110; ORF111; ORF115; ORF119; ORF126; ORF128; ORF148; ORF155; ORF163; ORF165; ORF168; ORF169; ORF171; ORF172; ORF174; ORF177; ORF181; ORF193; ORF203; ORF213; ORF214; ORF216; ORF217; ORF221; ORF222; ORF225; ORF229; ORF243; ORF246; ORF248; ORF254; ORF261; ORF285; ORF288; ORF292; ORF296; ORF298; ORF299; ORF301; ORF303; ORF317; ORF328; ORF329; ORF351; ORF354; ORF355; ORF364; ORF371; ORF374; ORF375; ORF391; ORF395; ORF401; ORF403; ORF405; ORF409; ORF414; ORF419; ORF421; ORF423; ORF425; ORF438; ORF448; ORF453; ORF458; ORF466; ORF468; ORF470; ORF480; ORF489; ORF490; ORF496; ORF501; ORF504; ORF505; ORF506; ORF511; ORF513; ORF519; ORF526; ORF532; ORF538; ORF539; ORF547; ORF550; ORF561; ORF568; ORF570; ORF574; ORF578; ORF579; ORF580; ORF582; ORF589; ORF593; ORF598; ORF601; ORF604; ORF610; ORF613; ORF617; ORF626; ORF632; ORF635; ORF638; ORF640; ORF641; ORF646; ORF649; ORF650; ORF651; ORF686; ORF711; ORF724; ORF732; ORF734; ORF744; ORF745; ORF749; ORF751; ORF769; ORF770; ORF771; ORF773; ORF776; ORF779; ORF780; ORF785; ORF787; ORF789; ORF801; ORF805; ORF812; ORF822; ORF825; ORF826; ORF839; ORF841; ORF843; ORF853; ORF861; ORF875; ORF876; ORF886; ORF893; ORF898; ORF906; ORF907; ORF908; ORF920; ORF922; ORF925; ORF933; ORF935; ORF936; ORF944; ORF946; ORF947; ORF954; ORF959; ORF961; ORF966; ORF967; ORF972; ORF978; ORF995; ORF996; ORF1000; ORF1003; ORF1010; ORF1011; ORF1012; ORF1017; ORF1020; ORF1030; ORF1036; ORF1038; ORF1043; ORF1046; ORF1048; ORF1050; ORF1058; ORF1071; ORF1073; ORF1084; ORF1085; ORF1086; ORF1087; ORF1091; ORF1092; ORF1094; ORF1096; ORF1100; ORF1104; ORF1111; ORF1112; ORF1114; ORF1117; ORF1122; ORF1125 and one of their representative fragments.

Preferably, the invention also relates to the nucleotide sequences according to the invention, characterized in that they encode a *Chlamydia pneumoniae* transmembrane polypeptide or one of its representative fragments, having at least 7 transmembrane domains and in that they comprise a nucleotide sequence chosen from the following sequences:

ORF17; ORF52; ORF68; ORF83; ORF87; ORF109; ORF112; ORF113; ORF120; ORF121; ORF127; ORF153; ORF204; ORF211; ORF218; ORF223; ORF275; ORF277; ORF295; ORF300; ORF302; ORF306; ORF327; ORF335; ORF342; ORF343; ORF347; ORF349; ORF361; ORF363; ORF369; ORF380; ORF388; ORF389; ORF397; ORF415; ORF432; ORF439; ORF446; ORF449; ORF472; ORF478; ORF500; ORF522; ORF524; ORF567; ORF575; ORF602; ORF606; ORF609; ORF636; ORF639; ORF643; ORF653; ORF668; ORF692; ORF702; ORF704; ORF713; ORF720; ORF778; ORF784; ORF800; ORF836; ORF838; ORF842; ORF864; ORF867; ORF883; ORF901; ORF916; ORF932; ORF934; ORF940; ORF942; ORF950; ORF956; ORF971; ORF973; ORF976; ORF988; ORF994; ORF1018; ORF1028; ORF1035; ORF1037; ORF1044; ORF1055; ORF1057; ORF1068; ORF1069; ORF1070; ORF1072; ORF1082; ORF1088; ORF1105; ORF1132; ORF1135 and one of their representative fragments.

Preferably, the invention relates to the nucleotide sequences according to the invention, characterized in that they encode a *Chlamydia pneumoniae* surface exposed polypeptide (e.g., an outer membrane protein) or one of its representative fragments, said nucleotide sequences comprising a nucleotide sequence chosen from the following sequences:

ORF 15, ORF 25, ORF 26, ORF 27, ORF 28, ORF 29, ORF 30, ORF 31, ORF 32, ORF 33, ORF 35, ORF 36, ORF 1257, ORF 280, ORF 291, ORF 314, ORF 354, ORF 380, ORF 1266, ORF 466, ORF 467, ORF 468, ORF 469, ORF 470, ORF 472, ORF 474, ORF 476, ORF 477, ORF 478,

ORF 479, ORF 480, ORF 482, ORF 483, ORF 485, ORF 486, ORF 500, ORF 501, ORF 503, ORF 504, ORF 505, ORF 506, ORF 507, ORF 1268, ORF 1269, ORF 543, ORF 544, ORF 578, ORF 579, ORF 580, ORF 581, ORF 595, ORF 596, ORF 597, ORF 1271, ORF 633, ORF 637, ORF 699, ORF 706, ORF 737, ORF 744, ORF 1273, ORF 751, ORF 775, ORF 776, ORF 777, ORF 793, ORF 815, ORF 830, ORF 1221, ORF 849, ORF 851, ORF 852, ORF 874, ORF 891, ORF 922, ORF 940, ORF 1231, ORF 1281, ORF 1035, ORF 1079, ORF 1087, ORF 1108, and one of their representative fragments.

Preferably, the invention relates to the nucleotide sequences according to the invention, characterized in that they encode a *Chlamydia pneumoniae* lipoprotein or one of its representative fragments, said nucleotide sequences comprising a nucleotide sequence chosen from the following sequences:

ORF 3, ORF 10, ORF 11, ORF 16, ORF 1254, ORF 1255, ORF 38, ORF 1256, ORF 62, ORF 85, ORF 1258, ORF 115, ORF 1151, ORF 151, ORF 1259, ORF 173, ORF 1261, ORF 186, ORF 194, ORF 205, ORF 214, ORF 216, ORF 217, ORF 238, ORF 1177, ORF 280, ORF 291, ORF 317, ORF 327, ORF 354, ORF 364, ORF 367, ORF 414, ORF 432, ORF 1192, ORF 460, ORF 1267, ORF 1268, ORF 520, ORF 536, ORF 1270, ORF 576, ORF 597, ORF 603, ORF 609, ORF 637, ORF 1272, ORF 652, ORF 1213, ORF 699, ORF 705, ORF 706, ORF 708, ORF 711, ORF 727, ORF 1274, ORF 800, ORF 814, ORF 825, ORF 829, ORF 830, ORF 831, ORF 844, ORF 849, ORF 1275, ORF 1276, ORF 1277, ORF 872, ORF 878, ORF 880, ORF 891, ORF 892, ORF 1278, ORF 1279, ORF 1280, ORF 941, ORF 942, ORF 1282, ORF 1283, ORF 952, ORF 988, ORF 998, ORF 1009, ORF 1285, ORF 1235, ORF 1028, ORF 1056, ORF 1070, ORF 1287, ORF 1087, ORF 1288, ORF 1289, ORF 1098, ORF 1246, ORF 1291, ORF 1108, ORF 1109, ORF 1112, ORF 1133, and one of their representative fragments.

Preferably, the invention relates to the nucleotide sequences according to the invention, characterized in that they encode a *Chlamydia pneumoniae* polypeptide involved in lipopolysaccharide (LPS) biosynthesis, said nucleotide sequences comprising a nucleotide sequence chosen from the following sequences: ORF 316, ORF 564, ORF 610, ORF 647, ORF 1211, ORF 688, ORF 924, and one of their representative fragments.

Preferably the invention relates to additional LPS-related nucleotide sequences according to the invention, characterized in that they encode:

(a) a *Chlamydia pneumoniae* KDO (3-deoxy-D-manno-octulosonic acid)-related polypeptide or one of its representative fragments, said nucleotide sequences comprising a nucleotide sequence chosen from the following sequences: ORF 177, ORF 1156, ORF 245, ORF 767, and one of their representative fragments;

(b) a *Chlamydia pneumoniae* phosphomannomutase-related polypeptide or one of its representative fragments, said nucleotide sequences comprising a nucleotide sequence chosen from the following sequences: ORF 74, and one of its representative fragments;

(c) a *Chlamydia pneumoniae* phosphoglucomutase-related polypeptide or one of its representative fragments, said nucleotide sequences comprising a nucleotide sequence chosen from the following sequences: ORF 1286, ORF 1039, and one of their representative fragments; and (d) a *Chlamydia pneumoniae* lipid A component-related polypeptide or one of its representative fragments, said nucleotide sequences comprising a nucleotide sequence chosen from the following sequences: ORF 689, ORF 690, ORF 691, ORF 1037, and one of their representative fragments.

Preferably, the invention relates to the nucleotide sequences according to the invention, characterized in that they encode a *Chlamydia pneumoniae* polypeptide containing RGD (Arg-Gly-Asp) attachment sites or one of its representative fragments.

(a) RGD-containing proteins that are outer membrane proteins, are more likely to play a role in cell attachment. ORFs that encoded a protein containing an RGD sequence and also were classified as outer membrane proteins are ORF 468 and its representative fragments.

(a) An RGD-encoding ORF that showed homology to cds1, cds2, and copN type III virulence loci in *Chlamydia psittaci* (Hsia, R. et al. (1997), Type III secretion genes identity a putative virulence locus of Chlamydia. Molecular Microbiology 25:351–359) is ORF 350, and its representative fragments.

(c) The outer membrane of Chlamydia is made of cysteine-rich proteins that form a network of both intra and inter molecular disulfide links. This contributes to the integrity of the membrane since Chlamydia lacks the peptidoglycan layer that other gram-negative bacteria have. Cysteine-rich proteins that have the RGD sequence are also considered to be potential vaccine candidates. Cysteine-rich proteins were defined as proteins that had more than 3.0% cysteine in their primary amino acid sequence, above the mean genomic ORF cysteine content. The corresponding ORFs are: ORF 1290, ORF 1294, ORF 1296, and one of their representative fragments.

(d) The outer membrane of Chlamydia may also contain small proteins that have cysteines in their N- and C-terminus that may contribute to the network formed by disulfide linkages. These proteins may be anchored in the outer membrane via their N-terminus and may have their C-terminus exposed, which then can interact with the host cells. Alternatively, these proteins may be anchored in the outer membrane via both N-and C-terminus and may have regions in the middle that may be exposed which can in turn interact with the host cells. ORFs encoding polypeptides that contain cysteines in their first 30 amino acids and also contain an RGD sequence are:

ORF 105, ORF 106, ORF 114, ORF 170, ORF 171, ORF 1264, ORF 268, ORF 1265, ORF 350, ORF 393, ORF 394, ORF 451, ORF 452, ORF 453, ORF 473, ORF 499, ORF 515, ORF 519, ORF 525, ORF 526, ORF 538, ORF 611, ORF 645, ORF 686, ORF 700, ORF 746, ORF 755, ORF 756, ORF 757, ORF 789, ORF 814, ORF 855, ORF 856, ORF 878, ORF 957, ORF 958, ORF 989, ORF 1290, and one of their representative fragments.

(e) RGD-containing ORFs homologous to RGD-containing ORFs from *Chlamydia trachomatis* are:

ORF 114, ORF 468, ORF 755, ORF 756, ORF 757, ORF 855, ORF 856, ORF 905, ORF 913, ORF 914, ORF 915, and one of their representative fragments.

Preferably, the invention relates to the nucleotide sequences according to the invention, characterized in that they encode a *Chlamydia pneumoniae* Type III or other, non-type III secreted polypeptide or one of its representative fragments, said nucleotide sequences comprising a nucleotide sequence chosen from the following sequences:

ORF 25, ORF 28, ORF 29, ORF 33, ORF 308, ORF 309, ORF 343, ORF 344, ORF 345, ORF 367, ORF 414, ORF 415, ORF 480, ORF 550, ORF 579, ORF 580, ORF 581, ORF 597, ORF 699, ORF 744, ORF 751, ORF 776, ORF 866, ORF 874, ORF 883, ORF 884, ORF 888, ORF 891, ORF 1293, and one of their representative fragments.

Preferably, the invention relates to the nucleotide sequences according to the invention, characterized in that they encode a *Chlamydia pneumoniae* cell wall anchored surface polypeptide or one of its representative fragments, said nucleotide sequences comprising a nucleotide sequence chosen from the following sequences: ORF 267, ORF 271, ORF 419, ORF 590, ORF 932, ORF 1292, ORF 1295, and one of their representative fragments.

Preferably, the invention relates to the nucleotide sequences according to the invention, characterized in that they encode *Chlamydia pneumoniae* polypeptides not found in *Chlamydia trachomatis* (Blastp. P>e$^{-10}$), said nucleotide sequences comprising a nucleotide sequence chosen from the following sequences:

ORF 7, ORF 8, ORF 9, ORF 16, ORF 17, ORF 18, ORF 19, ORF 20, ORF 21, ORF 22, ORF 1254, ORF 23, ORF 1255, ORF 24, ORF 1139, ORF 1140, ORF 46, ORF 47, ORF 51, ORF 60, ORF 1256, ORF 61, ORF 62, ORF 63, ORF 64, ORF 1257, ORF 65, ORF 66, ORF 67, ORF 68, ORF 1143, ORF 1145, ORF 83, ORF 84, ORF 1146, ORF 85, ORF 86, ORF 87, ORF 1258, ORF 116, ORF 117, ORF 125, ORF 1148, ORF 143, ORF 1150, ORF 1151, ORF 144, ORF 145, ORF 147, ORF 148, ORF 149, ORF 150, ORF 152, ORF 1259, ORF 162, ORF 166, ORF 1154, ORF 167, ORF 1261, ORF 1156, ORF 1157, ORF 178, ORF 179, ORF 1158, ORF 182, ORF 183, ORF 184, ORF 185, ORF 1159, ORF 186, ORF 1160, ORF 187, ORF 188, ORF 189, ORF 190, ORF 1161, ORF 1162, ORF 191, ORF 192, ORF 194, ORF 195, ORF 1163, ORF 196, ORF 201, ORF 202, ORF 209, ORF 212, ORF 221, ORF 224, ORF 1167, ORF 226, ORF 227, ORF 228, ORF 229, ORF 230, ORF 231, ORF 232, ORF 1169, ORF 1170, ORF 1171, ORF 234, ORF 235, ORF 236, ORF 1172, ORF 243, ORF 251, ORF 252, ORF 1176, ORF 253, ORF 255, ORF 254, ORF 256, ORF 1177, ORF 1178, ORF 262, ORF 263, ORF 1264, ORF 278, ORF 279, ORF 1180, ORF 280, ORF 290, ORF 291, ORF 292, ORF 296, ORF 1181, ORF 297, ORF 298, ORF 300, ORF 1265, ORF 322, ORF 324, ORF 325, ORF 370, ORF 1186, ORF 371, ORF 372, ORF 1187, ORF 373, ORF 378, ORF 1266, ORF 382, ORF 383, ORF 384, ORF 385, ORF 386, ORF 1188, ORF 1189, ORF 391, ORF 392, ORF 398, ORF 400, ORF 403, ORF 1191, ORF 423, ORF 435, ORF 445, ORF 450, ORF 1193, ORF 456, ORF 460, ORF 461, ORF 465, ORF 1196, ORF 471, ORF 473, ORF 475, ORF 481, ORF 484, ORF 487, ORF 488, ORF 489, ORF 490, ORF 491, ORF 492, ORF 493, ORF 494, ORF 495, ORF 496, ORF 497, ORF 498, ORF 499, ORF 502, ORF 1267, ORF 1268, ORF 508, ORF 510, ORF 509, ORF 512, ORF 515, ORF 519, ORF 1197, ORF 521, ORF 1198, ORF 522, ORF 524, ORF 528, ORF 534, ORF 537, ORF 1269, ORF 1270, ORF 548, ORF 551, ORF 557, ORF 1201, ORF 1203, ORF 562, ORF 566, ORF 593, ORF 595, ORF 600, ORF 1271, ORF 604, ORF 611, ORF 612, ORF 614, ORF 616, ORF 625, ORF 627, ORF 628, ORF 629, ORF 631, ORF 641, ORF 1272, ORF 648, ORF 1212, ORF 663, ORF 685, ORF 707, ORF 714, ORF 715, ORF 716, ORF 717, ORF 722, ORF 746, ORF 1273, ORF 761, ORF 764, ORF 770, ORF 1217, ORF 783, ORF 1274, ORF 803, ORF 815, ORF 1220, ORF 835, ORF 1221, ORF 844, ORF 845, ORF 846, ORF 847, ORF 848, ORF 849, ORF 850, ORF 851, ORF 1275, ORF 852, ORF 862, ORF 1276, ORF 1277, ORF 873, ORF 1223, ORF 892, ORF 919, ORF 1225, ORF 1278, ORF 926, ORF 1228, ORF 1229, ORF 1230, ORF 1279, ORF 1281, ORF 1282, ORF 1283, ORF 948, ORF 950, ORF 949, ORF 951, ORF 980, ORF 982, ORF 1233, ORF 999, ORF 1000, ORF 1001, ORF 1002, ORF 1008, ORF 1285, ORF 1235, ORF 1016, ORF 1019, ORF 1027, ORF 1036, ORF 1241, ORF 1048, ORF 1049, ORF 1050, ORF 1053, ORF 1054, ORF 1064, ORF 1076, ORF 1091, ORF 1288, ORF 1093, ORF 1289, ORF 1101, ORF 1103, ORF 1245, ORF 1246, ORF 1247, ORF 1290, ORF 1291, ORF 1115, ORF 1116, ORF 1118, ORF 1120, ORF 1249, ORF 1121, ORF 1250, ORF 1126, ORF 1251, ORF 1127, ORF 1128, ORF 1130, ORF 1129, ORF 1131, ORF 1136, ORF 1253, ORF 1292, ORF 1294, ORF 1295, ORF 1296, and one of their representative fragments.

Preferably, the invention also relates to the nucleotide sequences according to the invention, characterized in that they encode a *Chlamydia pneumoniae* polypeptide or one of its representative fragments which is involved in the intermediate metabolism, in particular in the metabolism of sugars and/or of cofactors, such as for example triose phosphate isomerase or pyruvate kinase, and in that they comprise a nucleotide sequence chosen from the following sequences:

ORF2; ORF55; ORF56; ORF69; ORF75; ORF80; ORF100; ORF110; ORF114; ORF120; ORF121; ORF157; ORF160; ORF161; ORF172; ORF180; ORF181; ORF198; ORF200; ORF225; ORF248; ORF249; ORF276; ORF277; ORF318; ORF319; ORF320; ORF323; ORF331; ORF347; ORF375; ORF376; ORF381; ORF393; ORF394; ORF395; ORF396; ORF409; ORF446; ORF447; ORF448; ORF449; ORF513; ORF516; ORF571; ORF647; ORF662; ORF697; ORF718; ORF793; ORF794; ORF808; ORF809; ORF838; ORF839; ORF840; ORF853; ORF854; ORF918; ORF923; ORF929; ORF931; ORF938; ORF939; ORF958; ORF959; ORF960; ORF966; ORF995; ORF1021; ORF1040; ORF1041; ORF1042; ORF1085; ORF1100; ORF1102; ORF1117; ORF1118; ORF1119; ORF1120; ORF1135 and one of their representative fragments.

Preferably, the invention also relates to the nucleotide sequences according to the invention, characterized in that they encode a *Chlamydia pneumoniae* polypeptide or one of its representative fragments which is involved in the intermediate metabolism of nucleotides or nucleic acids, such as for example CTP synthetase or GMP synthetase, and in that they comprise a nucleotide sequence chosen from the following sequences:

ORF77; ORF78; ORF138; ORF189; ORF190; ORF233; ORF246; ORF338; ORF412; ORF421; ORF438; ORF607; ORF648; ORF657; ORF740; ORF783; ORF967; ORF989; ORF990; ORF992; ORF1011; ORF1058; ORF1059; ORF1073; ORF1074 and one of their representative fragments.

Preferably, the invention also relates to the nucleotide sequences according to the invention, characterized in that they encode a *Chlamydia pneumoniae* polypeptide or one of its representative fragments which is involved in the metabolism of nucleic acids, such as for example DNA polymerases or DNA topoisomerases, and in that they comprise a nucleotide sequence chosen from the following sequences:

ORF14; ORF59; ORF70; ORF71; ORF97; ORF113; ORF137; ORF141; ORF169; ORF285; ORF287;

ORF288; ORF313; ORF326; ORF358; ORF411; ORF443; ORF548; ORF569; ORF601; ORF651; ORF654; ORF658; ORF659; ORF664; ORF665; ORF694; ORF698; ORF704; ORF760; ORF762; ORF763; ORF786; ORF787; ORF788; ORF801; ORF802; ORF812; ORF819; ORF822; ORF870; ORF897; ORF898; ORF902; ORF908; ORF916; ORF954; ORF955; ORF961; ORF983; ORF996; ORF1007; ORF1012; ORF1013; ORF1014; ORF1015; ORF1038; ORF1137 and one of their representative fragments.

Preferably, the invention also relates to the nucleotide sequences according to the invention, characterized in that they encode a *Chlamydia pneumoniae* polypeptide or one of its representative fragments which is involved in the metabolism of amino acids or polypeptides, such as for example serine hydroxymethyl transferase or the proteins which load amino acids onto transfer RNAs, and in that they comprise a nucleotide sequence chosen from the following sequences:

ORF99; ORF111; ORF127; ORF134; ORF140; ORF174; ORF175; ORF176; ORF353; ORF377; ORF404; ORF523; ORF539; ORF559; ORF561; ORF586; ORF598; ORF609; ORF636; ORF687; ORF700; ORF701; ORF759; ORF790; ORF857; ORF861; ORF904; ORF936; ORF952; ORF962; ORF963; ORF964; ORF965; ORF991; ORF1003; ORF1004; ORF1005; ORF1018; ORF1067; ORF1110; ORF1111; ORF1112; ORF1114; ORF1121; ORF1122; ORF1123; ORF1124; ORF1125 and one of their representative fragments.

Preferably, the invention also relates to the nucleotide sequences according to the invention, characterized in that they encode a *Chlamydia pneumoniae* polypeptide or one of its representative fragments which is involved in the metabolism of polypeptides, such as for example protein kinases or proteases, and in that they comprise a nucleotide sequence chosen from the following sequences:

ORF4; ORF44; ORF45; ORF48; ORF54; ORF112; ORF130; ORF155; ORF163; ORF212; ORF257; ORF307; ORF343; ORF405; ORF416; ORF458; ORF540; ORF541; ORF542; ORF543; ORF544; ORF560; ORF594; ORF652; ORF699; ORF723; ORF747; ORF817; ORF827; ORF871; ORF909; ORF910; ORF911; ORF912; ORF1023; ORF1051; ORF1052; ORF1081 and one of their representative fragments.

Preferably, the invention also relates to the nucleotide sequences according to the invention, characterized in that they encode a *Chlamydia pneumoniae* polypeptide or one of its representative fragments which is involved in the metabolism of fatty acids, such as for example succinyl-CoA-synthesizing proteins or phosphatidylserine synthetase, and in that they comprise a nucleotide sequence chosen from the following sequences:

ORF76; ORF284; ORF308; ORF309; ORF310; ORF311; ORF312; ORF425; ORF433; ORF565; ORF688; ORF690; ORF691; ORF767; ORF797; ORF894; ORF895; ORF994; ORF1020; ORF1030; ORF1033; ORF1034; ORF1046; ORF1047; ORF1057 and one of their representative fragments.

Preferably, the invention also relates to the nucleotide sequences according to the invention, characterized in that they encode a *Chlamydia pneumoniae* polypeptide or one of its representative fragments which is involved in the synthesis of the wall, such as for example KDO transferase, and the proteins responsible for the attachment of certain sugars onto the exposed proteins, and in that they comprise a nucleotide sequence chosen from the following sequences: ORF49; ORF50; ORF177; ORF178; ORF245; ORF610; ORF972; ORF974; ORF978; ORF1037 and one of their representative fragments.

Preferably, the invention also relates to the nucleotide sequences according to the invention, characterized in that they encode a *Chlamydia pneumoniae* polypeptide or one of its representative fragments which is involved in the transcription, translation and/or maturation process, such as for example initiation factors, RNA polymerases or certain chaperone proteins, and in that they comprise a nucleotide sequence chosen from the following sequences:

ORF90; ORF92; ORF131; ORF151; ORF199; ORF333; ORF334; ORF336; ORF379; ORF589; ORF590; ORF619; ORF630; ORF649; ORF739; ORF741; ORF806; ORF821; ORF843; ORF968; ORF971; ORF1061 and one of their representative fragments.

Preferably, the invention also relates to the nucleotide sequences according to the invention, characterized in that they encode a *Chlamydia pneumoniae* ribosomal polypeptide or one of its representative fragments, such as for example the ribosomal proteins L21, L27 and S10, and in that they comprise a nucleotide sequence chosen from the following sequences:

ORF93; ORF94; ORF95; ORF136; ORF259; ORF332; ORF348; ORF583; ORF584; ORF588; ORF591; ORF592; ORF663; ORF666; ORF667; ORF669; ORF670; ORF671; ORF672; ORF673; ORF674; ORF675; ORF676; ORF677; ORF678; ORF679; ORF680; ORF681; ORF683; ORF684; ORF738; ORF781; ORF1008; ORF1024; ORF1025; ORF1066 and one of their representative fragments.

Preferably, the invention also relates to the nucleotide sequences according to the invention, characterized in that they encode a *Chlamydia pneumoniae* transport polypeptide or one of its representative fragments, such as for example the proteins for transporting amino acids, sugars and certain oligopeptides, and in that they comprise a nucleotide sequence chosen from the following sequences:

ORF40; ORF41; ORF52; ORF105; ORF106; ORF107; ORF109; ORF133; ORF210; ORF211; ORF214; ORF215; ORF216; ORF217; ORF218; ORF219; ORF220; ORF223; ORF242; ORF260; ORF293; ORF299; ORF366; ORF369; ORF575; ORF602; ORF638; ORF639; ORF640; ORF643; ORF653; ORF702; ORF703; ORF724; ORF732; ORF855; ORF856; ORF901; ORF906; ORF933; ORF942; ORF1043; ORF1086; ORF1105 and one of their representative fragments.

Preferably, the invention also relates to the nucleotide sequences according to the invention, characterized in that they encode a *Chlamydia pneumoniae* polypeptide or one of its representative fragments which is involved in the virulence process, such as for example the proteins analogous to the *Escherichia coli* vacB protein, and in that they comprise a nucleotide sequence chosen from the following sequences: ORF546; ORF550; ORF778; ORF779; ORF886 and one of their representative fragments.

Preferably, the invention also relates to the nucleotide sequences according to the invention, characterized in that they encode a *Chlamydia pneumoniae* polypeptide or one of its representative fragments which is involved in the secretory system and/or which is secreted, such as for example proteins homologous to proteins in the secretory system of certain bacteria such as the Salmonellae or the Yersiniae, and in that they comprise a nucleotide sequence chosen from the following sequences:

ORF751; ORF874; ORF875; ORF876; ORF883; ORF884; ORF885 and one of their representative fragments.

Preferably, the invention also relates to a nucleotide sequence according to the invention, characterized in that they encode a polypeptide specific to *Chlamydia pneumoniae* or one of its representative fragments (with a Blast E value of >10$^{-5}$), and in that they comprise a nucleotide sequence chosen from the following sequences:

ORF7; ORF8; ORF17; ORF18; ORF19; ORF20; ORF22; ORF23; ORF24; ORF51; ORF60; ORF63; ORF65; ORF66; ORF67; ORF83; ORF84; ORF86; ORF87; ORF125; ORF143; ORF144; ORF179; ORF182; ORF184; ORF185; ORF187; ORF221; ORF252; ORF254;; ORF278; ORF279; ORF387; ORF388; ORF397; ORF1048; ORF1049; ORF1050; ORF1128; ORF1130; ORF1131 and one of their representative fragments.

Also forming part of the invention are polypeptides encoded by the polynucleotides of the invention, as well as fusion polypeptides comprising such polypeptides. In one embodiment, the polypeptides and fusion polypeptides immunoreact with seropositive serum of an individual infected with *Chlamydia pneumoniae*. For example, described below, are polypeptide sequences exhibiting particularly preferable characteristics. For each group of preferred polypeptides described below, it is to be understood that in addition to the individual polypeptides listed, in instances wherein such polypeptides are encoded as part of "combined" ORFs, such "combined" polypeptides are also to be included within the preferred group.

The subject of the invention is also a polypeptide according to the invention, characterized in that it is a polypeptide of the cellular envelope, preferably of the outer cellular envelope, of *Chlamydia pneumoniae* or one of its representative fragments. According to the invention, the said polypeptide is preferably chosen from the polypeptides having the following sequences:

SEQ ID No. 15; SEQ ID No. 25; SEQ ID No. 26; SEQ ID No. 27; SEQ ID No. 28; SEQ ID No. 29; SEQ ID No. 30; SEQ ID No. 31; SEQ ID No. 32; SEQ ID No. 33; SEQ ID No. 35; SEQ ID No. 68; SEQ ID No. 124; SEQ ID No. 275; SEQ ID No. 291; SEQ ID No. 294; SEQ ID No. 327; SEQ ID No. 342; SEQ ID No. 364; SEQ ID No. 374; SEQ ID No. 380; SEQ ID No. 414; SEQ ID No. 439; SEQ ID No. 466; SEQ ID No. 467; SEQ ID No. 468; SEQ ID No. 469; SEQ ID No. 470; SEQ ID No. 472; SEQ ID No. 474; SEQ ID No. 476; SEQ ID No. 477; SEQ ID No. 478; SEQ ID No. 479; SEQ ID No. 480; SEQ ID No. 482; SEQ ID No. 485; SEQ ID No. 500; SEQ ID No. 501; SEQ ID No. 503; SEQ ID No. 504; SEQ ID No. 505; SEQ ID No. 506; SEQ ID No. 520; SEQ ID No. 578; SEQ ID No. 580; SEQ ID No. 581; SEQ ID No. 595; SEQ ID No. 596; SEQ ID No. 597; SEQ ID No. 737; SEQ ID No. 830; SEQ ID No. 834; SEQ ID No. 836; SEQ ID No. 893; SEQ ID No. 917; SEQ ID No. 932; SEQ ID No. 976; SEQ ID No. 1035; SEQ ID No. 1045; SEQ ID No. 1090 and one of their representative fragments.

Preferably, the invention relates to a polypeptide according to the invention, characterized in that it is a *Chlamydia pneumoniae* transmembrane polypeptide or one of its representative fragments, having between 1 and 3 transmembrane domains, and in that it is chosen from the polypeptides having the following sequences:

SEQ ID No. 2; SEQ ID No. 3; SEQ ID No. 6; SEQ ID No. 9; SEQ ID No. 10; SEQ ID No. 11; SEQ ID No. 13; SEQ ID No. 14; SEQ ID No. 16; SEQ ID No. 18; SEQ ID No. 19; SEQ ID No. 20; SEQ ID No. 21; SEQ ID No. 22; SEQ ID No. 25; SEQ ID No. 27; SEQ ID No. 28; SEQ ID No. 29; SEQ ID No. 30; SEQ ID No. 31; SEQ ID No. 32; SEQ ID No. 33; SEQ ID No. 34; SEQ ID No. 35; SEQ ID No. 37; SEQ ID No. 39; SEQ ID No. 41; SEQ ID No. 42; SEQ ID No. 44; SEQ ID No. 45; SEQ ID No. 46; SEQ ID No. 47; SEQ ID No. 48; SEQ ID No. 49; SEQ ID No. 50; SEQ ID No. 53; SEQ ID No. 54; SEQ ID No. 56; SEQ ID No. 57; SEQ ID No. 59; SEQ ID No. 60; SEQ ID No. 61; SEQ ID No. 62; SEQ ID No. 63; SEQ ID No. 64; SEQ ID No. 65; SEQ ID No. 66; SEQ ID No. 69;; SEQ ID No. 72; SEQ ID No. 73; SEQ ID No. 74; SEQ ID No. 76; SEQ ID No. 77; SEQ ID No. 78; SEQ ID No. 79; SEQ ID No. 80; SEQ ID No. 82; SEQ ID No. 84; SEQ ID No. 85; SEQ ID No. 86; SEQ ID No. 88; SEQ ID No. 89; SEQ ID No. 90; SEQ ID No. 91; SEQ ID No. 92; SEQ ID No. 93; SEQ ID No. 95; SEQ ID No. 96; SEQ ID No. 98; SEQ ID No. 99; SEQ ID No. 100; SEQ ID No. 101; SEQ ID No. 102; SEQ ID No. 103; SEQ ID No. 104; SEQ ID No. 105; SEQ ID No. 106; SEQ ID No. 107; SEQ ID No. 108; SEQ ID No. 114; SEQ ID No. 117; SEQ ID No. 118; SEQ ID No. 122; SEQ ID No. 123; SEQ ID No. 124; SEQ ID No. 125; SEQ ID No. 129; SEQ ID No. 130; SEQ ID No. 131; SEQ ID No. 132; SEQ ID No. 133; SEQ ID No. 134; SEQ ID No. 135; SEQ ID No. 137; SEQ ID No. 138; SEQ ID No. 139; SEQ ID No. 140; SEQ ID No. 141; SEQ ID No. 142; SEQ ID No. 143; SEQ ID No. 145; SEQ ID No. 146; SEQ ID No. 147; SEQ ID No. 150; SEQ ID No. 151; SEQ ID No. 152; SEQ ID No. 156; SEQ ID No. 157; SEQ ID No. 158; SEQ ID No. 159; SEQ ID No. 160; SEQ ID No. 161; SEQ ID No. 162; SEQ ID No. 164; SEQ ID No. 166; SEQ ID No. 167; SEQ ID No. 170; SEQ ID No. 173; SEQ ID No. 175; SEQ ID No. 176; SEQ ID No. 178; SEQ ID No. 179; SEQ ID No. 180; SEQ ID No. 182; SEQ ID No. 183; SEQ ID No. 184; SEQ ID No. 185; SEQ ID No. 186; SEQ ID No. 187; SEQ ID No. 188; SEQ ID No. 189; SEQ ID No. 190; SEQ ID No. 191; SEQ ID No. 192; SEQ ID No. 194; SEQ ID No. 195; SEQ ID No. 196; SEQ ID No. 197; SEQ ID No. 198; SEQ ID No. 199; SEQ ID No. 200; SEQ ID No. 201; SEQ ID No. 202; SEQ ID No. 205; SEQ ID No. 207; SEQ ID No. 208; SEQ ID No. 209; SEQ ID No. 210; SEQ ID No. 212; SEQ ID No. 215; SEQ ID No. 219; SEQ ID No. 220; SEQ ID No. 224; SEQ ID No. 226; SEQ ID No. 227; SEQ ID No. 228; SEQ ID No. 231; SEQ ID No. 232; SEQ ID No. 233; SEQ ID No. 234; SEQ ID No. 235; SEQ ID No. 236; SEQ ID No. 238; SEQ ID No. 239; SEQ ID No. 240; SEQ ID No. 241; SEQ ID No. 242; SEQ ID No. 244; SEQ ID No. 247; SEQ ID No. 251; SEQ ID No. 252; SEQ ID No. 253; SEQ ID No. 255; SEQ ID No. 256; SEQ ID No. 257; SEQ ID No. 258; SEQ ID No. 260; SEQ ID No. 262; SEQ ID No. 263; SEQ ID No. 266; SEQ ID No. 267; SEQ ID No. 268; SEQ ID No. 269; SEQ ID No. 270; SEQ ID No. 273; SEQ ID No. 274; SEQ ID No. 276; SEQ ID No. 278; SEQ ID No. 279; SEQ ID No. 280; SEQ ID No. 281; SEQ ID No. 282; SEQ ID No. 283; SEQ ID No. 284; SEQ ID No. 286; SEQ ID No. 287; SEQ ID No. 289; SEQ ID No. 290; SEQ ID No. 291; SEQ ID No. 293; SEQ ID No. 294; SEQ ID No. 297; SEQ ID No. 304; SEQ ID No. 305; SEQ ID No. 307; SEQ ID No. 308; SEQ ID No. 309; SEQ ID No. 310; SEQ ID No. 311; SEQ ID No. 313; SEQ ID No. 314; SEQ ID No. 315; SEQ ID No. 316; SEQ ID No. 318; SEQ ID No. 319; SEQ ID No. 320; SEQ ID No. 321; SEQ ID No. 322; SEQ ID No. 323; SEQ ID No. 324; SEQ ID No. 325; SEQ ID No. 326; SEQ ID No. 331; SEQ ID No. 332; SEQ ID No. 336; SEQ ID No. 338; SEQ ID No. 339; SEQ ID No. 341; SEQ ID No. 344; SEQ ID No. 345; SEQ ID No. 346; SEQ ID No. 350; SEQ ID No. 352; SEQ ID No. 353; SEQ ID No. 356; SEQ ID No.

357; SEQ ID No. 358; SEQ ID No. 359; SEQ ID No. 360; SEQ ID No. 362; SEQ ID No. 365; SEQ ID No. 366; SEQ ID No. 367; SEQ ID No. 370; SEQ ID No. 372; SEQ ID No. 373; SEQ ID No. 376; SEQ ID No. 377; SEQ ID No. 378; SEQ ID No. 379; SEQ ID No. 381; SEQ ID No. 382; SEQ ID No. 383; SEQ ID No. 384; SEQ ID No. 385; SEQ ID No. 386; SEQ ID No. 387; SEQ ID No. 390; SEQ ID No. 392; SEQ ID No. 393; SEQ ID No. 394; SEQ ID No. 396; SEQ ID No. 398; SEQ ID No. 399; SEQ ID No. 400; SEQ ID No. 404; SEQ ID No. 408; SEQ ID No. 410; SEQ ID No. 411; SEQ ID No. 413; SEQ ID No. 4 16; SEQ ID No. 41 7; SEQ ID No. 41 8; SEQ ID No. 420; SEQ ID No. 422; SEQ ID No. 424; SEQ ID No. 427; SEQ ID No. 428; SEQ ID No. 429; SEQ ID No. 430; SEQ ID No. 431; SEQ ID No. 433; SEQ ID No. 434; SEQ ID No. 437; SEQ ID No. 440; SEQ ID No. 441; SEQ ID No. 442; SEQ ID No. 443; SEQ ID No. 444; SEQ ID No. 445; SEQ ID No. 447; SEQ ID No. 450; SEQ ID No. 451; SEQ ID No. 452; SEQ ID No. 455; SEQ ID No. 456; SEQ ID No. 459; SEQ ID No. 460; SEQ ID No. 461; SEQ ID No. 462; SEQ ID No. 463; SEQ ID No. 464; SEQ ID No. 465; SEQ ID No. 467; SEQ ID No. 469; SEQ ID No. 471; SEQ ID No. 474; SEQ ID No. 475; SEQ ID No. 476; SEQ ID No. 477; SEQ ID No. 479; SEQ ID No. 482; SEQ ID No. 483; SEQ ID No. 484; SEQ ID No. 485; SEQ ID No. 486; SEQ ID No. 487; SEQ ID No. 488; SEQ ID No. 491; SEQ ID No. 493; SEQ ID No. 494; SEQ ID No. 497; SEQ ID No. 498; SEQ ID No. 499; SEQ ID No. 503; SEQ ID No. 508; SEQ ID No. 509; SEQ ID No. 510; SEQ ID No. 512; SEQ ID No. 514; SEQ ID No. 515; SEQ ID No. 516; SEQ ID No. 517; SEQ ID No. 518; SEQ ID No. 520; SEQ ID No. 521; SEQ ID No. 523; SEQ ID No. 525; SEQ ID No. 527; SEQ ID No. 528; SEQ ID No. 529; SEQ ID No. 530; SEQ ID No. 531; SEQ ID No. 533; SEQ ID No. 534; SEQ ID No. 535; SEQ ID No. 536; SEQ ID No. 537; SEQ ID No. 540; SEQ ID No. 541; SEQ ID No. 543; SEQ ID No. 544; SEQ ID No. 545; SEQ ID No. 546; SEQ ID No. 548; SEQ ID No. 549; SEQ ID No. 551; SEQ ID No. 553; SEQ ID No. 554; SEQ ID No. 555; SEQ ID No. 556; SEQ ID No. 557; SEQ ID No. 558; SEQ ID No. 559; SEQ ID No. 560; SEQ ID No. 562; SEQ ID No. 563; SEQ ID No. 564; SEQ ID No. 565; SEQ ID No. 566; SEQ ID No. 569; SEQ ID No. 571; SEQ ID No. 573; SEQ ID No. 576; SEQ ID No. 577; SEQ ID No. 581; SEQ ID No. 583; SEQ ID No. 584; SEQ ID No. 585; SEQ ID No. 586; SEQ ID No. 588; SEQ ID No. 591; SEQ ID No. 592; SEQ ID No. 594; SEQ ID No. 595; SEQ ID No. 596; SEQ ID No. 597; SEQ ID No. 599; SEQ ID No. 600; SEQ ID No. 603; SEQ ID No. 605; SEQ ID No. 608; SEQ ID No. 614; SEQ ID No. 615; SEQ ID No. 620; SEQ ID No. 621; SEQ ID No. 622; SEQ ID No. 623; SEQ ID No. 624; SEQ ID No. 625; SEQ ID No. 629; SEQ ID No. 630; SEQ ID No. 631; SEQ ID No. 633; SEQ ID No. 634; SEQ ID No. 637; SEQ ID No. 642; SEQ ID No. 644; SEQ ID No. 645; SEQ ID No. 647; SEQ ID No. 648; SEQ ID No. 652; SEQ ID No. 654; SEQ ID No. 655; SEQ ID No. 657; SEQ ID No. 658; SEQ ID No. 659; SEQ ID No. 660; SEQ ID No. 661; SEQ ID No. 664; SEQ ID No. 665; SEQ ID No. 666; SEQ ID No. 667; SEQ ID No. 670; SEQ ID No. 671; SEQ ID No. 672; SEQ ID No. 673; SEQ ID No. 674; SEQ ID No. 676; SEQ ID No. 679; SEQ ID No. 681; SEQ ID No. 684; SEQ ID No. 687; SEQ ID No. 688; SEQ ID No. 689; SEQ ID No. 690; SEQ ID No. 693; SEQ ID No. 694; SEQ ID No. 695; SEQ ID No. 696; SEQ ID No. 697; SEQ ID No. 698; SEQ ID No. 699; SEQ ID No. 700; SEQ ID No. 701; SEQ ID No. 703; SEQ ID No. 705; SEQ ID No. 706; SEQ ID No. 707; SEQ ID No. 708; SEQ ID No. 710; SEQ ID No. 712; SEQ ID No. 715; SEQ ID No. 716; SEQ ID No. 717; SEQ ID No. 718; SEQ ID No. 719; SEQ ID No. 721; SEQ ID No. 722; SEQ ID No. 723; SEQ ID No. 725; SEQ ID No. 726; SEQ ID No. 727; SEQ ID No. 728; SEQ ID No. 729; SEQ ID No. 730; SEQ ID No. 731; SEQ ID No. 733; SEQ ID No. 736; SEQ ID No. 737; SEQ ID No. 738; SEQ ID No. 740; SEQ ID No. 741; SEQ ID No. 742; SEQ ID No. 743; SEQ ID No. 747; SEQ ID No. 748; SEQ ID No. 750; SEQ ID No. 752; SEQ ID No. 754; SEQ ID No. 755; SEQ ID No. 756; SEQ ID No. 757; SEQ ID No. 759; SEQ ID No. 760; SEQ ID No. 761; SEQ ID No. 762; SEQ ID No. 763; SEQ ID No. 764; SEQ ID No. 765; SEQ ID No. 766; SEQ ID No. 767; SEQ ID No. 768; SEQ ID No. 772; SEQ ID No. 774; SEQ ID No. 775; SEQ ID No. 777; SEQ ID No. 781; SEQ ID No. 783; SEQ ID No. 788; SEQ ID No. 791; SEQ ID No. 792; SEQ ID No. 793; SEQ ID No. 794; SEQ ID No. 795; SEQ ID No. 796; SEQ ID No. 797; SEQ ID No. 798; SEQ ID No. 799; SEQ ID No. 802; SEQ ID No. 803; SEQ ID No. 806; SEQ ID No. 807; SEQ ID No. 808; SEQ ID No. 809; SEQ ID No. 810; SEQ ID No. 811; SEQ ID No. 813; SEQ ID No. 814; SEQ ID No. 815; SEQ ID No. 816; SEQ ID No. 817; SEQ ID No. 819; SEQ ID No. 820; SEQ ID No. 821; SEQ ID No. 823; SEQ ID No. 824; SEQ ID No. 827; SEQ ID No. 829; SEQ ID No. 830; SEQ ID No. 831; SEQ ID No. 833; SEQ ID No. 834; SEQ ID No. 835; SEQ ID No. 837; SEQ ID No. 844; SEQ ID No. 845 ; SEQ ID No. 8 46; SEQ ID No. 8 47 ; SEQ ID No. 848; SEQ ID No. 849; SEQ ID No. 850; SEQ ID No. 851; SEQ ID No. 852; SEQ ID No. 854; SEQ ID No. 855; SEQ ID No. 856; SEQ ID No. 857; SEQ ID No. 859; SEQ ID No. 860; SEQ ID No. 862; SEQ ID No. 865; SEQ ID No. 866; SEQ ID No. 868; SEQ ID No. 869; SEQ ID No. 870; SEQ ID No. 871; SEQ ID No. 872; SEQ ID No. 874; SEQ ID No. 877; SEQ ID No. 878; SEQ ID No. 879; SEQ ID No. 880; SEQ ID No. 881; SEQ ID No. 882; SEQ ID No. 884; SEQ ID No. 885; SEQ ID No. 888; SEQ ID No. 889; SEQ ID No. 890; SEQ ID No. 891; SEQ ID No. 892; SEQ ID No. 894; SEQ ID No. 895; SEQ ID No. 896; SEQ ID No. 897; SEQ ID No. 899; SEQ ID No. 900; SEQ ID No. 902; SEQ ID No. 903; SEQ ID No. 904; SEQ ID No. 905; SEQ ID No. 909; SEQ ID No. 910; SEQ ID No. 912; SEQ ID No. 913; SEQ ID No. 914; SEQ ID No. 915; SEQ ID No. 917; SEQ ID No. 918; SEQ ID No. 919; SEQ ID No. 921; SEQ ID No. 923; SEQ ID No. 924; SEQ ID No. 926; SEQ ID No. 927; SEQ ID No. 928; SEQ ID No. 929; SEQ ID No. 930; SEQ ID No. 931; SEQ ID No. 937; SEQ ID No. 938; SEQ ID No. 939; SEQ ID No. 941; SEQ ID No. 943; SEQ ID No. 948; SEQ ID No. 951; SEQ ID No. 952; SEQ ID No. 953; SEQ ID No. 958; SEQ ID No. 960; SEQ ID No. 963; SEQ ID No. 964; SEQ ID No. 965; SEQ ID No. 968; SEQ ID No. 970; SEQ ID No. 974; SEQ ID No. 975; SEQ ID No. 977; SEQ ID No. 979; SEQ ID No. 980; SEQ ID No. 981; SEQ ID No. 983; SEQ ID No. 984; SEQ ID No. 985; SEQ ID No. 987; SEQ ID No. 989; SEQ ID No. 992; SEQ ID No. 993; SEQ ID No. 997; SEQ ID No. 998; SEQ ID No. 999; SEQ ID No. 1001; SEQ ID No. 1002; SEQ ID No. 1004; SEQ ID No. 1005; SEQ ID No. 1009; SEQ ID No. 1013; SEQ ID No. 1014; SEQ ID No. 1015; SEQ ID No. 1016; SEQ ID No. 1019; SEQ ID No. 1021; SEQ ID No. 1023; SEQ ID No. 1024; SEQ ID No. 1029; SEQ ID No. 1031; SEQ ID No. 1033; SEQ ID No. 1034; SEQ ID No. 1039; SEQ ID No. 1041; SEQ ID No. 1042; SEQ ID No. 1045; SEQ ID No. 1047; SEQ ID No. 1049; SEQ ID No. 1051; SEQ ID No. 1052; SEQ ID No. 1053; SEQ ID No. 1054; SEQ ID No. 1056; SEQ ID No. 1059; SEQ ID No. 1061; SEQ ID No. 1062; SEQ ID No. 1063; SEQ ID No. 1064; SEQ ID No. 1065; SEQ ID No. 1067; SEQ ID No. 1075;

SEQ ID No. 1077; SEQ ID No. 1078; SEQ ID No. 1079;
SEQ ID No. 1080; SEQ ID No. 1081; SEQ ID No. 1089;
SEQ ID No. 1095; SEQ ID No. 1097; SEQ ID No. 1098;
SEQ ID No. 1099; SEQ ID No. 1101; SEQ ID No. 1102;
SEQ ID No. 1103; SEQ ID No. 1106; SEQ ID No. 1107;
SEQ ID No. 1108; SEQ ID No. 1109; SEQ ID No. 1110;
SEQ ID No. 1113; SEQ ID No. 1116; SEQ ID No. 1118;
SEQ ID No. 1119; SEQ ID No. 1121; SEQ ID No. 1123;
SEQ ID No. 1124; SEQ ID No. 1126; SEQ ID No. 1128;
SEQ ID No. 1130; SEQ ID No. 1131; SEQ ID No. 1133;
SEQ ID No. 1134; SEQ ID No. 1136; SEQ ID No. 1137
and one of their representative fragments.

Preferably, the invention relates to a polypeptide according to the invention, characterized in that it is a *Chlamydia pneumoniae* transmembrane polypeptide or one of its representative fragments, having between 4 and 6 transmembrane domains, and in that it is chosen from the polypeptides having the following sequences:

SEQ ID No. 5; SEQ ID No. 7; SEQ ID No. 8; SEQ ID No. 15; SEQ ID No. 36; SEQ ID No. 38; SEQ ID No. 51; SEQ ID No. 55; SEQ ID No. 58; SEQ ID No. 67; SEQ ID No. 70; SEQ ID No. 81; SEQ ID No. 97; SEQ ID No. 110; SEQ ID No. 111; SEQ ID No. 115; SEQ ID No. 119; SEQ ID No. 126; SEQ ID No. 128; SEQ ID No. 148; SEQ ID No. 155; SEQ ID No. 163; SEQ ID No. 165; SEQ ID No. 168; SEQ ID No. 169; SEQ ID No. 171; SEQ ID No. 172; SEQ ID No. 174; SEQ ID No. 177; SEQ ID No. 181; SEQ ID No. 193; SEQ ID No. 203; SEQ ID No. 213; SEQ ID No. 214; SEQ ID No. 216; SEQ ID No. 217; SEQ ID No. 221; SEQ ID No. 222; SEQ ID No. 225; SEQ ID No. 229; SEQ ID No. 243; SEQ ID No. 246; SEQ ID No. 248; SEQ ID No. 254; SEQ ID No. 261; SEQ ID No. 285; SEQ ID No. 288; SEQ ID No. 292; SEQ ID No. 296; SEQ ID No. 298; SEQ ID No. 299; SEQ ID No. 301; SEQ ID No. 303; SEQ ID No. 317; SEQ ID No. 328; SEQ ID No. 329; SEQ ID No. 351; SEQ ID No. 354; SEQ ID No. 355; SEQ ID No. 364; SEQ ID No. 371; SEQ ID No. 374; SEQ ID No. 375; SEQ ID No. 391; SEQ ID No. 395; SEQ ID No. 401; SEQ ID No. 403; SEQ ID No. 405; SEQ ID No. 409; SEQ ID No. 414; SEQ ID No. 419; SEQ ID No. 421; SEQ ID No. 423; SEQ ID No. 425; SEQ ID No. 438; SEQ ID No. 448; SEQ ID No. 453; SEQ ID No. 458; SEQ ID No. 466; SEQ ID No. 468; SEQ ID No. 470; SEQ ID No. 480; SEQ ID No. 489; SEQ ID No. 490; SEQ ID No. 496; SEQ ID No. 501; SEQ ID No. 504; SEQ ID No. 505; SEQ ID No. 506; SEQ ID No. 511; SEQ ID No. 513; SEQ ID No. 519; SEQ ID No. 526; SEQ ID No. 532; SEQ ID No. 538; SEQ ID No. 539; SEQ ID No. 547; SEQ ID No. 550; SEQ ID No. 561; SEQ ID No. 568; SEQ ID No. 570; SEQ ID No. 574; SEQ ID No. 578; SEQ ID No. 579; SEQ ID No. 580; SEQ ID No. 582; SEQ ID No. 589; SEQ ID No. 593; SEQ ID No. 598; SEQ ID No. 601; SEQ ID No. 604; SEQ ID No. 610; SEQ ID No. 613; SEQ ID No. 617; SEQ ID No. 626; SEQ ID No. 632; SEQ ID No. 635; SEQ ID No. 638; SEQ ID No. 640; SEQ ID No. 641; SEQ ID No. 646; SEQ ID No. 649; SEQ ID No. 650; SEQ ID No. 651; SEQ ID No. 686; SEQ ID No. 711; SEQ ID No. 724; SEQ ID No. 732; SEQ ID No. 734; SEQ ID No. 744; SEQ ID No. 745; SEQ ID No. 749; SEQ ID No. 751; SEQ ID No. 769; SEQ ID No. 770; SEQ ID No. 771; SEQ ID No. 773; SEQ ID No. 776; SEQ ID No. 779; SEQ ID No. 780; SEQ ID No. 785; SEQ ID No. 787; SEQ ID No. 789; SEQ ID No. 801; SEQ ID No. 805; SEQ ID No. 812; SEQ ID No. 822; SEQ ID No. 825; SEQ ID No. 826; SEQ ID No. 839; SEQ ID No. 841; SEQ ID No. 843; SEQ ID No. 853; SEQ ID No. 861; SEQ ID No. 875; SEQ ID No. 876; SEQ ID No. 886; SEQ ID No. 893; SEQ ID No. 898; SEQ ID No. 906; SEQ ID No. 907; SEQ ID No. 908; SEQ ID No. 920; SEQ ID No. 922; SEQ ID No. 925; SEQ ID No. 933; SEQ ID No. 935; SEQ ID No. 936; SEQ ID No. 944; SEQ ID No. 946; SEQ ID No. 947; SEQ ID No. 954; SEQ ID No. 959; SEQ ID No. 961; SEQ ID No. 966; SEQ ID No. 967; SEQ ID No. 972; SEQ ID No. 978; SEQ ID No. 995; SEQ ID No. 996; SEQ ID No. 1000; SEQ ID No. 1003; SEQ ID No. 1010; SEQ ID No. 1011; SEQ ID No. 1012; SEQ ID No. 1017; SEQ ID No. 1020; SEQ ID No. 1030; SEQ ID No. 1036; SEQ ID No. 1038; SEQ ID No. 1043; SEQ ID No. 1046; SEQ ID No. 1048; SEQ ID No. 1050; SEQ ID No. 1058; SEQ ID No. 1071; SEQ ID No. 1073; SEQ ID No. 1084; SEQ ID No. 1085; SEQ ID No. 1086; SEQ ID No. 1087; SEQ ID No. 1091; SEQ ID No. 1092; SEQ ID No. 1094; SEQ ID No. 1096; SEQ ID No. 1100; SEQ ID No. 1104; SEQ ID No. 1111; SEQ ID No. 1112; SEQ ID No. 1114; SEQ ID No. 1117; SEQ ID No. 1122; SEQ ID No. 1125 and one of their representative fragments.

Preferably, the invention relates to a polypeptide according to the invention, characterized in that it is a *Chlamydia pneumoniae* transmembrane polypeptide or one of its representative fragments, having at least 7 transmembrane domains, and in that it is chosen from the polypeptides having the following sequences:

SEQ ID No. 17; SEQ ID No. 52; SEQ ID No. 68; SEQ ID No. 83; SEQ ID No. 87; SEQ ID No. 109 ; SEQ ID No. 112; SEQ ID No. 113; SEQ ID No. 120; SEQ ID No. 121; SEQ ID No. 127; SEQ ID No. 153; SEQ ID No. 204; SEQ ID No. 211; SEQ ID No. 218; SEQ ID No. 223; SEQ ID No. 275; SEQ ID No. 277; SEQ ID No. 295; SEQ ID No. 300; SEQ ID No. 302; SEQ ID No. 306; SEQ ID No. 327; SEQ ID No. 335; SEQ ID No. 342; SEQ ID No. 343; SEQ ID No. 347; SEQ ID No. 349; SEQ ID No. 361; SEQ ID No. 363; SEQ ID No. 369; SEQ ID No. 380; SEQ ID No. 388; SEQ ID No. 389; SEQ ID No. 397; SEQ ID No. 415; SEQ ID No. 432; SEQ ID No. 439; SEQ ID No. 446; SEQ ID No. 449; SEQ ID No. 472; SEQ ID No. 478; SEQ ID No. 500; SEQ ID No. 522; SEQ ID No. 524; SEQ ID No. 567; SEQ ID No. 575; SEQ ID No. 602; SEQ ID No. 606; SEQ ID No. 609; SEQ ID No. 636; SEQ ID No. 639; SEQ ID No. 643; SEQ ID No. 653; SEQ ID No. 668; SEQ ID No. 692; SEQ ID No. 702; SEQ ID No. 704; SEQ ID No. 713; SEQ ID No. 720; SEQ ID No. 778; SEQ ID No. 784; SEQ ID No. 800; SEQ ID No. 836; SEQ ID No. 838; SEQ ID No. 842; SEQ ID No. 864; SEQ ID No. 867; SEQ ID No. 883; SEQ ID No. 901; SEQ ID No. 916; SEQ ID No. 932; SEQ ID No. 934; SEQ ID No. 940; SEQ ID No. 942; SEQ ID No. 950; SEQ ID No. 956; SEQ ID No. 971; SEQ ID No. 973; SEQ ID No. 976; SEQ ID No. 988; SEQ ID No. 994; SEQ ID No. 1018; SEQ ID No. 1028; SEQ ID No. 1035; SEQ ID No. 1037; SEQ ID No. 1044; SEQ ID No. 1055; SEQ ID No. 1057; SEQ ID No. 1068; SEQ ID No. 1069; SEQ ID No. 1070; SEQ ID No. 1072; SEQ ID No. 1082; SEQ ID No. 1088; SEQ ID No. 1105; SEQ ID No. 1132; SEQ ID No. 1135 and one of their representative fragments.

Preferably, the invention relates to a polypeptide according to the invention, in that it is a *Chlamydia pneumoniae* surface exposed polypeptide or one of its representative fragments, and in that it is chosen from the polypeptides having the following sequences:

SEQ ID No. 15, SEQ ID No. 25, SEQ ID No. 26, SEQ ID No. 27, SEQ ID No. 28, SEQ ID No. 29, SEQ ID No. 30, SEQ ID No. 31, SEQ ID No. 32, SEQ ID No. 33, SEQ ID No. 35, SEQ ID No. 36, SEQ ID No. 1257, SEQ ID No. 280, SEQ ID No. 291, SEQ ID No. 314, SEQ ID No. 354, SEQ ID No. 380, SEQ ID No. 1266, SEQ ID No. 466,

SEQ ID No. 467, SEQ ID No. 468, SEQ ID No. 469, SEQ ID No. 470, SEQ ID No. 472, SEQ ID No. 474, SEQ ID No. 476, SEQ ID No. 477, SEQ ID No. 478, SEQ ID No. 479, SEQ ID No. 480, SEQ ID No. 482, SEQ ID No. 483, SEQ ID No. 485, SEQ ID No. 486, SEQ ID No. 500, SEQ ID No. 501, SEQ ID No. 503, SEQ ID No. 504, SEQ ID No. 505, SEQ ID No. 506, SEQ ID No. 507, SEQ ID No. 1268, SEQ ID No. 1269, SEQ ID No. 543, SEQ ID No. 544, SEQ ID No. 578, SEQ ID No. 579, SEQ ID No. 580, SEQ ID No. 581, SEQ ID No. 595, SEQ ID No. 596, SEQ ID No. 597, SEQ ID No. 1271, SEQ ID No. 633, SEQ ID No. 637, SEQ ID No. 699, SEQ ID No. 706, SEQ ID No. 737, SEQ ID No. 744, SEQ ID No. 1273, SEQ ID No. 751, SEQ ID No. 775, SEQ ID No. 776, SEQ ID No. 777, SEQ ID No. 793, SEQ ID No. 815, SEQ ID No. 830, SEQ ID No. 1221, SEQ ID No. 849, SEQ ID No. 851, SEQ ID No. 852, SEQ ID No. 874, SEQ ID No. 891, SEQ ID No. 922, SEQ ID No. 940, SEQ ID No. 1231, SEQ ID No. 1281, SEQ ID No. 1035, SEQ ID No. 1079, SEQ ID No. 1087, SEQ ID No. 1108, and one of their representative fragments.

Preferably, the invention relates to a polypeptide according to the invention, characterized in that it is a *Chlamydia pneumoniae* lipoprotein or one of its representative fragments, and in that it is chosen from the polypeptides having the following sequences:

SEQ ID No. 3, SEQ ID No. 10, SEQ ID No. 11, SEQ ID No. 16, SEQ ID No. 1254, SEQ ID No. 1255, SEQ ID No. 38, SEQ ID No. 1256, SEQ ID No. 62, SEQ ID No. 85, SEQ ID No. 1258, SEQ ID No. 115, SEQ ID No. 1151, SEQ ID No. 151, SEQ ID No. 1259, SEQ ID No. 173, SEQ ID No. 1261, SEQ ID No. 186, SEQ ID No. 194, SEQ ID No. 205, SEQ ID No. 214, SEQ ID No. 216, SEQ ID No. 217, SEQ ID No. 238, SEQ ID No. 1177, SEQ ID No. 280, SEQ ID No. 291, SEQ ID No. 317, SEQ ID No. 327, SEQ ID No. 354, SEQ ID No. 364, SEQ ID No. 367, SEQ ID No. 414, SEQ ID No. 432, SEQ ID No. 1192, SEQ ID No. 460, SEQ ID No. 1267, SEQ ID No. 1268, SEQ ID No. 520, SEQ ID No. 536, SEQ ID No. 1270, SEQ ID No. 576, SEQ ID No. 597, SEQ ID No. 603, SEQ ID No. 609, SEQ ID No. 637, SEQ ID No. 1272, SEQ ID No. 652, SEQ ID No. 1213, SEQ ID No. 699, SEQ ID No. 705, SEQ ID No. 706, SEQ ID No. 708, SEQ ID No. 711, SEQ ID No. 727, SEQ ID No. 1274, SEQ ID No. 800, SEQ ID No. 814, SEQ ID No. 825, SEQ ID No. 829, SEQ ID No. 830, SEQ ID No. 831, SEQ ID No. 844, SEQ ID No. 849, SEQ ID No. 1275, SEQ ID No. 1276, SEQ ID No. 1277, SEQ ID No. 872, SEQ ID No. 878, SEQ ID No. 880, SEQ ID No. 891, SEQ ID No. 892, SEQ ID No. 1278, SEQ ID No. 1279, SEQ ID No. 1280, SEQ ID No. 941, SEQ ID No. 942, SEQ ID No. 1282, SEQ ID No. 1283, SEQ ID No. 952, SEQ ID No. 988, SEQ ID No. 998, SEQ ID No. 1009, SEQ ID No. 1285, SEQ ID No. 1235, SEQ ID No. 1028, SEQ ID No. 1056, SEQ ID No. 1070, SEQ ID No. 1287, SEQ ID No. 1087, SEQ ID No. 1288, SEQ ID No. 1289, SEQ ID No. 1098, SEQ ID No. 1246, SEQ ID No. 1291, SEQ ID No. 1108, SEQ ID No. 1109, SEQ ID No. 1112, SEQ ID No. 1133, and one of their representative fragments.

Preferably, the invention relates to a polypeptide according to the invention, in that it is a *Chlamydia pneucmoniae* polypeptide involved in lipopolysaccharide (LPS) biosynthesis, and in that it is chosen from the polypeptides having the following sequences:

SEQ ID No. 316, SEQ ID No. 564, SEQ ID No. 610, SEQ ID No. 647, SEQ ID No. 1211, SEQ ID No. 688, SEQ ID No. 924, and one of their representative fragments.

Preferably, the invention relates to additional LPS-related polypeptides according to the invention, in that it is:

(a) a *Chlamydia pneumoniae* KDO (3-deoxy-D-manno-octylosonic acid)-related polypeptide or one of its representative fragments, and in that it is chosen from the polypeptides having the following sequences: SEQ ID No. 177, SEQ ID No. 1156, SEQ ID No. 245, SEQ ID No. 767, and one of their representative fragments;

(b) a *Chlamydia pneumoniae* phosphomannomutase-related polypeptide or one of its representative fragments, and in that it is chosen from the polypeptides having the following sequences: SEQ ID No. 74, and its representative fragment;

(c) a *Chlamydia pneumoniae* phosphoglucomutase-related polypeptide or one of its representative fragments, and in that it is chosen from the polypeptides having the following sequences: SEQ ID No. 1286, SEQ ID No. 1039, and its representative fragment; and (d) a *Chlamydia pneumoniae* lipid A component-related polypeptide or one of its representative fragments, and in that it is chosen from the polypeptides having the following sequences: SEQ ID No. 689, SEQ ID No. 690, SEQ ID No. 691, SEQ ID No. 1037, and one of their representative fragments.

Preferably, the invention relates to a polypeptide according to the invention, in that it is a *Chlamydia pneumoniae* polypeptide or one of its representative fragments that contains an RGD sequence and is also an outer membrane protein, and in that it is chosen from the polypeptides having the following sequences: SEQ ID No. 468 and its representative fragments.

Preferably, the invention relates to a polypeptide according to the invention, in that it is a *Chlamydia pneumoniae* polypeptide or one of its representative fragments that contains an RGD sequence that shows homology to cds1, cds2, and copN type III virulence loci in *Chlamydia Psitacci,* and in that it is chosen from the polypeptides having the following sequences:

SEQ ID No. 350 and its representative fragments.

Preferably, the invention relates to a polypeptide according to the invention, in that it is a *Chlamydia pneumoniae* polypeptide or one of its representative fragments that is cysteine-rich and contains RGD sequence, and in that it is chosen from the polypeptides having the following sequences: SEQ ID No. 1290, SEQ ID No. 6846, SEQ ID No. 6848, and one of their representative fragments.

Preferably, the invention relates to a polypeptide according to the invention, in that it is a *Chlamydia pneumoniae* outer membrane polypeptide that contains cysteines in their first 30 amino acids and also contain an RGD sequence, and in that it is chosen from the polypeptides having the following sequences:

SEQ ID No. 105, SEQ ID No. 106, SEQ ID No. 114, SEQ ID No. 170, SEQ ID No. 171, SEQ ID No. 1264, SEQ ID No. 268, SEQ ID No. 1265, SEQ ID No. 350, SEQ ID No. 393, SEQ ID No. 394, SEQ ID No. 451, SEQ ID No. 452, SEQ ID No. 453, SEQ ID No. 473, SEQ ID No. 499, SEQ ID No. 515, SEQ ID No. 519, SEQ ID No. 525, SEQ ID No. 526, SEQ ID No. 538, SEQ ID No. 611, SEQ ID No. 645, SEQ ID No. 686, SEQ ID No. 700, SEQ ID No. 746, SEQ ID No. 755, SEQ ID No. 756, SEQ ID No. 757, SEQ ID No. 789, SEQ ID No. 814, SEQ ID No. 855, SEQ ID No. 856, SEQ ID No. 878, SEQ ID No. 957, SEQ ID No. 958, SEQ ID No. 989, SEQ ID No. 1290, and one of their representative fragments.

Preferably, the invention relates to a polypeptide according to the invention, in that it is a *Chlamydia pneumoniae* polypeptide or one of its representative fragments that contains RGD sequences homologous to *Chlamydia trachomatis* polypeptides containing RGD sequences, and in that it is chosen from the polypeptides having the following sequences:

SEQ ID No. 114, SEQ ID No. 468, SEQ ID No. 755, SEQ ID No. 756, SEQ ID No. 757, SEQ ID No. 855, SEQ ID No. 856, SEQ ID No. 905, SEQ ID No. 913, SEQ ID No. 914, SEQ ID No. 915, and one of their representative fragments.

Preferably, the invention relates to a polypeptide according to the invention, in that it is a *Chlamydia pneumoniae* Type III and non-Type III secreted polypeptide or one of its representative fragments, and in that it is chosen from the polypeptides having the following sequences:

SEQ ID No. 25, SEQ ID No. 28, SEQ ID No. 29, SEQ ID No. 33, SEQ ID No. 308, SEQ ID No. 309, SEQ ID No. 343, SEQ ID No. 344, SEQ ID No. 345, SEQ ID No. 367, SEQ ID No. 414, SEQ ID No. 415, SEQ ID No. 480, SEQ ID No. 550, SEQ ID No. 579, SEQ ID No. 580, SEQ ID No. 581, SEQ ID No. 597, SEQ ID No. 699, SEQ ID No. 744, SEQ ID No. 751, SEQ ID No. 776, SEQ ID No. 866, SEQ ID No. 874, SEQ ID No. 883, SEQ ID No. 884, SEQ ID No. 888, SEQ ID No. 891, SEQ ID No. 6845, and one of their representative fragments.

Preferably, the invention relates to a polypeptide according to the invention, in that it is a *Chlamydia pneumoniae* cell wall anchored surface polypeptide or one of its representative fragments, and in that it is chosen from the polypeptides having the following sequences:

SEQ ID No. 267, SEQ ID No. 271, SEQ ID No. 419, SEQ ID No. 590, SEQ ID No. 932, SEQ ID No. 6844, SEQ ID No. 6847, and one of their representative fragments.

Preferably, the invention relates to a polypeptide according to the invention, in that it is a *Chlamydia pneumoniae* polypeptide or one of its representative fragments not found in *Chlamydia trachomatis* (Blastp P>e$^{-10}$), and in that it is chosen from the polypeptides having the following sequences:

SEQ ID No. 7, SEQ ID No. 8, SEQ ID No. 9, SEQ ID No. 16, SEQ ID No. 17, SEQ ID No. 18, SEQ ID No. 19, SEQ ID No. 20, SEQ ID No. 21, SEQ ID No. 22, SEQ ID No. 1254, SEQ ID No. 23, SEQ ID No. 1255, SEQ ID No. 24, SEQ ID No. 1139, SEQ ID No. 1140, SEQ ID No. 46, SEQ ID No. 47, SEQ ID No. 51, SEQ ID No. 60, SEQ ID No. 1256, SEQ ID No. 61, SEQ ID No. 62, SEQ ID No. 63, SEQ ID No. 64, SEQ ID No. 1257, SEQ ID No. 65, SEQ ID No. 66, SEQ ID No. 67, SEQ ID No. 68, SEQ ID No. 1143, SEQ ID No. 1145, SEQ ID No. 83, SEQ ID No. 84, SEQ ID No. 1146, SEQ ID No. 85, SEQ ID No. 86, SEQ ID No. 87, SEQ ID No. 1258, SEQ ID No. 116, SEQ ID No. 117, SEQ ID No. 125, SEQ ID No. 1148, SEQ ID No. 143, SEQ ID No. 1150, SEQ ID No. 1151, SEQ ID No. 144, SEQ ID No. 145, SEQ ID No. 147, SEQ ID No. 148, SEQ ID No. 149, SEQ ID No. 150, SEQ ID No. 152, SEQ ID No. 1259, SEQ ID No. 162, SEQ ID No. 166, SEQ ID No. 1154, SEQ ID No. 167, SEQ ID No. 1261, SEQ ID No. 1156, SEQ ID No. 1157, SEQ ID No. 178, SEQ ID No. 179, SEQ ID No. 1158, SEQ ID No. 182, SEQ ID No. 183, SEQ ID No. 184, SEQ ID No. 185, SEQ ID No. 1159, SEQ ID No. 186, SEQ ID No. 1160, SEQ ID No. 187, SEQ ID No. 188, SEQ ID No. 189, SEQ ID No. 190, SEQ ID No. 1161, SEQ ID No. 1162, SEQ ID No. 191, SEQ ID No. 192, SEQ ID No. 194, SEQ ID No. 195, SEQ ID No. 1163, SEQ ID No. 196, SEQ ID No. 201, SEQ ID No. 202, SEQ ID No. 209, SEQ ID No. 212, SEQ ID No. 221, SEQ ID No. 224, SEQ ID No. 1167, SEQ ID No. 226, SEQ ID No. 227, SEQ ID No. 228, SEQ ID No. 229, SEQ ID No. 230, SEQ ID No. 231, SEQ ID No. 232, SEQ ID No. 1169, SEQ ID No. 1170, SEQ ID No. 1171, SEQ ID No. 234, SEQ ID No. 235, SEQ ID No. 236, SEQ ID No. 1172, SEQ ID No. 243, SEQ ID No. 251, SEQ ID No. 252, SEQ ID No. 1176, SEQ ID No. 253, SEQ ID No. 255, SEQ ID No. 254, SEQ ID No. 256, SEQ ID No. 1177, SEQ ID No. 1178, SEQ ID No. 262, SEQ ID No. 263, SEQ ID No. 1264, SEQ ID No. 278, SEQ ID No. 279, SEQ ID No. 1180, SEQ ID No. 280, SEQ ID No. 290, SEQ ID No. 291, SEQ ID No. 292, SEQ ID No. 296, SEQ ID No. 1181, SEQ ID No. 297, SEQ ID No. 298, SEQ ID No. 300, SEQ ID No. 1265, SEQ ID No. 322, SEQ ID No. 324, SEQ ID No. 325, SEQ ID No. 370, SEQ ID No. 1186, SEQ ID No. 371, SEQ ID No. 372, SEQ ID No. 1187, SEQ ID No. 373, SEQ ID No. 378, SEQ ID No. 1266, SEQ ID No. 382, SEQ ID No. 383, SEQ ID No. 384, SEQ ID No. 385, SEQ ID No. 386, SEQ ID No. 1188, SEQ ID No. 1189, SEQ ID No. 391, SEQ ID No. 392, SEQ ID No. 398, SEQ ID No. 400, SEQ ID No. 403, SEQ ID No. 1191, SEQ ID No. 423, SEQ ID No. 435, SEQ ID No. 445, SEQ ID No. 450, SEQ ID No. 1193, SEQ ID No. 456, SEQ ID No. 460, SEQ ID No. 461, SEQ ID No. 465, SEQ ID No. 1196, SEQ ID No. 471, SEQ ID No. 473, SEQ ID No. 475, SEQ ID No. 481, SEQ ID No. 484, SEQ ID No. 487, SEQ ID No. 488, SEQ ID No. 489, SEQ ID No. 490, SEQ ID No. 491, SEQ ID No. 492, SEQ ID No. 493, SEQ ID No. 494, SEQ ID No. 495, SEQ ID No. 496, SEQ ID No. 497, SEQ ID No. 498, SEQ ID No. 499, SEQ ID No. 502, SEQ ID No. 1267, SEQ ID No. 1268, SEQ ID No. 508, SEQ ID No. 510, SEQ ID No. 509, SEQ ID No. 512, SEQ ID No. 515, SEQ ID No. 519, SEQ ID No. 1197, SEQ ID No. 521, SEQ ID No. 1198, SEQ ID No. 522, SEQ ID No. 524, SEQ ID No. 528, SEQ ID No. 534, SEQ ID No. 537, SEQ ID No. 1269, SEQ ID No. 1270, SEQ ID No. 548, SEQ ID No. 551, SEQ ID No. 557, SEQ ID No. 1201, SEQ ID No. 1203, SEQ ID No. 562, SEQ ID No. 566, SEQ ID No. 593, SEQ ID No. 595, SEQ ID No. 600, SEQ ID No. 1271, SEQ ID No. 604, SEQ ID No. 611, SEQ ID No. 612, SEQ ID No. 614, SEQ ID No. 616, SEQ ID No. 625, SEQ ID No. 627, SEQ ID No. 628, SEQ ID No. 629, SEQ ID No. 631, SEQ ID No. 641, SEQ ID No. 1272, SEQ ID No. 648, SEQ ID No. 1212, SEQ ID No. 663, SEQ ID No. 685, SEQ ID No. 707, SEQ ID No. 714, SEQ ID No. 715, SEQ ID No. 716, SEQ ID No. 717, SEQ ID No. 722, SEQ ID No. 746, SEQ ID No. 1273, SEQ ID No. 761, SEQ ID No. 764, SEQ ID No. 770, SEQ ID No. 1217, SEQ ID No. 783, SEQ ID No. 1274, SEQ ID No. 803, SEQ ID No. 815, SEQ ID No. 1220, SEQ ID No. 835, SEQ ID No. 1221, SEQ ID No. 844, SEQ ID No. 845, SEQ ID No. 846, SEQ ID No. 847, SEQ ID No. 848, SEQ ID No. 849, SEQ ID No. 850, SEQ ID No. 851, SEQ ID No. 1275, SEQ ID No. 852, SEQ ID No. 862, SEQ ID No. 1276, SEQ ID No. 1277, SEQ ID No. 873, SEQ ID No. 1223, SEQ ID No. 892, SEQ ID No. 919, SEQ ID No. 1225, SEQ ID No. 1278, SEQ ID No. 926, SEQ ID No. 1228, SEQ ID No. 1229, SEQ ID No. 1230, SEQ ID No. 1279, SEQ ID No. 1281, SEQ ID No. 1282, SEQ ID No. 1283, SEQ ID No. 948, SEQ ID No. 950, SEQ ID No. 949, SEQ ID No. 951, SEQ ID No. 980, SEQ ID No. 982, SEQ ID No. 1233, SEQ ID No. 999, SEQ ID No. 1000, SEQ ID No. 1001, SEQ ID No. 1002, SEQ ID No. 1008, SEQ ID No. 1285, SEQ ID No. 1235, SEQ ID No. 1016, SEQ ID No. 1019, SEQ ID No. 1027, SEQ ID No. 1036, SEQ ID No. 1241, SEQ ID No. 1048, SEQ ID No. 1049, SEQ ID No. 1050, SEQ ID No. 1053, SEQ ID No. 1054, SEQ ID

No. 1064, SEQ ID No. 1076, SEQ ID No. 1091, SEQ ID
No. 1288, SEQ ID No. 1093, SEQ ID No. 1289, SEQ ID
No. 1101, SEQ ID No. 1103, SEQ ID No. 1245, SEQ ID
No. 1246, SEQ ID No. 1247, SEQ ID No. 1290, SEQ ID
No. 1291, SEQ ID No. 1115, SEQ ID No. 1116, SEQ ID
No. 1118, SEQ ID No. 1120, SEQ ID No. 1249, SEQ ID
No. 1121, SEQ ID No. 1250, SEQ ID No. 1126, SEQ ID
No. 1251, SEQ ID No. 1127, SEQ ID No. 1128, SEQ ID
No. 1130, SEQ ID No. 1129, SEQ ID No. 1131, SEQ ID
No. 1136, SEQ ID No. 1253, SEQ ID No. 6844, SEQ ID
No. 6846, SEQ ID No. 6847, SEQ ID No. 6848, and one
of their representative fragments.

Preferably, the invention relates to a polypeptide according to the invention, characterized in that it is a *Chlamydia pneumoniae* polypeptide or one of its representative fragments which is involved in the intermediate metabolism, in particular in the metabolism of sugars and/or of cofactors, and in that it is chosen from the polypeptides having the following sequences:

SEQ ID No. 2; SEQ ID No. 55; SEQ ID No. 56; SEQ ID No. 69; SEQ ID No. 75; SEQ ID No. 80; SEQ ID No. 100; SEQ ID No. 110; SEQ ID No. 114; SEQ ID No. 120; SEQ ID No. 121; SEQ ID No. 157; SEQ ID No. 160; SEQ ID No. 161; SEQ ID No. 172; SEQ ID No. 180; SEQ ID No. 181; SEQ ID No. 198; SEQ ID No. 200; SEQ ID No. 225; SEQ ID No. 248; SEQ ID No. 249; SEQ ID No. 276; SEQ ID No. 277; SEQ ID No. 318; SEQ ID No. 319; SEQ ID No. 320; SEQ ID No. 323; SEQ ID No. 331; SEQ ID No. 347; SEQ ID No. 375; SEQ ID No. 376; SEQ ID No. 381; SEQ ID No. 393; SEQ ID No. 394; SEQ ID No. 395; SEQ ID No. 396; SEQ ID No. 409; SEQ ID No. 446; SEQ ID No. 447; SEQ ID No. 448; SEQ ID No. 449; SEQ ID No. 513; SEQ ID No. 516; SEQ ID No. 571; SEQ ID No. 647; SEQ ID No. 662; SEQ ID No. 697; SEQ ID No. 718; SEQ ID No. 793; SEQ ID No. 794; SEQ ID No. 808; SEQ ID No. 809; SEQ ID No. 838; SEQ ID No. 839; SEQ ID No. 840; SEQ ID No. 853; SEQ ID No. 854; SEQ ID No. 918; SEQ ID No. 923; SEQ ID No. 929; SEQ ID No. 931; SEQ ID No. 938; SEQ ID No. 939; SEQ ID No. 958; SEQ ID No. 959; SEQ ID No. 960; SEQ ID No. 966; SEQ ID No. 995; SEQ ID No. 1021; SEQ ID No. 1040; SEQ ID No. 1041; SEQ ID No. 1042; SEQ ID No. 1085; SEQ ID No. 1100; SEQ ID No. 1 102; SEQ ID No. 1117; SEQ ID No. 1118; SEQ ID No. 1119; SEQ ID No. 1120; SEQ ID No. 1135 and one of their representative fragments.

Preferably, the invention relates to a polypeptide according to the invention, characterized in that it is a *Chlamydia pneumoniae* polypeptide or one of its representative fragments which is involved in the intermediate metabolism of nucleotides or nucleic acids, and in that it is chosen from the polypeptides having the following sequences:

SEQ ID No. 77; SEQ ID No. 78; SEQ ID No. 138; SEQ ID No. 189; SEQ ID No. 190; SEQ ID No. 233; SEQ ID No. 246; SEQ ID No. 338; SEQ ID No. 412; SEQ ID No. 421; SEQ ID No. 438; SEQ ID No. 607; SEQ ID No. 648; SEQ ID No. 657; SEQ ID No. 740; SEQ ID No. 783; SEQ ID No. 967; SEQ ID No. 989; SEQ ID No. 990; SEQ ID No. 992; SEQ ID No. 1011; SEQ ID No. 1058; SEQ ID No. 1059; SEQ ID No. 1073; SEQ ID No. 1074 and one of their representative fragments.

Preferably, the invention relates to a polypeptide according to the invention, characterized in that it is a *Chlamydia pneumoniae* polypeptide or one of its representative fragments which is involved in the metabolism of nucleic acids, and in that it is chosen from the polypeptides having the following sequences:

SEQ ID No. 14; SEQ ID No. 59; SEQ ID No. 70; SEQ ID No. 71; SEQ ID No. 97; SEQ ID No. 113; SEQ ID No. 137; SEQ ID No. 141; SEQ ID No. 169; SEQ ID No. 285; SEQ ID No. 287; SEQ ID No. 288; SEQ ID No. 313; SEQ ID No. 326; SEQ ID No. 358; SEQ ID No. 411; SEQ ID No. 443; SEQ ID No. 548; SEQ ID No. 569; SEQ ID No. 601; SEQ ID No. 651; SEQ ID No. 654; SEQ ID No. 658; SEQ ID No. 659; SEQ ID No. 664; SEQ ID No. 665; SEQ ID No. 694; SEQ ID No. 698; SEQ ID No. 704; SEQ ID No. 760; SEQ ID No. 762; SEQ ID No. 763; SEQ ID No. 786; SEQ ID No. 787; SEQ ID No. 788; SEQ ID No. 801; SEQ ID No. 802; SEQ ID No. 812; SEQ ID No. 819; SEQ ID No. 822; SEQ ID No. 870; SEQ ID No. 897; SEQ ID No. 898; SEQ ID No. 902; SEQ ID No. 908; SEQ ID No. 916; SEQ ID No. 954; SEQ ID No. 955; SEQ ID No. 961; SEQ ID No. 983; SEQ ID No. 996; SEQ ID No. 1007; SEQ ID No. 1012; SEQ ID No. 1013; SEQ ID No. 1014; SEQ ID No. 1015; SEQ ID No. 1038; SEQ ID No. 1137 and one of their representative fragments.

Preferably, the invention relates to a polypeptide according to the invention, characterized in that it is a *Chlamydia pneumoniae* polypeptide or one of its representative fragments which is involved in the metabolism of amino acids or polypeptides, and in that it is chosen from the polypeptides having the following sequences:

SEQ ID No. 99; SEQ ID No. 111; SEQ ID No. 127; SEQ ID No. 134; SEQ ID No. 140; SEQ ID No. 174; SEQ ID No. 175; SEQ ID No. 176; SEQ ID No. 353; SEQ ID No. 377; SEQ ID No. 404; SEQ ID No. 523; SEQ ID No. 539; SEQ ID No. 559; SEQ ID No. 561; SEQ ID No. 586; SEQ ID No. 598; SEQ ID No. 609; SEQ ID No. 636; SEQ ID No. 687; SEQ ID No. 700; SEQ ID No. 701; SEQ ID No. 759; SEQ ID No. 790; SEQ ID No. 857; SEQ ID No. 861; SEQ ID No. 904; SEQ ID No. 936; SEQ ID No. 952; SEQ ID No. 962; SEQ ID No. 963; SEQ ID No. 964; SEQ ID No. 965; SEQ ID No. 991; SEQ ID No. 1003; SEQ ID No. 1004; SEQ ID No. 1005; SEQ ID No. 1018; SEQ ID No. 1067; SEQ ID No. 1110; SEQ ID No. 1111; SEQ ID No. 1112; SEQ ID No. 1114; SEQ ID No. 1121; SEQ ID No. 1122; SEQ ID No. 1123; SEQ ID No. 1124; SEQ ID No. 1125 and one of their representative fragments.

Preferably, the invention relates to a polypeptide according to the invention, characterized in that it is a *Chlamydia pneumoniae* polypeptide or one of its representative fragments which is involved in the metabolism of polypeptides, and in that it is chosen from the polypeptides having the following sequences:

SEQ ID No. 4; SEQ ID No. 44; SEQ ID No. 45; SEQ ID No. 48; SEQ ID No. 54; SEQ ID No. 112; SEQ ID No. 130; SEQ ID No. 155; SEQ ID No. 163; SEQ ID No. 212; SEQ ID No. 257; SEQ ID No. 307; SEQ ID No. 343; SEQ ID No. 405; SEQ ID No. 416; SEQ ID No. 458; SEQ ID No. 540; SEQ ID No. 541; SEQ ID No. 542; SEQ ID No. 543; SEQ ID No. 544; SEQ ID No. 560; SEQ ID No. 594; SEQ ID No. 652; SEQ ID No. 699; SEQ ID No. 723; SEQ ID No. 747; SEQ ID No. 817; SEQ ID No. 827; SEQ ID No. 871; SEQ ID No. 909; SEQ ID No. 910; SEQ ID No. 911; SEQ ID No. 912; SEQ ID No. 1023; SEQ ID No. 1051; SEQ ID No. 1052; SEQ ID No. 1081 and one of their representative fragments.

Preferably, the invention relates to a polypeptide according to the invention, characterized in that it is a *Chlamydia pneumoniae* polypeptide or one of its representative fragments which is involved in the metabolism of fatty acids, and in that it is chosen from the polypeptides having the following sequences:

SEQ ID No. 76; SEQ ID No. 284; SEQ ID No. 308; SEQ ID No. 309; SEQ ID No. 310; SEQ ID No. 311; SEQ ID No. 312; SEQ ID No. 425; SEQ ID No. 433; SEQ ID No. 565;

SEQ ID No. 688; SEQ ID No. 690; SEQ ID No. 691; SEQ ID No. 767; SEQ ID No. 797; SEQ ID No. 894; SEQ ID No. 895; SEQ ID No. 994; SEQ ID No. 1020; SEQ ID No. 1030; SEQ ID No. 1033; SEQ ID No. 1034; SEQ ID No. 1046; SEQ ID No. 1047; SEQ ID No. 1057 and one of their representative fragments.

Preferably, the invention relates to a polypeptide according to the invention, characterized in that it is a *Chlamydia pneumoniae* polypeptide or one of its representative fragments which is involved in the synthesis of the wall, and in that it is chosen from the polypeptides having the following sequences:

SEQ ID No. 49; SEQ ID No. 50; SEQ ID No. 177; SEQ ID No. 178; SEQ ID No. 245; SEQ ID No. 610; SEQ ID No. 972; SEQ ID No. 974; SEQ ID No. 978; SEQ ID No. 1037 and one of their representative fragments.

Preferably, the invention relates to a polypeptide according to the invention, characterized in that it is a *Chlamydia pneumoniae* polypeptide or one of its representative fragments which is involved in the transcription, translation and/or maturation process, and in that it is chosen from the polypeptides having the following sequences:

SEQ ID No. 90; SEQ ID No. 92; SEQ ID No. 131; SEQ ID No. 151; SEQ ID No. 199; SEQ ID No. 333; SEQ ID No. 334; SEQ ID No. 336; SEQ ID No. 379; SEQ ID No. 589; SEQ ID No. 590; SEQ ID No. 619; SEQ ID No. 630; SEQ ID No. 649; SEQ ID No. 739; SEQ ID No. 741; SEQ ID No. 806; SEQ ID No. 821; SEQ ID No. 843; SEQ ID No. 968; SEQ ID No. 971; SEQ ID No. 1061 and one of their representative fragments.

Preferably, the invention relates to a polypeptide according to the invention, characterized in that it is a *Chlamydia pneumoniae* ribosomal polypeptide or one of its representative fragments, and in that it is chosen from the polypeptides having the following sequences:

SEQ ID No. 93; SEQ ID No. 94; SEQ ID No. 95; SEQ ID No. 136; SEQ ID No. 259; SEQ ID No. 332; SEQ ID No. 348; SEQ ID No. 583; SEQ ID No. 584; SEQ ID No. 588; SEQ ID No. 591; SEQ ID No. 592; SEQ ID No. 663; SEQ ID No. 666; SEQ ID No. 667; SEQ ID No. 669; SEQ ID No. 670; SEQ ID No. 671; SEQ ID No. 672; SEQ ID No. 673; SEQ ID No. 674; SEQ ID No. 675; SEQ ID No. 676; SEQ ID No. 677; SEQ ID No. 678; SEQ ID No. 679; SEQ ID No. 680; SEQ ID No. 681; SEQ ID No. 683; SEQ ID No. 684; SEQ ID No. 738; SEQ ID No. 781; SEQ ID No. 1008; SEQ ID No. 1024; SEQ ID No. 1025; SEQ ID No. 1066 and one of their representative fragments.

Preferably, the invention also relates to a polypeptide according to the invention, characterized in that it is a *Chlamydia pneumoniae* transport polypeptide or one of its representative fragments, and in that it is chosen from the polypeptides having the following sequences:

SEQ ID No. 40; SEQ ID No. 41; SEQ ID No. 52; SEQ ID No. 105; SEQ ID No. 106; SEQ ID No. 107; SEQ ID No. 109; SEQ ID No. 133; SEQ ID No. 210; SEQ ID No. 211; SEQ ID No. 214; SEQ ID No. 215; SEQ ID No. 216; SEQ ID No. 217; SEQ ID No. 218; SEQ ID No. 219; SEQ ID No. 220; SEQ ID No. 223; SEQ ID No. 242; SEQ ID No. 260; SEQ ID No. 293; SEQ ID No. 299; SEQ ID No. 366; SEQ ID No. 369; SEQ ID No. 575; SEQ ID No. 602; SEQ ID No. 638; SEQ ID No. 639; SEQ ID No. 640; SEQ ID No. 643; SEQ ID No. 653; SEQ ID No. 702; SEQ ID No. 703; SEQ ID No. 724; SEQ ID No. 732; SEQ ID No. 855; SEQ ID No. 856; SEQ ID No. 901; SEQ ID No. 906; SEQ ID No. 933; SEQ ID No. 942; SEQ ID No. 1043; SEQ ID No. 1086; SEQ ID No. 1105 and one of their representative fragments.

Preferably, the invention relates to a polypeptide according to the invention, characterized in that it is a *Chlamydia pneumoniae* polypeptide or one of its representative fragments which is involved in the virulence process, and in that it is chosen from the polypeptides having the following sequences:

SEQ ID No. 546; SEQ ID No. 550; SEQ ID No. 778; SEQ ID No. 779; SEQ ID No. 886 and one of their representative fragments.

Preferably, the invention relates to a polypeptide according to the invention, characterized in that it is a *Chlamydia pneumoniae* polypeptide or one of its representative fragments which is involved in the secretory system and/or which is secreted, and in that it is chosen from the polypeptides having the following sequences:

SEQ ID No. 751; SEQ ID No. 874; SEQ ID No. 875; SEQ ID No. 876; SEQ ID No. 883; SEQ ID No. 884; SEQ ID No. 885 and one of their representative fragments.

The secreted polypeptides, including the Type III and other, non-Type III secreted polypeptides, of the present invention, as well as the corresponding nucleotide sequences, may be detected by techniques known to persons skilled in the art, such as for example the techniques using cloning combined with vectors allowing the expression of the said polypeptides fused to export markers such as the luc gene for luciferase or the PhoA gene for alkaline phosphatase.

Preferably, the invention relates to a polypeptide according to the invention, characterized in that it is a polypeptide specific to *Chlamydia pneumoniae* or one of its representative fragments(with a Blast E value of $>10^{-5}$), and in that it is chosen from the polypeptides having the following sequences:

SEQ ID No. 7; SEQ ID No. 8; SEQ ID No. 17; SEQ ID No. 18; SEQ ID No. 19; SEQ ID No. 20; SEQ ID No. 22; SEQ ID No. 23; SEQ ID No. 24; SEQ ID No. 51; SEQ ID No. 60; SEQ ID No. 63; SEQ ID No. 65; SEQ ID No. 66; SEQ ID No. 67; SEQ ID No. 83; SEQ ID No. 84; SEQ ID No. 86; SEQ ID No. 87; SEQ ID No. 125; SEQ ID No. 143; SEQ ID No. 144; SEQ ID No. 179; SEQ ID No. 182; SEQ ID No. 184; SEQ ID No. 185; SEQ ID No. 187; SEQ ID No. 221; SEQ ID No. 252; SEQ ID No. 254;; SEQ ID No. 278; SEQ ID No. 279; SEQ ID No. 387; SEQ ID No. 388; SEQ ID No. 397; SEQ ID No. 1048; SEQ ID No. 1049; SEQ ID No. 1050; SEQ ID No. 1128; SEQ ID No. 1130; SEQ ID No. 1131 and one of their representative fragments.

In general, in the present invention, the functional group to which a polypeptide of the invention belongs, as well as its corresponding nucleotide sequence, may be determined either by comparative analogy with sequences already known, or by the use of standard techniques of biochemistry, of cytology combined with the techniques of genetic engineering such as immunoaffinity, localization by immunolabelling, differential extraction, measurement of enzymatic activity, study of the activity inducing or repressing expression or the study of expression in *E. coli*.

It is clearly understood, on the one hand, that, in the present invention, the nucleotide sequences (ORF) and the amino acid sequences (SEQ ID No. 2 to SEQ ID No. 1291 and SEQ ID No. 6844 to SEQ ID No. 684) which are listed by functional group, are not exhaustive within the group considered. Moreover, it is also clearly understood that, in the present invention, a nucleotide sequence (ORF) or an amino acid sequence mentioned within a given functional group may also be part of another group taking into account, for example, the interrelationship between the groups listed.

Accordingly, and as an example of this interrelationship, an exported and/or secreted polypeptide as well as its coding nucleotide sequence may also be involved in the *Chlamydia pneumoniae* virulence process by modifying the defense mechanism of the infected host cell, or a transmembrane polypeptide or its coding nucleotide sequence is also part of the polypeptides or coding nucleotide sequences of the cellular envelope.

The subject of the present invention is also the nucleotide and/or polypeptide sequences according to the invention, characterized in that the said sequences are recorded on a medium, called recording medium, whose type and nature facilitate the reading, the analysis and the exploitation of the said sequences. These media may of course also contain other information extracted from the present invention, such as in particular the analogies with already known sequences, such as those mentioned in Table 1 of the present description, and/or may contain, in addition, information relating to the nucleotide and/or polypeptide sequences of other microorganisms so as to facilitate the comparative analysis and the exploitation of the results obtained.

Among these recording media, computer-readable media, such as magnetic, optical, electrical and hybrid media such as, for example, floppy disks, CD-ROMs or recording cassettes, are preferred in particular.

The invention also relates to nucleotide sequences which can be used as primer or probe, characterized in that the said sequences are chosen from the nucleotide sequences according to the invention.

The invention relates, in addition, to the use of a nucleotide sequence according to the invention, as primer or probe, for the detection and/or amplification of nucleic acid sequences.

The nucleotide sequences according to the invention may thus be used to amplify nucleotide sequences, in particular by the PCR technique (polymerase chain reaction) (Erlich, 1989; Innis et al., 1990; Rolfs et al., 1991, and White et al., 1997).

These oligodeoxyribonucleotide or oligoribonucleotide primers correspond to representative nucleotide fragments, and are advantageously at least 8 nucleotides, preferably at least 12 nucleotides, 15 nucleotides and still more preferably at least 20 nucleotides long.

Other techniques for amplifying the target nucleic acid may be advantageously used as alternatives to PCR.

The nucleotide sequences of the invention, in particular the primers according to the invention, may also be used in other methods for amplifying a target nucleic acid, such as:

the TAS (Transcription-based Amplification System) technique described by Kwoh et al. in 1989;

the 3SR (Self-Sustained Sequence Replication) technique described by Guatelli et al. in 1990;

the NASBA (Nucleic Acid Sequence Based Amplification) technique described by Kievitis et al. in 1991;

the SDA (Strand Displacement Amplification) technique (Walker et al., 1992);

the TMA (Transcription Mediated Amplification) technique.

The polynucleotides of the invention may also be used in techniques for amplifying or for modifying the nucleic acid serving as probe, such as:

the LCR (Ligase Chain Reaction) technique described by Landegren et al. in 1988 and perfected by Barany et al. in 1991, which uses a thermostable ligase;

the RCR (Repair Chain Reaction) technique described by Segev in 1992;

the CPR (Cycling Probe Reaction) technique described by Duck et al. in 1990;

the Q-beta-replicase amplification technique described by Miele et al. in 1983 and perfected in particular by Chu et al. in 1986, Lizardi et al. in 1988, and then by Burg et al. as well as by Stone et al. in 1996.

The invention also relates to the nucleotide sequences of fragments which can be obtained by amplification with the aid of at least one primer according to the invention. The present invention encompasses both hybridization probes and primers. In general, the complementary probes should be of a length sufficient to form a stable hybrid complex with the target sequences. Primers, while complementary to the target sequences need not form stable hybridization complexes with the target sequences alone. Rather, primers form stable complexes with the target sequences in the presence of polymerase to permit extension of the primer.

In the case where the target polynucleotide to be detected is possibly an RNA, for example an mRNA, it will be possible to use, prior to the use of an amplification reaction with the aid of at least one primer according to the invention or to the use of a method of detection with the aid of at least one probe of the invention, a reverse transcriptase-type enzyme so as to obtain a cDNA from the RNA contained in the biological sample. The cDNA obtained will then serve as target for the primer(s) or the probe(s) used in the amplification or detection method according to the invention.

The detection probe will be chosen so that it hybridizes with the target sequence or the amplicon generated from the target sequence. Such a detection probe will advantageously have as sequence a sequence of at least 12 nucleotides, in particular of at least 20 nucleotides, and preferably at least 100 nucleotides.

The invention also comprises the nucleotide sequences which can be used as probe or primer according to the invention, characterized in that they are labelled with a radioactive compound or with a nonradioactive compound.

The nonlabelled nucleotide sequences may be used directly as probes or primers; however, the sequences are generally labelled with a radioactive element ($^{32}P$, $^{35}S$, $^{3}H$, $^{125}I$) or with a nonradioactive molecule (biotin, acetylaminofluorene, digoxigenin, 5-bromo-deoxyuridine, fluorescein) so as to obtain probes which can be used in numerous applications.

Examples of nonradioactive labelling of nucleotide sequences are described, for example, in French patent No. 78,10975 or by Urdea et al. or by Sanchez-Pescador et al. in 1988.

In the latter case, one of the labelling methods described in patents FR-2 422 956 and FR-2 518 755 may also be used.

The invention also relates to the nucleotide sequences of fragments which can be obtained by hybridization with the aid of at least one probe according to the invention.

The hybridization technique may be performed in various ways (Matthews et al., 1988). The most common method consists in immobilizing the nucleic acid extracted from *Chlamydia pneumoniae* cells on a support (such as nitrocellulose, nylon, polystyrene) and in incubating, under well-defined conditions, the target nucleic acid immobilized with the probe. After hybridization, the excess probe is removed and the hybrid molecules formed are detected by the appropriate method (measurement of the radioactivity, of the fluorescence or of the enzymatic activity linked to the probe).

The invention also comprises the nucleotide sequences according to the invention, characterized in that they are covalently or noncovalently immobilized on a support.

According to another advantageous embodiment of the nucleic sequences according to the invention, the latter may be used immobilized on a support and may thus serve to capture, through specific hybridization, the target nucleic acid obtained from the biological sample to be tested. If necessary, the solid support is separated from the sample and the hybridization complex formed between the so-called capture probe and the target nucleic acid is then detected by means of a second probe, called detection probe, labelled with an easily detectable element.

The nucleotide sequences according to the invention may also be used in new analytical systems, DNA chips, which allow sequencing, the study of mutations and of the expression of genes, and which are currently of interest given their very small size and their high capacity in terms of number of analyses.

The principle of the operation of these chips is based on molecular probes, most often oligonucleotides, which are attached onto a miniaturized surface, generally of the order of a few square centimetres. During an analysis, a sample containing fragments of a target nucleic acid to be analysed, for example DNA or RNA labelled, for example, after amplification, is deposited onto the DNA chip in which the support has been coated beforehand with probes. Bringing the labelled target sequences into contact with the probes leads to the formation, through hybridization, of a duplex according to the rule of pairing defined by J. D. Watson and F. Crick. After a washing step, analysis of the surface of the chip allows the effective hybridizations to be located by means of the signals emitted by the labels tagging the target. A hybridization fingerprint results from this analysis which, by appropriate computer processing, will make it possible to determine information such as the presence of specific fragments in the sample, the determination of sequences and the presence of mutations.

The chip consists of a multitude of molecular probes, precisely organized or arrayed on a solid support whose surface is miniaturized. It is at the centre of a system where other elements (imaging system, microcomputer) allow the acquisition and interpretation of a hybridization fingerprint.

The hybridization supports are provided in the form of flat or porous surfaces (pierced with wells) composed of various materials. The choice of a support is determined by its physicochemical properties, or more precisely, by the relationship between the latter and the conditions under which the support will be placed during the synthesis or the attachment of the probes or during the use of the chip. It is therefore necessary, before considering the use of a particular support (R. S. Matson et al., 1994), to consider characteristics such as its stability to pH, its physical strength, its reactivity and its chemical stability as well as its capacity to nonspecifically bind nucleic acids. Materials such as glass, silicon and polymers are commonly used. Their surface is, in a first step, called "functionalization", made reactive towards the groups which it is desired to attach thereon. After the functionalization, so-called spacer molecules are grafted onto the activated surface. Used as intermediates between the surface and the probe, these molecules of variable size render unimportant the surface properties of the supports, which often prove to be problematic for the synthesis or the attachment of the probes and for the hybridization.

Among the hybridization supports, there may be mentioned glass which is used, for example, in the method of in situ synthesis of oligonucleotides by photochemical addressing developed by the company Affymetrix (E. L. Sheldon, 1993), the glass surface being activated by silane. Genosensor Consortium (P. Mérel, 1994) also uses glass slides carrying wells 3 mm apart, this support being activated with epoxysilane.

Polymers or silicon may also be mentioned among these hybridization supports. For example, the Andrein Mirzabekov team has developed a chip consisting of polyacrylamide squares polymerized on a silanized glass surface (G. Yershov et al., 1996). Several teams use silicon, in particular the IFOS laboratory of Ecole Centrale of Lyon which uses a silicon semiconductor substrate which is p-doped by introducing it into its crystalline structure atoms whose valency is different from that of silicon. Various types of metals, in particular gold and platinum, may also be used as support (Genosensor Consortium (K. Beattie et al., 1993)).

The probes according to the invention may be synthesized directly in situ on the supports of the DNA chips. This in situ synthesis may be carried out by photochemical addressing (developed by the company Affymax (Amsterdam, Holland) and exploited industrially by its subsidiary Affymetrix (United States)) or based on the VLSIPS (very large scale immobilized polymer synthesis) technology (S. P. A. Fodor et al., 1991) which is based on a method of photochemically directed combinatory synthesis and the principle of which combines solid-phase chemistry, the use of photolabile protecting groups and photolithography.

The probes according to the invention may be attached to the DNA chips in various ways such as electrochemical addressing, automated addressing or the use of probe printers (T. Livache et al., 1994; G. Yershov et al., 1996; J. Derisi et al., 1996, and S. Borman, 1996).

The revealing of the hybridization between the probes of the invention, deposited or synthesized in situ on the supports of the DNA chips, and the sample to be analysed, may be determined, for example, by measurement of fluorescent signals, by radioactive counting or by electronic detection.

The use of fluorescent molecules such as fluorescein constitutes the most common method of labelling the samples. It allows direct or indirect revealing of the hybridization and allows the use of various fluorochromes.

Affymetrix currently provides an apparatus or a scanner designed to read its Gene Chip™ chips. It makes it possible to detect the hybridizations by scanning the surface of the chip in confocal microscopy (R. J. Lipshutz et al., 1995). Other methods of detecting fluorescent signals have been tested: coupling of an epifluorescence microscope and a CCD camera (G. Yershov et al., 1996), the use of an optical fibre collecting system (E. L. Sheldon, 1993). A conventional method consists in carrying out an end labelling, with phosphorus 32, of the target sequences, by means of an appropriate apparatus, the Phosphorimager (marketed by Molecular Dynamics). The electronic detection is based on the principle that the hybridization of two nucleic acid molecules is accompanied by physical phenomena which can be quantified under certain conditions (system developed by Ecole Centrale of Lyon and called GEN-FET (GEN field effect transistor)). Genosensor Consortium and the company Beckman Instruments who are developing an electronic chip or Permittivity Chips™ may also be mentioned (K. Beattie et al., 1993).

The nucleotide sequences according to the invention may thus be used in DNA chips to carry out the analysis of mutations. This analysis is based on the production of chips capable of analysing each base of a nucleotide sequence according to the invention.

The nucleotide sequences according to the invention may also be used in DNA chips to carry out the analysis of the expression of the *Chlamydia pneumoniae* genes. This analysis of the expression of *Chlamydia pneumoniae* genes is based on the use of chips where probes of the invention, chosen for their specificity to characterize a given gene, are present (D. J. Lockhart et al., 1996; D. D. Shoemaker et al., 1996). For the methods of analysis of gene expression using the DNA chips, reference may, for example, be made to the methods described by D. J. Lockhart et al. (1996) and Sosnowsky et al. (1997) for the synthesis of robes in situ or for the addressing and the attachment of previously synthesized probes. The target sequences to be analysed are labelled and in general fragmented into sequences of about 50 to 100 nucleotides before being hybridized onto the chip. After washing as described, for example, by D. J. Lockhart et al. (1996) and application of different electric fields (Sosnowsky et al., 1997), the labelled compounds are detected and quantified, the hybridizations being carried out at least in duplicate. Comparative analyses of the signal intensities obtained with respect to the same probe for different samples and/or for different probes with the same sample, determine the differential expression of RNA or of DNA derived from the sample.

The nucleotide sequences according to the invention may, in addition, be used in DNA chips where other nucleotide probes specific for other microorganisms are also present, and may allow the carrying out of a serial test allowing rapid identification of the presence of a microorganism in a sample.

Accordingly, the subject of the invention is also the nucleotide sequences according to the invention, characterized in that they are immobilized on a support of a DNA chip.

The DNA chips, characterized in that they contain at least one nucleotide sequence according to the invention, immobilized on the support of the said chip, also form part of the invention.

The said chips will preferably contain several probes or nucleotide sequences of the invention of different length and/or corresponding to different genes so as to identify, with greater certainty, the specificity of the target sequences or the desired mutation in the sample to be analysed.

Accordingly, the analyses carried out by means of primers and/or probes according to the invention, immobilized on supports such as DNA chips, will make it possible, for example, to identify, in samples, mutations linked to variations such as intraspecies variations. These variations may be correlated or associated with pathologies specific to the variant identified and will make it possible to select the appropriate treatment.

The invention thus comprises a DNA chip according to the invention, characterized in that it contains, in addition, at least one nucleotide sequence of a microorganism different from *Chlamydia pneumoniae,* immobilized on the support of the said chip; preferably, the different microorganism will be chosen from an associated microorganism, a bacterium of the Chlamydia family, and a variant of the species *Chlamydia pneumoniae.*

Another subject of the present invention is a vector for the cloning and/or the expression of a sequence, characterized in that it contains a nucleotide sequence according to the invention. Among the said vectors according to the invention, the vectors containing a nucleotide sequence encoding a polypeptide of the cellular, preferably outer, envelope of *Chlamydia pneumoniae* or one of its representative fragments, are preferred. In a specific embodiment, the vectors contain a nucleotide sequence encoding a *Chlamydia pneumoniae* secreted polypeptide or one of its representative fragments or encoding a transport polypeptide, a surface exposed polypeptide, a lipoprotein or one of its representative fragments, a polypeptide involved in lipopolysaccharide (LPS) biosynthesis, a Type III and non-Type III secreted polypeptide, a polypeptide containing RGD attachment sites, a cell wall anchored surface polypeptide, a polypeptide not found in *Chlamydia trachomatis,* a ribosomal polypeptide or a polypeptide involved in secretion, transcription, translation, maturation of proteins, a polypeptide involved in the synthesis of the wall, a polypeptide involved in the virulence, a polypeptide involved in the intermediate metabolism, in particular in the metabolism of sugars and/or of cofactors, a polypeptide involved in the metabolism of nucleotides, of amino acids, of nucleic acids or of fatty acids of *Chlamydia pneumoniae* or one of their representative fragments, or a polypeptide specific to *Chlamydia pneumoniae.*

According to the invention, the vectors comprise the elements necessary to allow the expression and/or the secretion of the said nucleotide sequences in a given host cell, and form part of the invention. The vector should, in this case, comprise a promoter, signals for initiation and for termination of translation, as well as appropriate regions for regulation of transcription. It should be capable of being stably maintained in the host cell and may optionally possess particular signals specifying the secretion of the translated protein. These different elements are chosen according to the host cell used. To this effect, the nucleotide sequences according to the invention may be inserted into autonomously-replicating vectors within the chosen host, or integrative vectors in the chosen host.

Any of the standard methods known to those skilled in the art for the insertion of DNA fragments into a vector may be used to construct expression vectors containing a chimeric gene consisting of appropriate transcriptional/translational control signals and the protein coding sequences. These methods may include in vitro recombinant DNA and synthetic techniques and in vivo recombinants (genetic recombination).

Expression of a polypeptide, peptide or derivative, or analogs thereof encoded by a polynucleotide sequence in SEQ ID No. 1 or ORFs contained within SEQ ID No. 1 may be regulated by a second nucleic acid sequence so that the protein or peptide is expressed in a host transformed with the recombinant DNA molecule. For example, expression of a protein or peptide may be controlled by any promoter/ enhancer element known in the art. Promoters which may be used to control expression include, but are not limited to, the CMV promoter, the SV40 early promoter region (Bernoist and Chambon, 1981, Nature 290:304–310), the promoter contained in the 3' long terminal repeat of Rous sarcoma virus (Yamamoto, et al., 1980, Cell 22:787–797), the herpes thymidine kinase promoter (Wagner et al., 1981, Proc. Natl. Acad. Sci. U.S.A. 78:1441–1445), the regulatory sequences of the metallothionein gene (Brinster et al., 1982, Nature 296:39–42); prokaryotic expression vectors such as the $-lactamase promoter (Villa-Kamaroff, et al., 1978, Proc. Natl. Acad. Sci. U.S.A. 75:3727–3731), or the tac promoter (DeBoer, et al., 1983, Proc. Natl. Acad. Sci. U.S.A. 80:21–25); see also "Useful proteins from recombinant bacteria" in Scientific American, 1980, 242:74–94; plant expression vectors comprising the nopaline synthetase promoter region (Herrera-Estrella et al., 1983, Nature 303:209–213) or the cauliflower mosaic virus 35S RNA promoter (Gardner, et al., 1981, Nucl. Acids Res. 9:2871), and the promoter of the photosynthetic enzyme ribulose biphosphate carboxylase (Herrera-Estrella et al., 1984, Nature 310:115–120); promoter elements from yeast or other fungi such as the Gal 4 promoter, the ADC (alcohol dehydrogenase) promoter, PGK (phosphoglycerol kinase) promoter, alkaline phosphatase promoter, and the following animal transcriptional control regions, which exhibit tissue specificity and have been utilized in transgenic animals: elastase I gene control region which is active in pancreatic acinar cells (Swift et al., 1984, Cell 38:639–646; Ornitz et al., 1986, Cold Spring Harbor Symp. Quant. Biol. 50:399–409; MacDonald, 1987, Hepatology 7:425–515); insulin gene control region which is active in pancreatic beta cells (Hanahan, 1985, Nature 315:115–122), immunoglobulin gene control region which is active in lymphoid cells (Grosschedl et al., 1984, Cell 38:647–658; Adames et al., 1985, Nature 318:533–538; Alexander et al., 1987, Mol. Cell. Biol. 7:1436–1444), mouse mammary tumor virus control region which is active in testicular, breast, lymphoid and mast cells (Leder et al., 1986, Cell 45:485–495), albumin gene control region which is active in liver (Pinkert et al., 1987, Genes and Devel. 1:268–276), alpha-fetoprotein gene control region which is active in liver (Krumlauf et al., 1985, Mol. Cell. Biol. 5:1639–1648; Hammer et al., 1987, Science 235:53–58; alpha 1-antitrypsin gene control region which is active in the liver (Kelsey et al., 1987, Genes and Devel. 1:161–171), beta-globin gene control region which is active in myeloid cells (Mogram et al., 1985, Nature 315:338–340; Kollias et al., 1986, Cell 46:89–94; myelin basic protein gene control region which is active in oligodendrocyte cells in the brain (Readhead et al., 1987, Cell 48:703–712); myosin light chain-2 gene control region which is active in skeletal muscle (Sani, 1985, Nature 314:283–286), and gonadotropic releasing hormone gene control region which is active in the hypothalamus (Mason et al., 1986, Science 234:1372–1378).

The vectors according to the invention are, for example, vectors of plasmid or viral origin. In a specific embodiment, a vector is used that comprises a promoter operably linked to a protein or peptide-encoding a nucleic acid sequence in SEQ ID No. 1, or ORFs contained within SEQ ID No. 1, one or more origins of replication, and, optionally, one or more selectable markers (e.g., an antibiotic resistance gene). Expression vectors comprise regulatory sequences that control gene expression, including gene expression in a desired host cell. Preferred vectors for the expression of the polypeptides of the invention include the pET-type plasmid vectors (Promega) or pBAD plasmid vectors (Invitrogen). Furthermore, the vectors according to the invention are useful for transforming host cells so as to clone or express the nucleotide sequences of the invention.

Expression can also be achieved using targeted homologous recombination to activate *Chlamydia pneumoniae* genes present in the cloned genomic DNA. A heterologous regulatory element may be inserted into a stable cell line or cloned microorganism, such that it is operatively linked with an endogenous *Chlamydia pneumoniae* gene present in the cloned genome, using techniques, such as targeted homologous recombination, which are well known to those of skill in the art (See, e.g., Chappel, U.S. Pat. No. 4,215,051 and Skoultchi, WO 91/06667 each of which is incorporated herein in its entirety).

Expression vector/host cell systems containing inserts of polynucleotide sequences in SEQ ID No. 1 or ORFs within SEQ ID No. 1, which encode polypeptides, peptides or derivatives, or analogs thereof, can be identified by three general approaches: (a) nucleic acid hybridization, (b) presence or absence of "marker" gene functions, and (c) expression of inserted sequences. In the first approach, the presence of a polynucleotide sequence inserted in an expression vector can be detected by nucleic acid hybridization using probes comprising sequences that are homologous to an inserted polynucleotide sequence. In the second approach, the recombinant vector/host system can be identified and selected based upon the presence or absence of certain "marker" gene functions (e.g., thymidine kinase activity, resistance to antibiotics, transformation phenotype, occlusion body formation in baculovirus, etc.) caused by the insertion of a polynucleotide sequence in the vector. For example, if the polynucleotide sequence in SEQ ID No. 1 or ORFs within SEQ ID No. 1 is inserted within the marker gene sequence of the vector, recombinants containing the insert can be identified by the absence of the marker gene function. In the third approach, recombinant expression vectors can be identified by assaying the product of the polynucleotide sequence expressed by the recombinant. Such assays can be based, for example, on the physical or functional properties of the expressed polypeptide in in vitro assay systems, e.g., binding with antibody, promotion of cell proliferation.

Once a particular recombinant DNA molecule is identified and isolated, several methods known in the art may be used to propagate it. The clones identified may be introduced into an appropriate host cell by standard methods, such as for example lipofection, electroporation, and heat shock. Once a suitable host system and growth conditions are established, recombinant expression vectors can be propagated and prepared in quantity.

The invention also encompasses the host cells transformed by a vector according to the invention. These cells may be obtained by introducing into host cells a nucleotide sequence inserted into a vector as defined above, and then culturing the said cells under conditions allowing the replication and/or the expression of the transfected nucleotide sequence.

The host cell may be chosen from eukaryotic or prokaryotic systems, such as for example bacterial cells (Olins and Lee, 1993), but also yeast cells (Buckholz, 1993), as well as animal cells, in particular cultures of mammalian cells (Edwards and Aruffo, 1993), and in particular Chinese hamster ovary (CHO) cells, but also insect cells in which methods using baculoviruses for example may be used (Luckow, 1993).

Furthermore, a host cell strain may be chosen which modulates the expression of the inserted sequences, or modifies and processes the gene product in the specific fashion desired. Expression from certain promoters can be elevated in the presence of certain inducers; thus, expression of the genetically engineered polypeptide may be controlled. Furthermore, different host cells have characteristic and specific mechanisms for the translational and post-translational processing and modification (e.g., glycosylation, phosphorylation) of proteins. Appropriate cell lines or host systems can be chosen to ensure the desired modification and processing of the foreign protein expressed. For example, expression in a bacterial system can be used to produce an unglycosylated core protein product. Expression in yeast will produce a glycosylated product. Expression in mammalian cells can be used to ensure "native" glycosylation of a heterologous protein. Furthermore, different vector/host expression systems may effect processing reactions to different extents.

A preferred host cell for the expression of the proteins of the invention consists of prokaryotic cells, such as Gram bacteria. A further preferred host cell according to the invention is a bacterium belonging to the Chlamydia family, more preferably belonging to the species *Chlamydia pneumoniae* or chosen from a microorganism associated with the species *Chlamydia pneumoniae*.

In other specific embodiments, the polypeptides, peptides or derivatives, or analogs thereof may be expressed as a fusion, or chimeric protein product (comprising the protein, fragment, analog, or derivative joined via a peptide bond to a heterologous protein sequence (of a different protein)). Such a chimeric product can be made by ligating the appropriate nucleic acid sequences encoding the desired amino acid sequences to each other by methods known in the art, in the proper coding frame, and expressing the chimeric product by methods commonly known in the art. Alternatively, such a chimeric product may be made by protein synthetic techniques, e.g., by use of a peptide synthesizer.

Genomic sequences can be cloned and expressed as translational gene products (i.e., peptides, polypeptides, and proteins) or transcriptional gene products (i.e., antisense and ribozymes).

The invention further relates to the intracellular production of an antisense nucleic acid sequence of SEQ ID No. 1 by transcription from an exogenous sequence. For example, a vector can be introduced in vivo such that it is taken up by a cell, within which cell the vector or a portion thereof is transcribed, producing an antisense nucleic acid (RNA) of the invention. Such a vector would contain a sequence encoding an antisense nucleic acid. Such a vector can remain episomal or become chromosomally integrated, as long as it can be transcribed to produce the desired antisense RNA. Such vectors can be constructed by recombinant DNA technology methods standard in the art. Vectors can be plasmid, viral, or others known in the art, used for replication and expression in mammalian cells. Expression of the sequence encoding the an antisense RNA can be by any promoter known in the art to act in mammalian, preferably human, cells. Such promoters can be inducible or constitutive. Such promoters include but are not limited to: the CMV promoter, the SV40 early promoter region (Bernoist and Chambon, 1981, Nature 290:304–310), the promoter contained in the 3N long terminal repeat of Rous sarcoma virus (Yamamoto et al., 1980, Cell 22:787–797), the herpes thymidine kinase promoter (Wagner et al., 1981, Proc. Natl. Acad. Sci. U.S.A. 78:1441–1445), the regulatory sequences of the metallothionein gene (Brinster et al., 1982, Nature 296:39–42), etc.

In a specific embodiment, the antisense oligonucleotide comprises catalytic RNA, or a ribozyme (see, e.g., PCT International Publication WO 90/11364, published Oct. 4, 1990; Sarver et al., 1990, Science 247:1222–1225). In another embodiment, the oligonucleotide is a 2N-0-methylribonucleotide (Inoue et al., 1987, Nucl. Acids Res. 15:6131–6148), or a chimeric RNA-DNA analog (Inoue et al., 1987, FEBS Lett. 215:327–330).

In another embodiment, the antisense nucleic acids of the invention comprise a sequence complementary to at least a portion of an RNA transcript of a polynucleotide sequence in SEQ ID No. 1. However, absolute complementarity, although preferred, is not required. A sequence "complementary to at least a portion of an RNA," as referred to herein, means a sequence having sufficient complementarity to be able to hybridize with the RNA, forming a stable duplex; in the case of double-stranded antisense nucleic acid sequence, a single strand of the duplex DNA may thus be tested, or triplex formation may be assayed. The ability to hybridize will depend on both the degree of complementarity and the length of the antisense nucleic acid. Generally, the longer the hybridizing nucleic acid, the more base mismatches with an RNA transcribed from SEQ ID No. 1 may contain and still form a stable duplex (or triplex, as the case may be). One skilled in the art can ascertain a tolerable degree of mismatch by use of standard procedures to determine the melting point of the hybridized complex.

The invention also relates to the animals, except humans, comprising one of the above-described transformed cells according to the invention.

The production of transgenic animals according to the invention overexpressing one or more of the *Chlamydia pneumoniae* genes will be preferably carried out on rats, mice or rabbits according to methods well known to persons skilled in the art such as viral or nonviral transfections. The transgenic animals overexpressing one or more of the said genes may be obtained by transfection of multiple copies of the said genes under the control of a powerful promoter of a ubiquitous nature, or which is selective for one type of tissue. The transgenic animals may also be obtained by homologous recombination on embryonic stem cells, transfer of these stem cells to embryos, selection of the chimeras affected at the level of the reproductive lines, and growth of the said chimeras.

The transformed cells as well as the transgenic animals according to the invention can be used in methods of preparing the recombinant polypeptide.

It is now possible to produce recombinant polypeptides in a relatively large quantity by genetic engineering using the cells transformed with expression vectors according to the invention or using transgenic animals according to the invention.

The methods of preparing a polypeptide of the invention in recombinant form, characterized in that they use a vector and/or a cell transformed with a vector according to the invention and/or a transgenic animal comprising one of the said transformed cells according to the invention, are themselves included in the present invention.

Among the said methods of preparing a polypeptide of the invention in recombinant form, the methods of preparation using a vector, and/or a cell transformed with the said vector and/or a transgenic animal comprising one of the said transformed cells, containing a nucleotide sequence encoding a polypeptide of the cellular envelope of *Chlamydia pneumoniae* or one of its representative fragments, more preferably encoding a polypeptide of the outer cellular envelope of *Chlamydia pneumoniae* or one of its fragment, are preferred.

Among the said methods of preparing a polypeptide of the invention in recombinant form, the methods of preparation using a vector, and/or a cell transformed with the said vector and/or a transgenic animal comprising one of the said transformed cells, containing a nucleotide sequence encoding a *Chlamydia pneumoniae* secreted polypeptide or one of its representative fragments or encoding a transport polypeptide, a surface exposed polypeptide, a lipoprotein or one of its representative fragments, a polypeptide involved in lipopolysaccharide biosynthesis, a Type III or other secreted polypeptide, a polypeptide containing RGD attachment sites, a cell wall anchored surface polypeptide, a polypeptide not found in *Chlamydia trachomatis,* a ribosomal polypeptide or a polypeptide involved in secretion, transcription, translation, maturation of proteins, a polypeptide involved in the synthesis of the wall, a polypeptide involved in the virulence, a polypeptide involved in the intermediate metabolism, in particular in the metabolism of sugars and/or of cofactors, a polypeptide involved in the metabolism of nucleotides, of amino acids, of nucleic acids or of fatty acids of *Chlamydia pneumoniae* or one of their representative fragments, or a polypeptide specific to *Chlamydia pneumoniae,* are also preferred.

The recombinant polypeptides obtained as indicated above may be provided either in glycosylated or non-glycosylated form and may or may not have the natural tertiary structure.

A preferred variant consists in producing a recombinant polypeptide fused to a "carrier" protein (chimeric protein). The advantage of this system is that it allows a stabilization and a reduction in proteolysis of the recombinant product, an increase in solubility during renaturation in vitro and/or a simplification of purification when the fusion partner has affinity for a specific ligand.

More particularly, the invention relates to a method of preparing a polypeptide of the invention comprising the following steps:

a) culture of the transformed cells under conditions allowing the expression of a recombinant polypeptide having a nucleic acid sequence according to the invention;
b) where appropriate, recovery of the said recombinant polypeptide.

When the method of preparing a polypeptide of the invention uses a transgenic animal according to the invention, the recombinant polypeptide is then extracted from the said animal.

The subject of the invention is also a polypeptide capable of being obtained by a method of the invention as described above.

The invention also comprises a method of preparing a synthetic polypeptide, characterized in that it uses an amino acid sequence of polypeptides according to the invention.

The invention also relates to a synthetic polypeptide obtained by a method according to the invention.

Polypeptides according to the invention may also be prepared by conventional techniques in the field of peptide synthesis under conditions suitable to produce the polypeptides encoded by the polynucleotide of the invention.

This synthesis may be carried out in and recovered from a homogeneous solution or on a solid phase.

For example, the synthesis technique in a homogeneous solution described by Houbenweyl in 1974 may be used.

This method of synthesis consists in successively condensing, in pairs, the successive amino acids in the required order, or in condensing amino acids and fragments previously formed and already containing several amino acids in the appropriate order, or alternatively several fragments thus previously prepared, it being understood that care will have been taken to protect beforehand all the reactive functional groups carried by these amino acids or fragments, with the exception of the amine functional groups of one and the carboxyl functional groups of the other or vice versa, which should normally take part in the formation of the peptide bonds, in particular after activation of the carboxyl functional group, according to methods well known in peptide synthesis.

According to another preferred technique of the invention, the one described by Merrifield is used.

To manufacture a peptide chain according to the Merrifield method, a highly porous polymer resin is used, onto which the first C-terminal amino acid of the chain is attached. This amino acid is attached onto a resin via its carboxyl group and its amine functional group is protected. The amino acids which will constitute the peptide chain are thus attached, one after another, onto the amine group, each time deprotected beforehand, of the portion of the peptide chain already formed, and which is attached to the resin. When the entire peptide chain desired is formed, the protecting groups are removed from the various amino acids constituting the peptide chain and the peptide is detached from the resin with the aid of an acid.

The invention relates, in addition, to hybrid (fusion) polypeptides having at least one polypeptide or one of its representative fragments according to the invention, and a sequence of a polypeptide capable of eliciting an immune response in humans or animals.

Advantageously, the antigenic determinant is such that it is capable of eliciting a humoral and/or cellular response. An antigenic determinant may be identified by screening expression libraries of the *Chlamydia pneumoniae* genome with antibodies contained in the serum of patients infected with a bacterium belonging to the species *Chlamydia pneumoniae*. An antigenic determinant may comprise a polypeptide or one of its representative fragments according to the invention, in glycosylated form, used in order to obtain immunogenic compositions capable of inducing the synthesis of antibodies directed against multiple epitopes. The said polypeptides or their glycosylated fragments also form part of the invention.

These hybrid molecules may consist, in part, of a carrier molecule for polypeptides or for their representative fragments according to the invention, combined with a portion which may be immunogenic, in particular an epitope of the diphtheria toxin, the tetanus toxin, a hepatitis B virus surface antigen (patent FR 79 21811), the poliomyelitis virus VP1 antigen or any other viral or bacterial toxin or antigen.

The methods of synthesizing the hybrid molecules include the methods used in genetic engineering to construct hybrid nucleotide sequences encoding the desired polypeptide sequences. Reference may be advantageously made, for example, to the technique for producing genes encoding fusion proteins described by Minton in 1984.

The said hybrid nucleotide sequences encoding a hybrid polypeptide as well as the hybrid polypeptides according to the invention, characterized in that they are recombinant polypeptides obtained by the expression of the said hybrid nucleotide sequences, also form part of the invention.

The invention also comprises the vectors characterized in that they contain one of the said hybrid nucleotide sequences. The host cells transformed by the said vectors, the transgenic animals comprising one of the said transformed cells as well as the methods of preparing recombinant polypeptides using the said vectors, the said transformed cells and/or the said transgenic animals of course also form part of the invention.

The polypeptides according to the invention, the antibodies according to the invention described below and the nucleotide sequences according to the invention may advantageously be used in in vitro and/or in vivo methods for the detection and/or the identification of bacteria belonging to the species *Chlamydia pneumoniae,* in a biological sample (biological tissue or fluid) which is likely to contain them. These methods, depending on the specificity of the polypeptides, of the antibodies and of the nucleotide sequences according to the invention which will be used, may in particular detect and/or identify the bacterial variants belonging to the species *Chlamydia pneumoniae* as well as the associated microorganisms capable of being detected by the polypeptides, the antibodies and the nucleotide sequences according to the invention which will be chosen. It may, for example, be advantageous to choose a polypeptide, an antibody or a nucleotide sequence according to the invention, which is capable of detecting any bacterium of the Chlamydia family by choosing a polypeptide, an antibody and/or a nucleotide sequence according to the invention which is specific to the family or, on the contrary, it will be most particularly advantageous to target a variant of the species *Chlamydia pneumoniae,* which is responsible, for example, for the induction or the worsening of pathologies specific to the targeted variant, by choosing a polypeptide, an antibody and/or a nucleotide sequence according to the invention which is specific to the said variant.

The polypeptides according to the invention may advantageously be used in a method for the detection and/or the identification of bacteria belonging to the species *Chlamydia pneumoniae* or to an associated microorganism, in a biological sample (biological tissue or fluid) which is likely to contain them, characterized in that it comprises the following steps:
a) bringing this biological sample into contact with a polypeptide or one of its representative fragments according to the invention (under conditions allowing an immunological reaction between the said polypeptide and the antibodies which may be present in the biological sample);
b) detecting the antigen-antibody complexes which may be formed.

Preferably, the biological sample consists of a fluid, for example a human or animal serum, blood or biopsies.

Any conventional procedure may be used to carry out such a detection of the antigen-antibody complexes which may be formed.

By way of example, a preferred method uses immunoenzymatic procedures based on the ELISA technique, immunofluorescence procedures or radioimmunological procedures (RIA), and the like.

Accordingly, the invention also relates to the polypeptides according to the invention, labelled with the aid of a suitable label such as a label of the enzymatic, fluorescent or radioactive type.

Such methods comprise, for example, the following steps:
deposition of defined quantities of a polypeptide composition according to the invention into the wells of a microtitre plate,
introduction, into the said wells, of increasing dilutions of serum, or of a different biological sample as defined above, which has to be analysed,
incubation of the microplate,
introduction, into the wells of the microtitre plate, of labelled antibodies directed against human or animal immunoglobulins, these antibodies having been labelled with the aid of an enzyme selected from those which are capable of hydrolyzing a substrate, thereby modifying the absorption of the radiation of the latter, at least at a defined wavelength, for example at 550 nm,
detection, by comparison with a control, of the quantity of substrate hydrolyzed.

The invention also relates to a kit or set for the detection and/or the identification of bacteria belonging to the species *Chlamydia pneumoniae* or to an associated microorganism, characterized in that it comprises the following components:
a polypeptide according to the invention,
where appropriate, the reagents for constituting the medium appropriate for the immunological or specific reaction,
the reagents allowing the detection of the antigen-antibody complexes produced by the immunological reaction between the polypeptide(s) of the invention and the antibodies which may be present in the biological sample, it being possible for these reagents also to carry a label, or to be capable of being recognized in turn by a labelled reagent, more particularly in the case where the polypeptide according to the invention is not labelled,
where appropriate, a reference biological sample (negative control) free of antibodies recognized by a polypeptide according to the invention,
where appropriate, a reference biological sample (positive control) containing a predetermined quantity of antibodies recognized by a polypeptide according to the invention.

According to the invention, the polypeptides, peptides, fusion proteins or other derivatives, or analogs thereof encoded by a polynucleotide sequence in SEQ ID No. 1, may be used as an immunogen to generate antibodies which immunospecifically bind such an immunogen. Such antibodies may include, but are not limited to, polyclonal and monoclonal antibodies, humanized or chimeric antibodies, single chain antibodies, Fab fragments, F(ab')$_2$ fragments, fragments produced by a Fab expression library, anti-idiotypic (anti-Id) antibodies, and epitope-binding fragments of any of the above. In a specific embodiment, the antibody to a polypeptide, peptide or other derivative, or analog thereof encoded by a polynucleotide sequence in SEQ ID No. 1 is a bispecific antibody (see generally, e.g. Fanger and Drakeman, 1995, *Drug News and Perspectives* 8: 133–137). Such a bispecific antibody is genetically engineered to recognize both (1) an epitope and (2) one of a variety of "trigger" molecules, e.g. Fc receptors on myeloid cells, and CD3 and CD2 on T cells, that have been identified as being able to cause a cytotoxic T-cell to destroy a particular target. Such bispecific antibodies can be prepared either by chemical conjugation, hybridoma, or recombinant molecular biology techniques known to the skilled artisan.

Various procedures known in the art may be used for the production of polyclonal antibodies to a polypeptide, peptide or other derivative, or analog thereof encoded by a polynucleotide sequence in SEQ ID No. 1. For the production of antibody, various host animals can be immunized by injection with a polypeptide, or peptide or other derivative, or analog thereof, including but not limited to rabbits, mice, rats, etc. Various adjuvants, depending on the host species, may be used to increase the immunological response, including but not limited to Stimulon™ QS-21 (Aquila Biopharmaceuticals, Inc., Framingham, Mass.), MPL™ (3-O-deacylated monophosphoryl lipid A; RIBI ImmunoChem Research, Inc., Hamilton, Mont.), aluminum phosphate, IL-12 (Genetics Institute, Cambridge, Mass.), Freund's (complete and incomplete), mineral gels such as aluminum hydroxide, surface active substances such as lysolecithin, pluronic polyols, polyanions, peptides, oil emulsions, keyhole limpet hemocyanins, dinitrophenol, BCG (bacille Calmette-Guerin), and corynebacterium parvum. Alternatively, polyclonal antibodies may be prepared by purifying, on an affinity column onto which a polypeptide according to the invention has been previously attached, the antibodies contained in the serum of patients infected with a bacterium belonging to the species *Chlamydia pneumoniae*.

For preparation of monoclonal antibodies directed toward a polypeptide, peptide or other derivative, or analog, any technique which provides for the production of antibody molecules by continuous cell lines in culture may be used. For example, the hybridoma technique originally developed by Kohler and Milstein (1975, Nature 256:495–497), as well as the trioma technique, the human B-cell hybridoma technique (Kozbor et al., 1983, Immunology Today 4:72), and the EBV-hybridoma technique to produce human monoclonal antibodies (Cole et al., 1985, in Monoclonal Antibodies and Cancer Therapy, Alan R. Liss, Inc., pp. 77–96). In an additional embodiment of the invention, monoclonal antibodies can be produced in germ-free animals utilizing technology described in PCT/US90/02545. In another embodiment of the invention, transgenic non-human animals can be used for the production of human antibodies utilizing technology described in WO 98/24893 and WO 96/33735. According to the invention, human antibodies may be used and can be obtained by using human hybridomas (Cote et al., 1983, Proc. Natl. Acad. Sci. U.S.A. 80:2026–2030) or by transforming human B cells with EBV virus in vitro (Cole et al., 1985, in *Monoclonal Antibodies and Cancer Therapy*, Alan R. Liss, pp. 77–96). In fact, according to the invention, techniques developed for the production of "chimeric antibodies" (Morrison et al., 1984, PROC. NATL. ACAD. SCI. U.S.A. 81:6851–6855; Neuberger et al., 1984, Nature 312:604–608; Takeda et al., 1985, Nature 314:452–454) by splicing the genes from a mouse antibody molecule specific for a polypeptide, peptide or other derivative, or analog together with genes from a human antibody molecule of appropriate biological activity can be used; such antibodies are within the scope of this invention.

According to the invention, techniques described for the production of single chain antibodies (U.S. Pat. No. 4,946, 778) can be adapted to produce polypeptide or peptide-specific single chain antibodies. An additional embodiment of the invention utilizes the techniques described for the construction of Fab expression libraries (Huse et al., 1989, Science 246:1275–1281) to allow rapid and easy identification of monoclonal Fab fragments with the desired specificity for polypeptides, derivatives, or analogs.

Antibody fragments which contain the idiotype of the molecule can be generated by known techniques. For example, such fragments include but are not limited to: the F(ab')$_2$ fragment which can be produced by pepsin digestion of the antibody molecule; the Fab' fragments which can be generated by reducing the disulfide bridges of the F(ab')$_2$ fragment, the Fab fragments which can be generated by treating the antibody molecule with papain and a reducing agent, and Fv fragments.

In addition, techniques have been developed for the production of chimerized (See, e.g., Boss, M. et al., U.S. Pat. No. 4,816,397; and Cabilly, S. et al., U.S. Pat. No. 5,585,089 each of which is incorporated herein by reference in its entirety) humanized antibodies (See, e.g., Queen, U.S. Pat. No. 5,585,089, which is incorporated herein by reference in its entirety.) An immunoglobulin light or heavy chain variable region consists of a "framework" region interrupted by three hypervariable regions, referred to as complementarily determining regions (CDRs). The extent of the framework region and CDRs have been precisely defined (See, "Sequences of Proteins of Immunological Interest", Kabat, E. et al., U.S. Department of Health and Human Services (1983). Briefly, humanized antibodies are antibody molecules from non-human species having one or more CDRs from the non-human species and a framework from a human immunoglobulin molecule.

The antibodies of the invention may also be labelled in the same manner as described above for the nucleic probes of the invention such as an enzymatic, fluorescent or radioactive type labelling.

The invention relates, in addition, to a method for the detection and/or the identification of bacteria belonging to the species *Chlamydia pneumoniae* or to an associated microorganism in a biological sample, characterized in that it comprises the following steps:
a) bringing the biological sample (biological tissue or fluid) into contact with a mono- or polyclonal antibody according to the invention (under conditions allowing an immunological reaction between the said antibodies and the polypeptides of the bacterium belonging to the species *Chlamydia pneumoniae* or to an associated microorganism which may be present in the biological sample, that is, under conditions suitable for the formation of immune complexes);
b) detecting the antigen-antibody complex which may be formed.

Also falling within the scope of the invention is a kit or set for the detection and/or the identification of bacteria belonging to the species *Chlamydia pneumoniae* or to an associated microorganism, characterized in that it comprises the following components:
a polyclonal or monoclonal antibody according to the invention, labeled where appropriate;
where appropriate, a reagent for constituting the medium appropriate for carrying out the immunological reaction;
a reagent allowing the detection of the antigen-antibody complexes produced by the immunological reaction, it being possible for this reagent also to carry a label, or to be capable of being recognized in turn by a labelled reagent, more particularly in the case where the said monoclonal or polyclonal antibody is not labelled;
where appropriate, reagents for carrying out the lysis of the cells in the sample tested.

The principle of the DNA chip which was explained above may also be used to produce protein "chips" on which the support has been coated with a polypeptide or an antibody according to the invention, or arrays thereof, in place of the DNA. These protein "chips" make it possible, for example, to analyze the biomolecular interactions (BIA) induced by the affinity capture of target analytes onto a support coated, for example, with proteins, by surface plasma resonance (SPR). Reference may be made, for example, to the techniques for coupling proteins onto a solid support which are described in EP 524 800 or to the methods describing the use of biosensor-type protein chips such as the BIAcore-type technique (Pharmacia) (Arlinghaus et al., 1997, Krone et al., 1997, Chatelier et al., 1995). These polypeptides or antibodies according to the invention, capable of specifically binding antibodies or polypeptides derived from the sample to be analysed, may thus be used in protein chips for the detection and/or the identification of proteins in samples. The said protein chips may in particular be used for infectious diagnosis and may preferably contain, per chip, several polypeptides and/or antibodies of the invention of different specificity, and/or polypeptides and/or antibodies capable of recognizing microorganisms different from *Chlamydia pneumoniae*.

Accordingly, the subject of the present invention is also the polypeptides and the antibodies according to the invention, characterized in that they are immobilized on a support, in particular of a protein chip.

The protein chips, characterized in that they contain at least one polypeptide or one antibody according to the invention immobilized on the support of the said chip, also form part of the invention.

The invention comprises, in addition, a protein chip according to the invention, characterized in that it contains, in addition, at least one polypeptide of a microorganism different from *Chlamydia pneumoniae* or at least one antibody directed against a compound of a microorganism different from *Chlamydia pneumoniae*, immobilized on the support of the said chip.

The invention also relates to a kit or set for the detection and/or the identification of bacteria belonging to the species *Chlamydia pneumoniae* or to an associated microorganism, or for the detection and/or the identification of a microorganism characterized in that it comprises a protein chip according to the invention.

The subject of the present invention is also a method for the detection and/or the identification of bacteria belonging to the species *Chlamydia pneumoniae* or to an associated microorganism in a biological sample, characterized in that it uses a nucleotide sequence according to the invention.

More particularly, the invention relates to a method for the detection and/or the identification of bacteria belonging to the species *Chlamydia pneumoniae* or to an associated microorganism in a biological sample, characterized in that it comprises the following steps:
a) where appropriate, isolation of the DNA from the biological sample to be analysed, or optionally production of a cDNA from the RNA in the biological sample;
b) specific amplification of the DNA of bacteria belonging to the species *Chlamydia pneumoniae* or to an associated microorganism with the aid of at least one primer according to the invention;
c) detection of the amplification products.

These may be detected, for example, by the molecular hybridization technique using a nucleic probe according to the invention. This probe will be advantageously labelled with a nonradioactive (cold probe) or radioactive element.

For the purposes of the present invention, "DNA in the biological sample" or "DNA contained in the biological sample" will be understood to mean either the DNA present in the biological sample considered, or optionally the cDNA obtained after the action of a reverse transcriptase-type enzyme on the RNA present in the said biological sample.

Another aim of the present invention consists in a method according to the invention, characterized in that it comprises the following steps:
a) bringing a nucleotide probe according to the invention into contact with a biological sample, the DNA contained in the biological sample having, where appropriate, been previously made accessible to hybridization, under conditions allowing the hybridization of the probe to complementary base pairs of the DNA of a bacterium belonging to the species *Chlamydia pneumoniae* or to an associated microorganism;
b) detecting the hybridization complex formed between the nucleotide probe and the DNA in the biological sample.

The present invention also relates to a method according to the invention, characterized in that it comprises the following steps:
a) bringing a nucleotide probe immobilized on a support according to the invention into contact with a biological sample, the DNA in the sample having, where appropriate, been previously made accessible to hybridization, under conditions allowing the hybridization of the probe to the DNA of a bacterium belonging to the species *Chlamydia pneumoniae* or to an associated microorganism;
b) bringing the hybrid formed between the nucleotide probe immobilized on a support and the DNA contained in the biological sample, where appropriate after removal of the DNA in the biological sample which has not hybridized with the probe, into contact with a labelled nucleotide probe according to the invention;
c) detecting the new hybrid formed in step b).

According to an advantageous embodiment of the method for the detection and/or the identification defined above, it is characterized in that, prior to step a), the DNA in the biological sample is primer-extended and/or amplified beforehand with the aid of at least one primer according to the invention.

The invention relates, in addition, to a kit or set for the detection and/or the identification of bacteria belonging to the species *Chlamydia pneumoniae* or to an associated microorganism, characterized in that it comprises the following components:

a) a nucleotide probe according to the invention;
b) where appropriate, the reagents necessary for carrying out a hybridization reaction;
c) where appropriate, at least one primer according to the invention as well as the reagents (e.g., polymerase and/or deoxynucleotide triphosphates) necessary for a DNA amplification reaction.

The invention also relates to a kit or set for the detection and/or the identification of bacteria belonging to the species *Chlamydia pneumoniae* or to an associated microorganism, characterized in that it comprises the following components:
a) a nucleotide probe, called capture probe, according to the invention;
b) an oligonucleotide probe, called detection probe, according to the invention;
c) where appropriate, at least one primer according to the invention as well as the reagents (e.g., polymerase and/or deoxynucleotide triphosphates) necessary for a DNA amplification reaction.

The invention also relates to a kit or set for the detection and/or the identification of bacteria belonging to the species *Chlamydia pneumoniae* or to an associated microorganism, characterized in that it comprises the following components:
a) at least one primer according to the invention;
b) where appropriate, the reagents necessary for carrying out a DNA amplification reaction;
c) where appropriate, a component which makes it possible to check the sequence of the amplified fragment, more particularly an oligonucleotide probe according to the invention.

The invention relates, in addition, to a kit or set for the detection and/or the identification of bacteria belonging to the species *Chlamydia pneumoniae* or to an associated microorganism, or for the detection and/or the identification of a microorganism characterized in that it comprises a DNA chip according to the invention.

The invention also relates to a method or to a kit or set according to the invention for the detection and/or the identification of bacteria belonging to the species *Chlamydia pneumoniae,* characterized in that the said primer and/or the said probe according to the invention are chosen from the nucleotide sequences specific to the species *Chlamydia pneumoniae,* in that the said polypeptides according to the invention are chosen from the polypeptides specific to the species *Chlamydia pneumoniae* and in that the said antibodies according to the invention are chosen from the antibodies directed against the polypeptides according to the invention chosen from the polypeptides specific to the species *Chlamydia pneumoniae.*

Preferably, the said method or the said kit or set above according to the invention, for the detection and/or the identification of bacteria belonging to the species *Chlamydia pneumoniae* is characterized in that the said primer and/or the said probe or the said polypeptides are chosen from the nucleotide sequences or polypeptides according to the invention which have been identified as being specific to the species *Chlamydia pneumoniae* and in that the said antibodies according to the invention are chosen from the antibodies directed against the polypeptides according to the invention chosen from the polypeptides identified as being specific to the species *Chlamydia pneumoniae.*

The invention relates, in addition, to a method or a kit or set according to the invention for the diagnosis of predispositions to, or of a condition caused by, cardiovascular diseases, preferably linked to the presence of atheroma, which are induced or worsened by a *Chlamydia pneumoniae* infection.

The invention also relates to a method or a kit or set according to the invention for the diagnosis of predispositions to, or of conditions caused by, respiratory diseases induced or worsened by a *Chlamydia pneumoniae* infection; preferably, the said respiratory disease is asthma.

According to another aspect, the subject of the invention is the use of polypeptides according to the invention, of cells transformed with a vector according to the invention and/or of transformed animals according to the invention, for the biosynthesis or the biodegradation of organic or inorganic compounds.

As has been mentioned above, the nucleotide sequences of the invention were identified by homology with sequences known to encode, for example, polypeptides or fragments of enzymatic polypeptides involved in the biosynthesis or the biodegradation of organic or inorganic molecules.

It is thus possible to use the said polypeptides of the invention in a similar manner for the biosynthesis or the biodegradation of organic or inorganic compounds of industrial or therapeutic interest (called compounds of interest).

Among these polypeptides, there may be mentioned in particular the enzymes involved in metabolism, such as the proteolytic enzymes, amino transferases, glucose metabolism, or the enzymes which may be used in the biosynthesis of sugars, amino acids, fatty acids, polypeptides, nucleotides, nucleic acids or any other organic or inorganic compound or in the biodegradation of organic or inorganic compounds.

Among these polypeptides, there may be mentioned, in addition, the mutated or modified enzymes corresponding to mutated or modified polypeptides according to the invention which may also be used for the biosynthesis or the biodegradation of organic or inorganic compounds at the industrial level, such as, for example, the production of compounds of interest, the reprocessing of manufacturing residues applied to the food industries, to the papermaking industry or to the chemical and pharmaceutical industries.

The methods of biosynthesis or biodegradation of organic or inorganic compounds, characterized in that they use a polypeptide or one of its representative fragments according to the invention, transformed cells according to the invention and/or a transformed animal according to the invention, also form part of the invention.

The invention relates, in addition, to the use of a nucleotide sequence according to the invention, of a polypeptide according to the invention, of an antibody according to the invention, of a cell according to the invention, and/or of a transformed animal according to the invention, for the selection of an organic or inorganic compound capable of modulating, regulating, inducing or inhibiting the expression of genes, and/or of modifying the cellular replication of eukaryotic or prokaryotic cells or capable of inducing, inhibiting or worsening the pathologies linked to an infection by *Chlamydia pneumoniae* or one of its associated microorganisms.

The invention also comprises screening assays that comprise methods of selecting compounds capable of binding to a polypeptide, fusion polypeptide or one of its representative fragments according to the invention, capable of binding to a nucleotide sequence according to the invention, or capable of recognizing an antibody according to the invention, and/or capable of modulating, regulating, inducing or inhibiting the expression of genes, and/or of modifying the growth or the cellular replication of eukaryotic or prokaryotic cells, or capable of inducing, inhibiting or worsening, in an animal or human organism, the pathologies linked to an infection by *Chlamydia pneumoniae* or one of its associated microorganisms, characterized in that it comprises the following steps:

a) bringing the said compound into contact with the said polypeptide, the said nucleotide sequence, with a transformed cell according to the invention and/or administering the said compound to a transformed animal according to the invention;

b) determining the capacity of the said compound to bind with the said polypeptide or the said nucleotide sequence, or to modulate, regulate, induce or inhibit the expression of genes, or to modulate growth or cellular replication, or to induce, inhibit or worsen in the said transformed animal, the pathologies linked to an infection by *Chlamydia pneumoniae* or one of its associated microorganisms.

The transformed cells and/or animals according to the invention may advantageously serve as a model and may be used in methods for studying, identifying and/or selecting compounds capable of being responsible for pathologies induced or worsened by *Chlamydia pneumoniae*, or capable of preventing and/or of treating these pathologies such as, for example, cardiovascular or respiratory diseases. In particular, the transformed host cells, in particular bacteria of the Chlamydia family whose transformation with a vector according to the invention may, for example, increase or inhibit its infectivity, or modulate the pathologies usually induced or worsened by the infection, may be used to infect animals in which the onset of pathologies will be monitored. These nontransformed animals, infected for example with transformed Chlamydia bacteria, may serve as a study model. In the same manner, the transformed animals according to the invention may, for example, exhibit predispositions to cardiovascular and/or respiratory diseases and thus be used in methods for selecting compounds capable of preventing and/or of treating the said diseases. The said methods using the said transformed cells and/or transformed animals form part of the invention.

The compounds capable of being selected may be organic compounds such as polypeptides or carbohydrates or any other organic or inorganic compounds already known, or new organic compounds produced using molecular modeling techniques and obtained by chemical or biochemical synthesis, these techniques being known to persons skilled in the art.

The said selected compounds may be used to modulate the growth and/or the cellular replication of *Chlamydia pneumoniae* or any other associated microorganism and thus to control infection by these microorganisms. The said compounds according to the invention may also be used to modulate the growth and/or the cellular replication of all eukaryotic or prokaryotic cells, in particular tumour cells and infectious microorganisms, for which the said compounds will prove active, the methods which make it possible to determine the said modulations being well known to persons skilled in the art.

Compound capable of modulating the growth of a microorganism is understood to designate any compound which makes it possible to act, to modify, to limit and/or to reduce the development, the growth, the rate of proliferation and/or the viability of the said microorganism.

This modulation may be achieved, for example, by an agent capable of binding to a protein and thus of inhibiting or of potentiating its biological activity, or capable of binding to a membrane protein of the outer surface of a microorganism and of blocking the penetration of the said microorganism into the host cell or of promoting the action of the immune system of the infected organism directed against the said microorganism. This modulation may also be achieved by an agent capable of binding to a nucleotide sequence of a DNA or RNA of a microorganism and of blocking, for example, the expression of a polypeptide whose biological or structural activity is necessary for the growth or for the reproduction of the said microorganism.

Associated microorganism is understood to designate in the present invention any microorganism whose gene expression may be modulated, regulated, induced or inhibited, or whose growth or cellular replication may also be modulated by a compound of the invention. Associated microorganism is also understood to designate in the present invention any microorganism containing nucleotide sequences or polypeptides according to the invention. These microorganisms may, in some cases, contain polypeptides or nucleotide sequences identical or homologous to those of the invention may also be detected and/or identified by the detection and/or identification methods or kit according to the invention and may also serve as a target for the compounds of the invention.

The invention relates to the compounds capable of being selected by a method of selection according to the invention.

The invention also relates to a pharmaceutical composition comprising a compound chosen from the following compounds:
a nucleotide sequence according to the invention;
a polypeptide according to the invention;
a vector according to the invention;
an antibody according to the invention; and
a compound capable of being selected by a method of selection according to the invention, optionally in combination with a pharmaceutically acceptable vehicle.

An effective quantity is understood to designate a sufficient quantity of the said compound or antibody, or of a polypeptide of the invention, which makes it possible to modulate the growth of *Chlamydia pneumoniae* or of an associated microorganism.

The invention also relates to a pharmaceutical composition comprising one or more polypeptides according to the invention and/or one or more fusion polypeptides according to the invention. Such compositions further comprise a pharmaceutically acceptable carrier or vehicle. Pharmaceutical compositions include compositions that comprise a polypeptide or fusion polypeptide that immunoreacts with seropositive serum of an individual infected with *Chlamydia pneumoniae*. In one embodiment, a pharmaceutical composition according to the invention can be utilized for the prevention or the treatment of an infection by a bacterium belonging to the species *Chlamydia pneumoniae* or by an associated microorganism.

The invention relates, in addition, to an immunogenic composition or a vaccine composition, characterized in that it comprises one or more polypeptides according to the invention and/or one or more hybrid (fusion) polypeptides according to the invention. Such compositions further comprise a pharmaceutically acceptable carrier or vehicle. Immunogenic compositions or fusion polypeptide include compositions that comprise a polypeptide that immunoreacts with seropositive serum of an individual infected with *Chlamydia pneumoniae*.

Immunogenic or vaccine compositions can also comprise DNA immunogenic or vaccine compositions comprising polynucleotide sequences of the invention operatively associated with a regulatory sequence that controls gene expression. Such compositions can include compositions that direct expression of a neutralizing epitope of *Chlamydia pneumoniae*.

The invention also comprises the use of a transformed cell according to the invention, for the preparation of a vaccine composition.

The invention also relates to a vaccine composition, characterized in that it contains a nucleotide sequence according to the invention, a vector according to the invention and/or a transformed cell according to the invention.

The invention also relates to the vaccine compositions according to the invention, for the prevention or the treatment of an infection by a bacterium belonging to the species *Chlamydia pneumoniae* or by an associated microorganism.

The invention also relates to the use of DNA encoding polypeptides of *Chlamydia pneumoniae*, in particular antigenic determinants, to be formulated as vaccine compositions. In accordance with this aspect of the invention, the DNA of interest is engineered into an expression vector under the control of regulatory elements, which will promote expression of the DNA, i.e., promoter or enhancer elements. In one preferred embodiment, the promoter element may be cell-specific and permit substantial transcription of the DNA only in predetermined cells. The DNA may be introduced directly into the host either as naked DNA (U.S. Pat. No. 5,679,647 incorporated herein by reference in their entirety) or formulated in compositions with other agents which may facilitate uptake of the DNA including viral vectors, i.e., adenovirus vectors, or agents which facilitate immunization, such as bupivicaine and other local anesthetics (U.S. Pat. No. 5,593,972 incorporated herein by reference in their entirety), saponins (U.S. Pat. No. 5,739,118 incorporated herein by reference in their entirety) and cationic polyamines (published international application WO 96/10038 incorporated herein by reference in their entirety).

The DNA sequence encoding the antigenic polypeptide and regulatory element may be inserted into a stable cell line or cloned microorganism, using techniques, such as targeted homologous recombination, which are well known to those of skill in the art, and described e.g., in Chappel, U.S. Pat. No. 4,215,051; Skoultchi, WO 91/06667 each of which is incorporated herein by reference in its entirety.

Such cell lines and microorganisms may be formulated for vaccine purposes. In yet another embodiment, the DNA sequence encoding the antigenic polypeptide and regulatory element may be delivered to a mammalian host and introduced into the host genome via homologous recombination (See, Chappel, U.S. Pat. No. 4,215,051; Skoultchi, WO 91/06667 each of which is incorporated herein by reference in its entirety.

Preferably, the immunogenic and/or vaccine compositions according to the invention intended for the prevention and/or the treatment of an infection by *Chlamydia pneumoniae* or by an associated microorganism will be chosen from the immunogenic and/or vaccine compositions comprising a polypeptide or one of its representative fragments corresponding to a protein, or one of its representative fragments, of the cellular envelope of *Chlamydia pneumoniae*. The vaccine compositions comprising nucleotide sequences will also preferably comprise nucleotide sequences encoding a polypeptide or one of its representative fragments corresponding to a protein, or one of its representative fragments, of the cellular envelope of *Chlamydia pneumoniae*.

Among these preferred immunogenic and/or vaccine compositions, the most preferred are those comprising a polypeptide or one of its representative fragments, or a nucleotide sequence or one of its representative fragments hose sequences are chosen from the nucleotide or amino acid sequences identified in this functional group and listed above.

The polypeptides of the invention or their representative fragments entering into the immunogenic compositions according to the invention may be selected by techniques known to persons skilled in the art, such as for example on the capacity of the said polypeptides to stimulate T cells, which results, for example, in their proliferation or the secretion of interleukins, and which leads to the production of antibodies directed against the said polypeptides.

In mice, in which a weight dose of the vaccine composition comparable to the dose used in humans is administered, the antibody reaction is tested by collecting serum followed by a study of the formation of a complex between the antibodies present in the serum and the antigen of the vaccine composition, according to the customary techniques.

According to the invention, the said vaccine compositions will be preferably in combination with a pharmaceutically acceptable vehicle and, where appropriate, with one or more appropriate immunity adjuvants.

Various types of vaccines are currently available for protecting humans against infectious diseases: attenuated live microorganisms (*M. bovis*—BCG for tuberculosis), inactivated microorganisms (influenza virus), acellular extracts (*Bordetella pertussis* for whooping cough), recombinant proteins (hepatitis B virus surface antigen), polysaccharides (pneumococci). Experiments are underway on vaccines prepared from synthetic peptides or from genetically modified microorganisms expressing heterologous antigens. Even more recently, recombinant plasmid DNAs carrying genes encoding protective antigens were proposed as an alternative vaccine strategy. This type of vaccination is carried out with a particular plasmid derived from an *E. coli* plasmid which does not replicate in vivo and which encodes only the vaccinal protein. Animals were immunized by simply injecting the naked plasmid DNA into the muscle. This technique leads to the expression of the vaccine protein in situ and to a cell-type (CTL) and a humoral type (antibody) immune response. This double induction of the immune response is one of the main advantages of the technique of vaccination with naked DNA.

The vaccine compositions of the present invention can be evaluated in in vitro and in vivo animal models prior to host, e.g., human, administration. For example, in vitro neutralization assays such as those described by Peterson et al. (1988) can be utilized. The assay described by Peterson et al. (1988) is suitable for testing vaccine compositions directed toward either *Chlamydia pneumoniae* or *Chlamydia trachomatis*.

Briefly, hyper-immune antisera is diluted in PBS containing 5% guinea pig serum, as a complement source. Chlamydiae ($10^4$ IFU; inclusion-forming units) are added to the antisera dilutions. The antigen-antibody mixtures are incubated at 37° C. for 45 minutes and inoculated into duplicate confluent Hep-2 or HeLa cell monolayers contained in glass vials (e.g., 15 by 45 mm), which have been washed twice with PBS prior to inoculation. The monolayer cells are infected by centrifugation at 1000×g for 1 hour followed by stationary incubation at 37E for 1 hour. Infected monolayers are incubated for 48 or 72 hours, fixed and stained with a Chlamydiae specific antibody, such as anti-MOMP for *C.trachomatis*, etc. IFUs are counted in ten fields at a magnification of 200×. Neutralization titer is assigned based on the dilution that gives 50% inhibition as compared to control monolayers/IFU.

The efficacy of vaccine compositions can be determined in vivo by challenging animal models of *Chlamydia pneumoniae* infection, e.g., mice or rabbits, with the vaccine compositions. For example, in vivo vaccine composition challenge studies can be performed in the murine model of *Chlamydia pneumonia* infection described by Moazed et al. (1997). Briefly, male homozygous apoE deficient and/or C57 BL/6J mice are immunized with vaccine compositions. Post-vaccination, the mice are mildly sedated by subcutaneous injection of a mixture of ketamine and xylazine, and inoculated intranasally with a total volume of 0.03–0.05 ml of organisms suspended in SPG medium or with SPG alone. The inoculations of *Chlamydia pneumoniae* are approximately $3 \times 10^7$ IFU/mouse. The mice are inoculated with *Chlamydia pneumoniae* at 8, 10, and 12 weeks of age. Tissues are then collected from the lung, spleen, heart, etc. at 1–20 weeks after the first inoculation. The presence of organisms is scored using PCR, histology and immunocytochemistry, or by quantitative culture/IFU after tissue homogenization.

Alternatively, in vivo vaccine composition challenge studies can be performed in the rabbit model of *Chlamydia pneumoniae* described by Laitinen et al. (1997). Briefly, New Zealand white rabbits (5 months old) are immunized with the vaccine compositions. Post-vaccination, the rabbits are sedated with Hypnorm, 0.3 ml/Kg of body weight, intramuscularly, and inoculated intranasally with a total of 0.5 ml of *Chlamydia pneumoniae* suspended in SPG medium or with SPG alone. The inoculations of *Chlamydia pneumoniae* are approximately $3 \times 10^7$ IFU/rabbit. The rabbits are reinfected in the same manner and with the same dose 3 weeks after the primary inoculation. Tissues are then collected 2 weeks after the primary infection and 1, 2, and 4 weeks after the reinfection. The presence of *Chlamydia pneumoniae* is scored using PCR, histology and immunocytochemistry, or by quantitative culture/IFU after tissue homogenization.

The vaccine compositions comprising nucleotide sequences or vectors into which the said sequences are inserted are in particular described in International Application No. WO 90/11092 and also in International Application No. WO 95/11307.

The nucleotide sequence constituting the vaccine composition according to the invention may be injected into the host after having been coupled to compounds which promote the penetration of this polynucleotide inside the cell or its transport up to the cell nucleus. The resulting conjugates may be encapsulated into polymeric microparticles, as described in International Application No. WO 94/27238 (Medisorb Technologies International).

According to another embodiment of the vaccine composition according to the invention, the nucleotide sequence, preferably a DNA, is complexed with the DEAE-dextran (Pagano et al., 1967) or with nuclear proteins (Kaneda et al., 1989), with lipids (Felgner et al., 1987) or encapsulated into liposomes (Fraley et al., 1980) or alternatively introduced in the form of a gel facilitating its transfection into the cells (Midoux et al., 1993, Pastore et al., 1994). The polynucleotide or the vector according to the invention may also be in suspension in a buffer solution or may be combined with liposomes.

Advantageously, such a vaccine will be prepared in accordance with the technique described by Tacson et al. or Huygen et al. in 1996 or alternatively in accordance with the technique described by Davis et al. in International Application No. WO 95/11307.

Such a vaccine may also be prepared in the form of a composition containing a vector according to the invention, placed under the control of regulatory elements allowing its expression in humans or animals. It is possible, for example, to use, as vector for the in vivo expression of the polypeptide antigen of interest, the plasmid pcDNA3 or the plasmid pcDNA1/neo, both marketed by Invitrogen® & D Systems, Abingdon, United Kingdom). It is also possible to use the plasmid V1Jns.tPA, described by Shiver et al. in 1995. Such a vaccine will advantageously comprise, in addition to the recombinant vector, a saline solution, for example a sodium chloride solution.

The immunogenic compositions of the invention can also be utilized as part of methods for immunization, wherein such methods comprise administering to a host, e.g., a human host, an immunizing amount of the immunogenic compositions of the invention. In a preferred embodiment, the method of immunizing is a method of immunizing against *Chlamydia pneumoniae*.

A pharmaceutically acceptable vehicle is understood to designate a compound or a combination of compounds entering into a pharmaceutical or vaccine composition which does not cause side effects and which makes it possible, for example, to facilitate the administration of the active compound, to increase its life and/or its efficacy in the body, to increase its solubility in solution or alternatively to enhance its preservation. These pharmaceutically acceptable vehicles are well known and will be adapted by persons skilled in the art according to the nature and the mode of administration of the active compound chosen.

As regards the vaccine formulations, these may comprise appropriate immunity adjuvants which are known to persons skilled in the art, such as, for example, aluminum hydroxide, a representative of the family of muramyl peptides such as one of the peptide derivatives of N-acetyl-muramyl, a bacterial lysate, or alternatively incomplete Freund's adjuvant, Stimulon™ QS-21 (Aquila Biopharmaceuticals, Inc., Framingham, Mass.), MPL™ (3-O-deacylated monophosphoryl lipid A; RIBI ImmunoChem Research, Inc., Hamilton, Mont.), aluminum phosphate, IL-12 (Genetics Institute, Cambridge, Mass.).

Preferably, these compounds will be administered by the systemic route, in particular by the intravenous route, by the intranasal, intramuscular, intradermal or subcutaneous route, or by the oral route. More preferably, the vaccine composition comprising polypeptides according to the invention will be administered several times, spread out over time, by the intradermal or subcutaneous route.

Their optimum modes of administration, dosages and galenic forms may be determined according to criteria which are generally taken into account in establishing a treatment adapted to a patient, such as for example the patient's age or body weight, the seriousness of his general condition, tolerance of the treatment and the side effects observed.

The invention comprises the use of a composition according to the invention for the treatment or the prevention of cardiovascular diseases, preferably linked to the presence of atheroma, which are induced or worsened by *Chlamydia pneumoniae*.

Finally, the invention comprises the use of a composition according to the invention for the treatment or the prevention of respiratory diseases which are induced or worsened by the presence of *Chlamydia pneumoniae*, preferably asthma.

Other characteristics and advantages of the invention appear in the following examples and figures:

LEGEND TO THE FIGURES

FIG. 1: Line for the production of *Chlamydia pneumoniae* sequences

Figures 2, 3A, 3B:
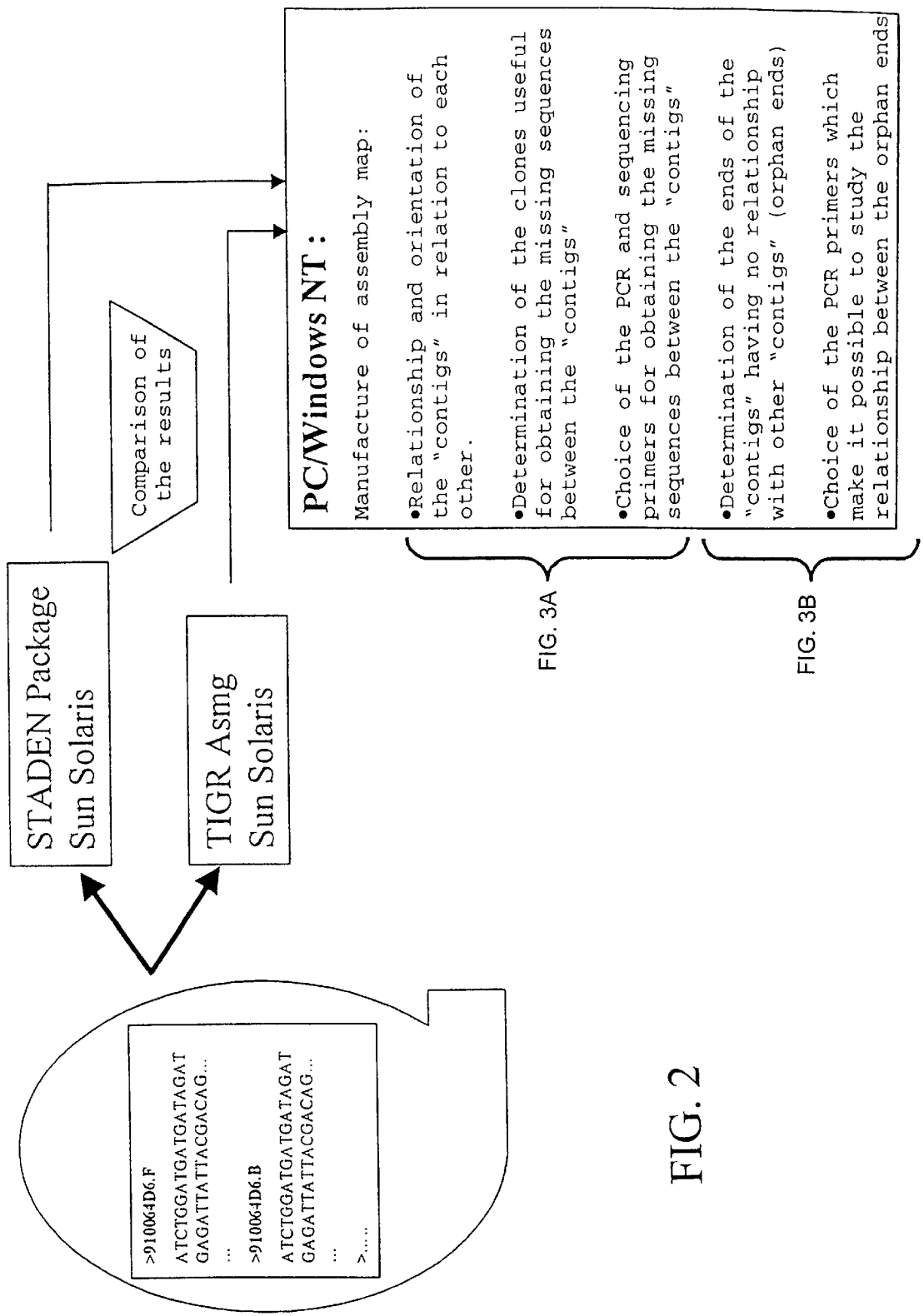

FIG. 2: Analysis of the sequences and assembling

Figure 3A:
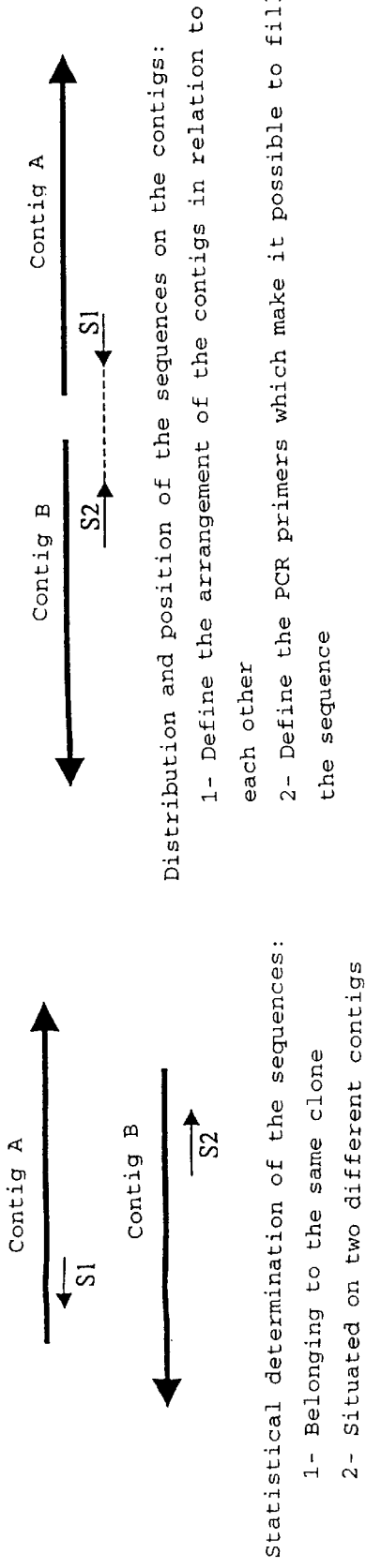
Figure 3B:
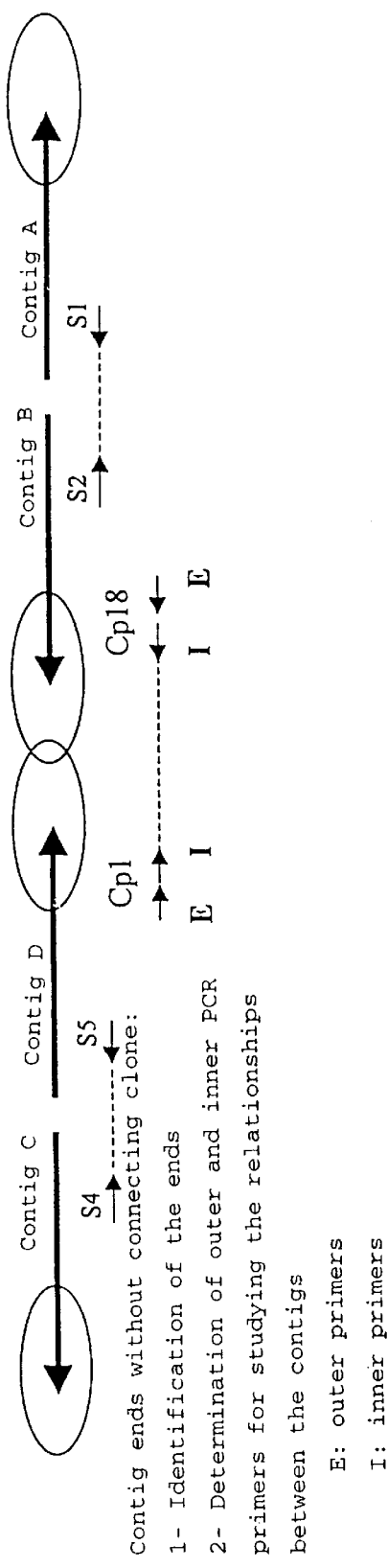

FIG. 3: Finishing techniques

FIG. 3a): Assembly map

FIG. 3b): Determination and use of the orphan ends of the contigs

EXAMPLES

Experimental Procedures

Cells

The *Chlamydia pneumoniae* strain (CM1) used by the inventors is obtained from ATCC (American Culture Type Collection) where it has the reference number ATCC 1360-VR.

It is cultured on HeLa 229 cells, obtained from the American Type Culture Collection, under the reference ATCC CCL-2.1.

Culture of the Cells

The HeLa ATCC CCL-2.1 cells are cultured in 75-ml cell culture flasks (Corning). The culture medium is Dulbecco's modified cell culture medium (Gibco BRL No. 04101965) supplemented with MEM amino acids (Gibco BRL—No. 04301140) L (5 ml per 500 ml of medium) and 5% foetal calf serum (Gibco BRL No. 10270 batch 40G8260K) without antibiotics or antifungals.

The cell culture stock is maintained in the following manner. The cell cultures are examined under an inverted microscope. 24 hours after confluence, each cellular lawn is washed with PBS (Gibco BRL No. 04114190), rinsed and then placed for 5 min in an oven in the presence of 3 ml of trypsine (Gibco BRL No. 25200056). The cellular lawn is then detached and then resuspended in 120 ml of culture medium, the whole is stirred in order to make the cellular suspension homogeneous. 30 ml of this suspension are then distributed per cell culture flask. The flasks are kept in a $CO_2$ oven (5%) for 48 hours at a temperature of 37° C. The cell stock is maintained so as to have available daily 16 flasks of subconfluent cells. It is these subconfluent cells which will be used so as to be infected with Chlamydia. 25-ml cell culture flasks are also used, these flasks are prepared in a similar manner but the volumes used for maintaining the cells are the following: 1 ml of trypsine, 28 ml of culture medium to resuspend the cells, 7 ml of culture medium are used per 25-ml flask.

Infection of the Cells with Chlamydia

Initially, the Chlamydiae are obtained frozen from ATCC (−70° C.), in suspension in a volume of 1 ml. This preparation is slowly thawed, 500 ml are collected and brought into contact with subconfluent cells, which are obtained as indicated above, in a 25-ml cell culture flask, containing 1 ml of medium, so as to cover the cells. The flask is then centrifuged at 2000 rpm in a "swing" rotor for microtitre plates, the centrifuge being maintained at a temperature of 35° C. After centrifugation, the two flasks are placed in an oven at 35° C. for three hours. 6 ml of culture medium containing cycloheximide (1 mg/ml) are then added and the flask is stored at 35° C. After 72 hours, the level of infection is evaluated by direct immunofluorescence and by the cytopathogenic effect caused to the cells.

Direct Immunofluorescence

Starting with infected cells, which were obtained as indicated above, a cellular smear is deposited with a Pasteur pipette on a microscope slide. The cellular smear is fixed with acetone for 10 minutes; after draining the acetone, the smear is covered with 30 ml of murine monoclonal antibodies directed against MOMP (major outer membrane protein) of Chlamydia (Syva, Biomérieux) labelled with fluorescein isothiocyanate. The whole is then incubated in a humid chamber at a temperature of 37° C. The slides are then rinsed with water, slightly dried, and then after depositing a drop of mounting medium, a coverslip is mounted before reading. The reading is carried out with the aid of a fluorescence microscope equipped with the required filters (excitation at 490 nm, emission at 520 nm).

Harvesting of the *Chlamydia pneumoniae*

After checking the infection by direct immunofluorescence, carried out as indicated above, the culture flasks are opened under a sterile cabinet, sterile glass beads with a diameter of the order of a millimeter are placed in the flask. The flask is closed and then vigorously stirred while being maintained horizontally, the cellular lawn at the bottom, so that the glass beads can have a mechanical action on the cellular lawn. Most of the cells are thus detached or broken; the effect of the stirring is observed under an optical microscope so as to ensure proper release of Chlamydiae.

Large-scale Infection of the Cell Cultures

The product of the Chlamydiae harvest (culture medium and cellular debris) is collected with a pipette, and distributed into three cell culture flasks containing subconfluent HeLa ATCC CCL-2.1 cells, obtained as indicated above. The cells thus inoculated are placed under gentle stirring (swing) in an oven at 35° C. After one hour, the flasks are kept horizontally in an oven so that the culture medium covers the cells for 3 hours. 30 ml of culture medium containing actydione (1 mg/ml) are then added to each of the flasks. The culture flasks are then stored at 35° C. for 72 hours. The cells thus infected are examined under an optical microscope after 24 hours, the cytopathogenic effect is evaluated by the appearance of cytoplasmic inclusions which are visible under an inverted optical microscope. After 72 hours, the vacuoles containing the Chlamydiae occupy the cytoplasm of the cell and push the cell nucleus sideways. At this stage, numerous cells are spontaneously destroyed and have left free elementary bodies in the culture medium. The Chlamydiae are harvested as described above and are either frozen at −80° C. or used for another propagation.

Purification of the Chlamydiae

The product of the Chlamydia harvests is stored at −80° C. and thawed on a water bath at room temperature. After thawing, each tube is vigorously stirred for one minute and immersed for one minute in an ultrasound tank (BRANSON 1200); the tubes are then stirred by inverting before being centrifuged for 5 min at 2000 rpm. The supernatant is carefully removed and kept at cold temperature (ice). The supernatant is vigorously stirred and then filtered on nylon filters having pores of 5 microns in diameter on a support (Nalgene) allowing a delicate vacuum to be established under the nylon filter. For each filtration, three nylon filters are superposed; these filters are replaced after every 40 ml of filtrate. Two hundred milliliters of filtration product are kept at cold temperature, and then after stirring by inverting, are centrifuged at 10,000 rpm for 90 min, the supernatant is removed and the pellet is taken up in 10 ml of 10 mM Tris, vigorously vortexed and then centrifuged at 10,000 rpm for 90 min. The supernatant is removed and the pellet is taken up in a buffer (20 mM Tris pH 8.0, 50 mM KCl, 5 mM $MgCl_2$) to which 800 units of DNAse I (Boehringer) are added. The whole is kept at 37° C. for one hour. One ml of 0.5 M EDTA is then added, the whole is vortexed and frozen at −20° C.

Preparation of the DNA

The Chlamydiae purified above are thawed and subjected to a proteinase K (Boehringer) digestion in a final volume of 10 ml. The digestion conditions are the following: 0.1 mg/ml proteinase K, 0.1×SDS at 55° C., stirring every 10 min. The product of digestion is then subjected to a double extraction with phenol-chloroform, two volumes of ethanol are added and the DNA is directly recovered with a Pasteur pipette having one end in the form of a hook. The DNA is dried on the edge of the tube and then resuspended in 500 ml of 2 mM Tris pH 7.5. The DNA is stored at 4° C. for at least 24 hours before being used for the cloning.

Cloning of the DNA

After precipitation, the DNA is quantified by measuring the optical density at 260 nm. Thirty mg of Chlamydia DNA are distributed into 10 tubes of 1.5 ml and diluted in 300 ml of water. Each of the tubes is subjected to 10 applications of ultrasound lasting for 0.5 sec in a sonicator (unisonix XL2020). The contents of the 10 tubes are then grouped and concentrated by successive extractions with butanol (Sigma B1888) in the following manner: two volumes of butanol are added to the dilute DNA mixture. After stirring, the whole is centrifuged for five minutes at 2500 rpm and the butanol is removed. This operation is repeated until the volume of the aqueous phase is less than 1 ml. The DNA is then precipitated in the presence of ethanol and of 0.5 M sodium acetate pH 5.4, and then centrifuged for thirty minutes at 15,000 rpm at cold temperature (4° C.). The pellet is washed with 75% ethanol, centrifuged for five minutes at 15,000 rpm and dried at room temperature. A tenth of the preparation is analysed on a 0.8% agarose gel. Typically, the size of the DNA fragments thus prepared is between 200 and 8000 base pairs.

To allow the cloning of the DNA obtained, the ends are repaired. The DNA is distributed in an amount of 10 mg/tube, in the following reaction medium: 100 ml final volume, 1×buffer (Biolabs 201L), 0.5 ml BSA 0.05 mg/ml, 0.1 mM DATP, 0.1 mM each of dGTP, dCTP or dTTP, 60,000 IU T4 DNA polymerase. The reaction is incubated for thirty minutes at 16° C. The contents of each of the tubes are then grouped before carrying out an extraction with phenol-chloroform and then precipitating the aqueous phase as described above. After this step, the DNA thus prepared is phosphorylated. For that, the DNA is distributed into tubes in an amount of 10 mg per tube, and then in a final volume of 50 ml, the reaction is prepared in the following manner: 1 mM ATP, 1×kinase buffer, 10 IU T4 polynucleotide kinase (Biolabs 201L). The preparation is incubated for thirty minutes at 37° C. The contents of the tubes are combined and a phenol-chloroform extraction and then a precipitation are carried out in order to precipitate the DNA. The latter is then suspended in 1 ml of water and then the DNA fragments are separated according to their size on a 0.8% agarose gel (1×TAE). The DNA is subjected to an electric field of 5 V/cm and then visualized on a UV table. The fragments whose size varies between 1200 and 2000 base pairs are selected by cutting out the gel. The gel fragment thus isolated is placed in a tube and then the DNA is purified with the Qiaex kit (20021 Qiagen), according to the procedure provided by the manufacturer.

Preparation of the Vector 14 mg of the cloning vector pGEM-5Zf (Proméga P2241) are diluted in a final volume of 150 ml and are subjected to digestion with the restriction enzyme EcoRV 300 IU (Biolabs 195S) according to the protocol and with the reagents provided by the manufacturer. The whole is placed at 37° C. for 150 min and then distributed in the wells of a 0.8% agarose gel subjected to an electric field of 5 V/cm. The linearized vector is visualized on a UV table, isolated by cutting out the gel and then purified by the Qiaex kit (Qiagen 20021) according to the manufacturer's recommendations. The purification products are grouped in a tube, the volume is measured and then half the volume of phenol is added and the whole is vigorously stirred for 1 min. Half the volume of chloroform-isoamyl alcohol 24:1 is added and vigorously stirred for 1 min. The whole is centrifuged at 15,000 rpm for 5 min at 4° C., the aqueous phase is recovered and transferred into a tube. The DNA is precipitated in the presence of 0.3 M sodium acetate, pH 5.4 and 3 volumes of ethanol and placed at −20° C. for 1 hour. The DNA is then centrifuged at 15,000 rpm for 30 min at 4° C., the supernatant is removed while preserving the pellet, washed twice with 70% ethanol. After drying at room temperature, the DNA is suspended in 25 ml of water.

Phosphorylation of the Vector 25 ml of the vector prepared in the preceding step are diluted in a final volume of 500 ml of the following reaction mixture:

After repair, the DNA is subjected to a phenol-chloroform extraction and a precipitation, the pellet is then taken up in 10 ml of water, the DNA is quantified by measuring the optical density at 260 nm. The quantified DNA is ligated into the vector PGEm-5Zf(+) prepared by the restriction enzyme EcoRV and dephosphorylated (see preparation of the vector). The ligation is carried out under three conditions which vary in the ratio between the number of vector molecules and the number of insert molecules. Typically, an equimolar ratio, a ratio of 1:3 and a ratio of 3:1 are used for the ligations which are, moreover, carried out under the following conditions: vector PGEm-5Zf(+) 25 ng, cut DNA, ligation buffer in a final volume of 20 ml with T4 DNA ligase (Amersham E70042X); the whole is then placed in a refrigerator overnight and then a phenol-chloroform extraction and a precipitation are carried out in a conventional manner. The pellet is taken up in 5 ml of water.

Transformation of the Bacteria

Plating of the Bacteria

Petri dishes containing LB Agar medium containing ampicillin (50 mg/ml), Xgal (280 mg/ml) [5-bromo-4-chloro-indolyl-beta-D-galactopyranoside (Sigma B-4252)], IPTG (140 mg/ml) [isopropyl-beta-D-thiogalactoside (Sigma I-6758)] are used, 50 and 100 ml of bacteria are plated for each of the ligations. The Petri dishes are placed upside down at 37° C. for 15 to 16 hours in an oven. The number of "recombinant" positive clones is evaluated by counting the white colonies and the blue colonies which are thought to contain the vector alone.

Evaluation of the "recombinant" positive clones

Ninety-four white colonies and two blue colonies are collected with the aid of sterile cones and are deposited at the bottom of the wells of plates designed for carrying out the amplification techniques. 30 ml of the following reaction mixture are added to each well: 1.7 mM $MgCl_2$, 0.2 mM each of dTP, dCTP, dGTP and dTTP, two synthetic oligonucleotides corresponding to sequences flanking the cloning site on either side and orienting the synthesis of the DNA in a convergent manner (0.5 mM RP and PU primers, 1 U TAQ polymerase (GibcoBRL 18038–026)).

The colonies thus prepared are subjected to a temperature of 94° C. for 5 min and then to 30 thermal cycles composed of the following steps: 94° C. for 40 s, 50° C. for 30 s, 72° C. for 180 s. The reaction is then kept for 7 min at 72° C. and then kept at 4° C.

The amplification products are deposited on an agarose gel (0.8%), stained with ethidium bromide, subjected to electrophoresis, and then analysed on an ultraviolet table. The presence of an amplification fragment having a size greater than 500 base pairs indicates the presence of an insert. The bacterial clones are then prepared so as to study the sequence of their insert.

Sequencing

To sequence the inserts of the clones obtained as above, these were amplified by PCR on bacteria cultures carried out overnight using the primers for the vectors flanking the inserts. The sequence of the ends of these inserts (on average 500 bases on each side) was determined by automated fluorescent sequencing on an ABI 377 sequencer, equipped with the ABI Prism DNA Sequencing Analysis software (version 2.1.2).

Analysis of the Sequences

The sequences obtained by sequencing in a high-yield line (FIG. 1) are stored in a database; this part of the production is independent of any treatment of the sequences. The sequences are extracted from the database, avoiding all the regions of inadequate quality, that is to say the regions for which uncertainties are observed on the sequence at more than 95%. After extraction, the sequences are introduced into a processing line, the diagram of which is described in FIG. 2. In a first path of this processing line, the sequences are assembled by the Gap4 software from R. Staden (Bonfield et al., 1995) (OS UNIX/SUN Solaris); the results obtained by this software are kept in the form of two files which will be used for a subsequent processing. The first of these files provides information on the sequence of each of the contigs obtained. The second file represents all the clones participating in the composition of all the contigs as well as their positions on the respective contigs.

The second processing path uses a sequence assembler (TIGR-Asmg assembler UNIX/SUN Solaris); the results of this second processing path are kept in the form of a file in the TIGR-Asmg format which provides information on the relationship existing between the sequences selected for the assembly. This assembler is sometimes incapable of linking contigs whose ends overlap over several hundreds of base pairs.

The results obtained from these two assemblers are compared with the aid of the BLAST program, each of the contigs derived from one assembly path being compared with the contigs derived from the other path.

For the two processing paths, the strict assembly parameters are fixed (95% homology, 30 superposition nucleotides). These parameters avoid 3 to 5% of the clones derived from eukaryotic cells being confused with sequences obtained from the clones derived from *Chlamydia pneumoniae*. The eukaryotic sequences are however preserved during the course of this project; the strategy introduced, which is described below, will be designed, inter alia, not to be impeded by these sequences derived from contaminating clones.

The results of these two assemblers are processed in a software developed for this project. This software operates on a Windows NT platform and receives, as data, the results derived from the STADEN software and/or the results derived from the TIGR-Asmg assembler, the software, results, after processing of the data, in the determination of an assembly map which gives the proximity relationship and the orientation of the contigs in relation to one another (FIG. 3a). Using this assembly map, the software determines all the primers necessary for finishing the project. This treatment, which will be detailed below, has the advantage of distinguishing the isolated sequences derived from the contaminations, by the DNA eukaryotic cells, of the small-sized sequences clearly integrated into the project by the relationships which they establish with contigs. In order to allow, without any risk of error, the arrangement and the orientation of the contigs in relation to one another, a statistical evaluation of the accuracy of the names (naming)

"naming" of sequence is made from the results of "contigation". This evaluation makes it possible to give each of the clone plates, as well as each of the subsets of plates, a weight which is inversely proportional to probable error rate existing in the "naming" of the sequences obtained from this plate or from a subset of this plate. In spite of a low error rate, errors may occur throughout the steps of production of the clones and of the sequences. These steps are numerous, repetitive and although most of them are automated, others, like the deposition in the sequencers, are manual; it is then possible for the operator to make mistakes such as the inversion of two sequences. This type of error has a repercussion on the subsequent processing of the data, by resulting in relationships (between the contigs) which do not exist in reality, then in attempts at directed sequencing between the contigs which will end in failure. It is because of this that the evaluation of the naming errors is of particular importance since it allows the establishment of a probabilistic assembly map from which it becomes possible to determine all the clones which will serve as template to obtain sequences separating two adjacent contigs. Table 2 of parent U.S. application serial No. 60/107078 filed Nov. 4, 1998 and French application 97–14673 filed Nov. 21, 1997, each of which is incorporated by reference herein in its entirety, gives the clones and the sequences of the primers initially used during the initial operations.

To avoid the step which consists in ordering and then preparing the clones by conventional microbiological means, outer and inner primers oriented towards the regions not yet sequenced are defined by the software. The primers thus determined make it possible to prepare, by PCR, a template covering the nonsequenced region. It is the so-called outer primers (the ones most distant from the region to be sequenced) which are used to prepare this template. The template is then purified and a sequence is obtained on each of the two strands during 2 sequencing reactions which each use one of the 2 inner primers. In order to facilitate the use of this approach, the two outer primers and the two inner primers are prepared and then stored on the same position of 4 different 96-well plates. The two plates containing the outer primers are used to perform the PCRs which will serve to prepare the templates. These templates will be purified on purification columns preserving the topography of the plates. Each of the sequences will be obtained using primers situated on one and then on the other of the plates containing the inner primers. This distribution allows a very extensive automation of the process and results in a method which is simple to use for finishing the regions not yet sequenced. Table 3 of parent U.S. application serial No. 60/107078 filed Nov. 4, 1998 and French application 97–14673 filed Nov. 21, 1997, each of which is incorporated by reference herein in its entirety, gives the names and the sequences of the primers used for finishing *Chlamydia pneumoniae*.

Finally, a number of contigs exist in a configuration where one of their ends is not linked to any other contig end (FIG. 3b) by a connecting clone relationship (a connecting clone is defined as a clone having one sequence end on a contig and the other end of its sequence on another contig; furthermore, this clone must be derived from a plate or a subset of plates with adequate naming quality). For the *Chlamydia pneumoniae* project, this particular case occurred 24 times. Two adjacent PCR primers orienting the synthesis of the DNA towards the end of the consensus sequence are defined for each of the orphan ends of the consensus sequence. The primer which is closest to the end of the sequence is called the inner primer whereas the primer which is more distant from the end of the sequence is called the outer primer. The outer primers are used to explore the mutual relationship between the orphan ends of the different contigs. The presence of a single PCR product and the possibility of amplifying this product unambiguously using the inner primers evokes the probable relationship between the contigs on which the primers which allowed the amplification are situated. This relationship will be confirmed by sequencing and will allow the connection between the orphan ends of the consensus sequences. This strategy has made it possible to obtain a complete map of the *Chlamydia pneumoniae* chromosome and then to finish the project.

Quality control

All the bases not determined with certainty in the chromosomal sequence were noted and the density of uncertainties was measured on the entire chromosome. The regions with a high density of uncertainties were noted and the PCR primers spanning these regions were drawn and are represented in Table 4 of parent U.S. application serial No. 60/107078 filed Nov. 4, 1998 and French application 97-14673 filed Nov. 21, 1997 each of which is incorporated by reference herein in its entirety.

The sequence of each of the PCR products was obtained with two operational primers different from the amplification primers. The sequences were obtained in both directions for all the PCRs (100% success).

Data banks

Local reorganizations of major public banks were used. The protein bank used consists of the nonredundant fusion of the Genpept bank (automated translation of GenBank, NCBI; Benson et al., 1996).

The entire BLAST software (public domain, Altschul et al., 1990) for searching for homologies between a sequence and protein or nucleic data banks was used. The significance levels used depend on the length and the complexity of the region tested as well as the size of the reference bank. They were adjusted and adapted to each analysis.

The results of the search for homologies between a sequence according to the invention and protein or nucleic data banks are presented and summarized in Table 1 below.

Table 1: List of Coding Chromosome Regions and Homologies Between These Regions and the Sequence Banks Legend to Table 1: Open reading frames are identified with the GenMark software version 2.3A (GenePro), the template used is *Chlamydia pneumoniae* of order 4 on a length of 196 nucleotides with a window of 12 nucleotides and a minimum signal of 0.5. The reading frames ORF2 to ORF 1137 are numbered in order of appearance on the chromosome, starting with ORF2 (ORF column). The positions of the beginning and of the end are then given in column 2 (position). When the position of the beginning is greater than the position of the end, this means that the region is encoded by the strand complementary to the sequence which was given in the sequence SEQ ID No. 1.

All the putative products were subjected to a search for homology on GENPEPT (release 102 for SEQ ID No. 2 to SEQ ID No. 1137, and release 108 for SEQ ID No. 1138 to SEQ ID No. 1291 and SEQ ID No. 6844 to SEQ ID No. 6849) with the BLASTP software (Altschul et al. 1990). With, as parameters, the default parameters with the exception of the expected value E set at $10^{-5}$ (for SEQ ID No. 2 to SEQ ID No. 1137) and P value set at $e^{-10}$ (for SEQ ID No. 1138 to SEQ ID No. 1291 and SEQ ID No. 6844 to SEQ ID No. 6849). Subsequently, only the identities greater than 30% (I% column) were taken into account. The description of the most homologous sequence is given in the Homology column; the identifier for the latter sequence is given in the ID column and the animal species to which this sequence belongs is given in the Species column. The Homology score is evaluated by the sum of the blast scores for each region of homology and reported in the Score column.

Materials and Methods for transmembrane domains:

The DAS software was used as recommended by the authors (Cserzo et al., 1997).

This method uses, to predict the transmembrane domains, templates derived from a sampling of selected proteins. All the regions for which a "Cutoff" greater than 1.5 was found by the program were taken into account.

Additional ORF Finder Programs

For this analysis, two additional ORF finder programs were used to predict potential open reading frames of a minimum length of 74 amino acids; Glimmer (Salzberg, S. L., Delcher, A., Kasif, S., and W. White. 1998. Microbial gene identification using interpolated Markov models. Nucleic Acids Res. 26:544–548.), and an in-house written program. The in-house program used a very simple search algorithm. The analysis required the that the genomic DNA sequence text be in the 5' to 3' direction, the genome is circular, and that TAA, TAG, and TGA are stop codons. The search parameters were as follows:

(1) A search for an ORF that started with a GTG codon was performed. If no GTG codons were found, then a search for an ATG codon was performed. However, if a GTG codon was found, then a search downstream for a ATG codon was performed. All start and stop nucleotide positions were recorded.

(2) A search for an ORF that started with a TTG codon was performed. If no TTG codons were found, then a search for a ATG codon was performed. However, if a TTG codon was found, then a search downstream for a ATG codon was performed. All start and stop nucleotide positions were recorded.

(3) The analysis described in steps 1 and 2 were repeated for the opposite strand of DNA sequence.

(4) A search for ORFs that determined all ORF lengths using start and stop positions in the same reading frames was performed.

(5) All ORFs whose DNA length was less than 225 nucleotides were eliminated from the search.

Surface Exposed Protein Search Criteria

Potential cell surface vaccine targets are outer membrane proteins such as porins, lipoproteins, adhesions and other non-integral proteins. In *Chlamydia psittaci,* the major immunogens is a group of putative outer membrane proteins (POMPs) and no homologs have been found in *Chlamydia pneumoniae* and *Chlamydia trachomatis* by traditional analysis (Longbottom, D., Russell, M., Dunbar, S. M., Jones, G. E., and A. J. Herring. 1998. Molecular Cloning and Characterization of the Genes Coding for the Highly Immunogenic Cluster of 90-Kilodalton Envelope Proteins from *Chlamydia psittaci* Subtype That Causes Abortion in Sheep. Infect Immun 66:1317–1324.) Several putative outer membrane proteins have been identified in *Chlamydia pneumoniae,* all of which may represent vaccine candidates. The major outer membrane protein (MOMP) gene (omp1) has been found in various isolates of *Chlamydia pneumoniae* (Jantos, Calif., Heck, S., Roggendorf, R., Sen-Gupta, M., and Hegemann, J H. 1997. Antigenic and molecular analyses of different chlamydia pneumoniae strains. J. Clin Microbiology 35(3):620–623.) Various criteria, as listed below, were used to identify putative surface exposed ORFs from the genomic DNA sequence of *Chlamydia pneumoniae* (French application 97-14673 filed Nov. 21, 1997). Any ORF which met any one or more of the individual criteria were listed in this category.

Protein homology searches were done using the Blastp 2.0 tool (Altschul, S. F., Madden, T. L., Schaffer, A. A., Zhang, J., Zhang, Z., Miller, W., and D. J. Lipman. 1997. Gapped BLAST and PSI-BLAST: a new generation of protein database search programs. Nucleic Acids Res. 25:3389–3402.)

An ORF product was labeled surface exposed if there was homology to a known, or hypothetical, or putative surface exposed protein with a P score better than $e^{-10}$.

Most, if not all, proteins that are localized to the membrane of bacteria, via a secretory pathway, contain a signal peptide. A software program, SignalP, analyzes the amino acid sequence of an ORF for such a signal peptide (Nielsen, H., Engelbrecht. J., Brunak, S., and G. von Heijne. 1997. Identification of prokaryotic and eukaryotic signal peptides and prediction of their cleavage sites. Protein Engineering 10:1–6.) The first 60 N-terminal amino acids of each ORF were analyzed by SignalP using the Gram-Negative software database. The output generates four separate values, maximum C, maximum Y, maximum S, and mean S. The S-score, or signal region, is the probability of the position belonging to the signal peptide. The C-score, or cleavage site, is the probability of the position being the first in the mature protein. The Y-score is the geometric average of the C-score and a smoothed derivative of the S-score. A conclusion of either a Yes or No is given next to each score. If all four conclusions are Yes and the C-terminal amino acid is either a phenylalanine (F) or a tyrosine (Y), the ORF product was labelled outer membrane (Struyve, M., Moons, M., and J. Tommassen. 1991. Carboxy-terminal Phenylalanine is Essential for the Correct Assembly of a Bacterial Outer Membrane Protein. J. Mol. Biol. 218:141–148.)

The program called Psort, determines the localization of a protein based on its signal sequence, recognition of transmembrane segments, and analysis of its amino acid composition (Nakai, K., and M. Kanehisa. 1991. Expert system for predicting protein localization sites in gram-negative bacteria. Proteins 11:95–110.) An ORF product is considered to be an outer membrane protein if the output data predicts the protein as outer membrane with a certainty value of 0.5 or better and whose value is at least twice as large as the next predicted localized certainty value.

Finally, ORF products that were not predicted to be outer membrane or surface exposed, based on the above criteria, were further analyzed. The blastp output data for these ORFs were searched using various general and specific keywords, suggestive of known cell surface exposed proteins. An ORF was labeled surface exposed if the keywords matched had a Blastp hit, had a P score better than $e^{-10}$, and that there was no better data indicating otherwise. The following is a list of the searched keywords:

| Adhesion | Adhesin | Invasion | Invasion Outer | | |
|---|---|---|---|---|---|
| Omp | Outer Surface | Porin | Membrane | Extensin | |
| Cell Surface | Cell Wall | Pilus | Pilin | Flagellar sheath | |
| BtuB | | | | | |
| Cir | ChuA | CopB | ExeD | FadL | FecA |
| FepA | FhuA | FmdC | FomA | FrpB | GspD |
| HemR | HgbA | Hgp | HmbR | HmuR | HMW |
| HrcC | Hrp | InvG | LamB | LbpA | LcrQ |
| Lmpl | MxiD | MOMP | PilE | HpaA | NolW |
| NspA | OpcP | OpnP | Opr | OspA | PhoE |
| PldA | Por | PscC | Pu1D | PupA | QuiX |

-continued

| Adhesion Omp Cell Surface | Adhesin Outer Surface Cell Wall | Invasion Porin Pilus | Invasion Outer Membrane Pilin | Extensin Flagellar sheath | |
|---|---|---|---|---|---|
| RafY Tbpl | ScrY Yop | SepC YscC | ShuA mip | SomA Tol | SpiA |

Those ORFs that did not meet the minimum requirement for being an outer membrane protein based on the above search criteria but which were homologous to identified outer membrane ORFs in *Chlamydia trachomatis* were included. The *Chlamydia trachomatis* genome (French patent applications FR97-15041, filed Nov. 28, 1997 and FR97-16034 filed Dec. 17, 1997) was analyzed using the above search criteria and a number of outer membrane ORFs were identified. These *Chlamydia trachomatis* ORFs were then tested against the *Chlamydia pneumoniae* genome using Blastp. Any *Chlamydia pneumoniae* ORF with a Blastp P value better than $e^{-10}$ against a *Chlamydia trachomatis* outer membrane was included in this section, if there was no better data indicating otherwise. A list of ORFs in the *Chlamydia pneumoniae* genome encoding putative surface exposed proteins is set forth above in the specification.

Identification of Putative Lipoproteins in the Genome of *Chlamydia pneumoniae*

Lipoproteins are the most abundant post-translationally modified bacterial secretory proteins (Pugsley, A. P. 1993. The complete general secretory pathway in Gram-negative bacteria. Microbiol. Rev. 57:50–108). The characteristic features of lipoproteins are a thiol-linked diacylglyceride and an amine-linked monoacyl group on the cysteine that becomes the amino-terminal residue after signal peptide cleavage by Signal Peptidase II. (Pugsley, A. P. 1993. The complete general secretory pathway in Gram-negative bacteria. Microbiol. Rev. 57:50–108). The identification of putative lipoproteins from the genomic sequencing of *Chlamydia pneumoniae* was done by examining the deduced amino acid sequence of identified ORFs for the presence of a signal peptide with a Signal Peptidase II cleavage site analogous to the consensus sequence for prolipoprotein modification and processing reactions (Hayashi, S., and H. C. Wu. 1992. Identification and characterization of lipid-modified proteins in bacteria, p. 261–285. In N. M. Hooper and A. J. Turner (ed.) Lipid modification of proteins: A practical approach. Oxford University Press, New York; Sutcliffe, I. C. and R. R. B. Russell. 1995. Lipoproteins of Gram-positive bacteria. J. Bacteriol. 177:1123–1128.).

*Chlamydia pneumoniae* ORFs were initially screened for the most basic of lipoprotein characteristics, a cysteine in the first 30 amino acids of the deduced protein. ORFs with a standard start codon (ATG, GTG, or TTG) and having one or more of the following characteristics were selected for direct analysis of their first 30 amino acids:

(a) Significant Signal P value (at least two out of the four values are Yes)

(b) PSORT value indicating membrane passage (IM-inner membrane, Peri-periplasm, or OM-outer membrane)

(c) Identification of the word lipoprotein among the ORF blastp data set.

(d) A Blastp value of $<e^{-10}$ with a putative lipoprotein from *Chlamydia trachomatis* (French applications 97-15041 filed Nov. 28, 1997 and FR-97-16034 filed Dec. 17, 1997).

The first 30 amino acids of each ORF in this set were analyzed for the characteristics commonly found in lipoprotein signal peptides (Pugsley, A. P. 1993. The complete general secretory pathway in Gram-negative bacteria. Microbiol. Rev. 57:50–108; Hayashi, S., and H. C. Wu. 1992. Identification and characterization of lipid-modified proteins in bacteria, p. 261–285. In N. M. Hooper and A. J. Turner (ed.) Lipid modification of proteins: A practical approach. Oxford University Press, New York; Sutcliffe, I. C. and R. R. B. Russell. 1995. Lipoproteins of Gram-positive bacteria. J. Bacteriol. 177:1123–1128.) Putative lipoprotein signal peptides were required to have a cysteine between amino acid 10 and 30 and reach a minimum score of three based on the following criteria for lipoprotein signal peptides:

(a) Identification of specific amino acids in specific positions around the cysteine which are part of the consensus Signal Peptidase II cleavage site (Hayashi, S., and H. C. Wu. 1992. Identification and characterization of lipid-modified proteins in bacteria, p. 261–285. In N. M. Hooper and A. J. Turner (ed.) Lipid modification of proteins: A practical approach. Oxford University Press, New York); Sutcliffe, I. C. and R. R. B. Russell. 1995. Lipoproteins of Gram-positive bacteria. J. Bacteriol. 177:1123–1128). Since the identification of the cleavage site is the most important factor in identifying putative lipoproteins, each correctly positioned amino acid contributed toward reaching the minimum score of three.

(b) A hydrophobic region rich in alanine and leucine prior to the cleavage site (Pugsley, A. P. 1993. The complete general secretory pathway in Gram-negative bacteria. Microbiol. Rev. 57:50–108) contributed toward reaching the minimum score of three.

(c) A short stretch of hydrophilic amino acids greater than or equal to 1 usually lysine or arginine following the N-terminal methionine (Pugsley, A. P. 1993. The complete general secretory pathway in Gram-negative bacteria. Microbiol. Rev. 57:50–108) contributed toward reaching the minimum score of three.

A list of ORFs in the *Chlamydia pneumoniae* genome encoding putative lipoproteins is set forth above in the specification.

LPS-Related ORFs of *Chlamydia pneumoniae*

Lipopolysaccharide (LPS) is an important major surface antigen of Chlamydia cells. Monoclonal antibodies (Mab) directed against LPS of *Chlamydia pneumoniae* have been identified that can neutralize the infectivity of *Chlamydia pneumoniae* both in vitro and in vivo (Peterson, E. M., de la Maza, L. M., Brade, L., Brade, H. 1998. Characterization of a Neutralizing Monoclonal Antibody Directed at the Lipopolysaccharide of *Chlamydia pneumonia*. Infect. Immun. August 66(8):3848–3855.) Chlamydial LPS is composed of lipid A and a core oligosaccharide portion and is phenotypically of the rough type (R-LPS) (Lukacova, M., Baumann, M., Brade, L., Mamat, U., Brade, H. 1994. Lipopolysaccharide Smooth-Rough Phase Variation in Bacteria of the Genus Chlamydia. Infect. Immun. June 62(6):2270–2276.) The lipid A component is composed of fatty acids which serve to anchor LPS in the outer membrane. The core component contains sugars and sugar derivatives such as a trisaccharide of 3-deoxy-D-manno-octulosonic acid (KDO) (Reeves, P. R., Hobbs, M., Valvano, M. A., Skurnik, M., Whitfield, C., Coplin, D., Kido, N., Klena, J., Maskell, D., Raetz, C. R. H., Rick, P. D. 1996. *Bacterial Polysaccharide Synthesis and Gene Nomenclature* pp. 10071–10078, Elsevier Science Ltd.). The KDO gene product is a multifunctional glycosyltransferase and represents a shared epitope among the Chlamydia. For a review of LPS biosynthesis see, e.g., Schnaitman, C. A., Klena, J. D. 1993. Genetics of Lipopolysaccharide Biosynthesis in Enteric Bacteria. Microbiol. Rev. 57:655–682.

A text search of the ORF blastp results identified several genes that are involved in Chlamydial LPS production with a P score better than $e^{-10}$. The following key-terms were used in the text search: KDO, CPS (Capsular Polysaccharide Biosynthesis), capsule, LPS, rfa, rfb, rfc, rfe, rha, rhl, core, epimerase, isomerase, transferase, pyrophosphorylase, phosphatase, aldolase, heptose, manno, glucose, lpxB, fibronectin, fibrinogen, fucosyltransferase, lic, lgt, pgm, tolC, rol, ChoP, phosphorylcholine, waaF, PGL-Tb1. A list of ORFs in the *Chlamydia pneumoniae* genome encoding putative polypeptides involved in LPS biosynthesis is set forth above in the specification.

Type III And Other Secreted Products

Type III secretion enables gram-negative bacteria to secrete and inject pathogenicity proteins into the cytosol of eukaryotic host cells (Hueck, C. J., 1998. Type III Protein Secretion Systems in Bacterial Pathogens of Animals and Plants. In Microbiology and Molecular Biology Reviews. 62:379–433.) These secreted factors often resemble eukaryotic signal transduction factors, thus enabling the bacterium to redirect host cell functions (Lee, C. A., 1997. Type III secretion systems: machines to deliver bacterial proteins into eukaryotic cells? Trends Microbiol. 5:148–156.) In an attempt to corrupt normal cellular functions, Chlamydial pathogenicity factors injected into the host cytosol will nonetheless, as cytoplasmic constituents be processed and presented in the context of the Major Histocompatibility Complex (MHC class I). As such, these pathogenicity proteins represent MHC class I antigens and will play an important role in cellular immunity. Also included in this set are secreted non-type III products that may play a role as vaccine components.

A text search of the ORF blastp results identified genes that are involved in *Chlamydia pneumoniae* protein secretion with a P score better than $e^{-10}$. The following key-terms were used in the text search in an effort to identify surface localized or secreted products: Yop, Lcr, Ypk, Exo, Pcr, Pop, Ipa, Vir, Ssp, Spt, Esp, Tir, Hrp, Mxi, hemolysin, toxin, IgA protease, cytolysin, tox, hap, secreted and Mip.

*Chlamydia pneumoniae* ORFs that did not meet the above keyword search criteria, but have homologs in *Chlamydia trachomatis* that do meet the search criteria are included herein. The *Chlamydia trachomatis* genome (French patent applications FR97-15041, filed Nov. 28, 1997 and 97-16034 filed Dec. 17, 1997) was analyzed using the above search criteria and a number of ORFs were identified. These *Chlamydia trachomatis* ORFs were tested against the *Chlamydia pneumoniae* genome using Blastp. Any *Chlamydia pneumoniae* ORF with a Blastp P value $<e^{-10}$ against a *Chlamydia trachomatis* homolog, identified using the above search criteria, was included. A list of ORFs in the *Chlamydia pneumoniae* genome encoding putative secreted proteins is in the specification.

*Chlamydia pneumoniae:* RGD Recognition Sequence

Proteins that contain Arg-Gly-Asp (RGD) attachment site, together with integrins that serve as their receptor constitute a major recognition system for cell adhesion. The RGD sequence is the cell attachment site of a large number of adhesive extracellular matrix, blood, and cell surface proteins and nearly half of the known integrins recognize this sequence in their adhesion protein ligands. There are many RGD containing microbial proteins such as the penton protein of adenovirus, the coxsackie virus, the foot and mouth virus and pertactin, a 69 kDa (kilodalton) surface protein of *Bordetella pertussis,* that serve as ligands through which these microbes bind to integrins on the cell surfaces and gain entry into the cell. The following provides evidence supporting the importance of RGD in microbial adhesion:

a) The adenovirus penton base protein has a cell rounding activity and when penton base was expressed in *E. coli,* it caused cell rounding and cells adhered to polystyrene wells coated with the protein. Mutant analysis showed that both these properties required an RGD sequence. Virus mutants with amino acid substitutions in the RGD sequence, showed much less adherence to HeLa S3 cells, and also were delayed in virus reproduction (Bai, M., Harfe, B., and Freimuth, P. 1993. Mutations That Alter an RGD Sequence in the Adenovirus Type 2 Penton Base Protein Abolish Its Cell-Rounding Activity and Delay Virus Reproduction in Flat Cells. J. Virol. 67:5198–5205).

b) It has been shown that attachment and entry of coxsackie virus A9 to GMK cells were dependent on an RGD motif in the capsid protein VP1. VP1 has also been shown to bind $a_v b_3$ integrin, which is a vitronectin receptor (Roivainen, M., Piirainen, L., Hovi, T., Virtanen, I., Riikonen, T., Heino, J., and Hyypia, T. 1994. Entry of Coxsackievirus A9 into Host Cells: Specific Interactions with $a_v b_3$ Integrin, the Vitronectin Receptor Virology, 203:357–65).

c) During the course of whooping cough, *Bordetella pertussis* interacts with alveolar macrophages and other leukocytes on the respiratory epithelium. Whole bacteria adheres by means of two proteins, filamentous hemagglutinin (FHA) and pertussis toxin. FHA interacts with two classes of molecules on macrophages, galactose containing glycoconjugates and the integrin CR3. The interaction between CR3 and FHA involves recognition of RGD sequence at the positions 1097–1099 in FHA (Relman, D., Tuomanen, E., Falkow, S., Golenbock, D. T., Saukkonen, K., and Wright, S. D. "Recognitition of a Bacterial Adhesin by an Integrin: Macrophage CR3 Binds Filamentous Hemagglutinin of Bordetella Pertussis." Cell, 61:1375–1382 (1990)).

d) Pertactin, a 69 kDa outer membrane protein of *Bordetella pertussis,* has been shown to promote attachment of Chinese hamster ovary cells (CHO). This attachment is mediated by recognition of RGD sequence in pertactin by integrins on CHO cells and can be inhibited by synthetic RGD containing peptide homologous to the one present in pertactin (Leininger, E., Roberts, M., Kenimer, J. G., Charles, I. G., Fairweather, N., Novotny, P., and Brennan, M. J. 1991. Pertactin, an Arg-Gly-Asp containing *Bordetella pertussis* surface protein that promotes adherence of mammalian cells Proc. Natl. Acad. Sci. USA, 88:345–349).

e) The RGD sequence is highly conserved in the VP1 protein of foot and mouth disease virus (FMDV). Attachment of FMDV to baby hamster kidney cells (BHK) has been shown to be mediated by VP1 protein via the RGD sequence. Antibodies against the RGD sequence of VP1 blocked attachment of virus to BHK cells (Fox, G., Parry, N. R., Barnett, P. V., McGinn, B., Rowland, D. J., and Brown, F. 1989. The Cell Attachment Site on Foot-and-Mouth Disease Virus Includes the Amino Acid Sequence RGD (Arginine-Glycine-Aspartic Acid) J. Gen. Virol., 70:625–637).

It has been demonstrated that bacterial adherence can be based on interaction of a bacterial adhesin RGD sequence with an integrin and that bacterial adhesins can have multiple binding site characteristic of eukaryotic extracellular matrix proteins. RGD recognition is one of the important mechanisms used by microbes to gain entry into eukaryotic cells.

The complete deduced protein sequence of the *Chlamydia pneumoniae* genome was searched for the presence of RGD sequence. There were a total of 54 ORFs that had one or more RGD sequences. Not all RGD containing proteins mediate cell attachment. It has been shown that RGD containing peptides that have proline immediately following the RGD sequence are inactive in cell attachment assays (Pierschbacher & Ruoslahti. 1987. Influence of stereochemistry of the sequence Arg-Gly-Asp-Xaa on binding specificity in cell adhesion. J. Biol. Chem. 262:17294–98). ORFs that had RGD, with proline as the amino acid following the RGD sequence were excluded from the list. Also, RGD sequence may not be available at the surface of the protein or may be present in a context that is not compatible with integrin binding. Since not all RGD-containing proteins are involved in cell attachment, several other criteria were used to refine the list of RGD-containing proteins. A list of ORFs in the *Chlamydia pneumoniae* genome encoding polypeptides with RGD recognition sequence(s) is in the specification.

Non-*Chlamydia trachomatis* ORFs

*Chlamydia pneumoniae* ORFs were compared to the ORFs in the *Chlamydia trachomatis* genome (French patent applications FR97-15041, filed Nov. 28, 1997 and 97-16034 filed Dec. 17, 1997) using Blastp. Any *Chlamydia pneumoniae* ORF with a Blastp P value worse than $e^{-10}$ (i.e. $>e^{-10}$) against *Chlamydia trachomatis* ORFs are included in this section. A list of ORFs in the *Chlamydia pneumoniae* genome which are not found in *Chlamydia trachomatis* is set forth above in the specification.

Cell Wall Anchor Surface ORFs

Many surface proteins are anchored to the cell wall of Gram-positive bacteria via the conserved LPXTG motif (Schneewind, O., Fowler, A., and Faull, K. F. 1995. Structure of the Cell Wall Anchor of Surface Proteins in *Staphylococcus aureus*. Science 268:103–106). A search of the *Chlamydia pneumoniae* ORFs was done using the motif LPXTG. A list of ORFs in the *Chlamydia pneumoniae* genome encoding polypeptides anchored to the cell wall is in the specification.

ATCC Deposits

Samples of *Chlamydia pneumoniae* were deposited with the American Type Culture Collection (ATCC), Rockville, Md., on Nov. 19, 1998, and assigned the accession number VR-2634. Cells can be grown, harvested and purified, and DNA can be prepared as discussed above. In order to enable recovery of specific fragments of the chromosome, one can run targeted PCR reactions, whose amplification products can then be sequenced and/or cloned into any suitable vector, according to standard procedures known to those skilled in the art.

In addition, a sample of three pools of clones covering chromosomal regions of interest were deposited with the American Type Culture Collection (ATCC), Rockville, Md., on Nov. 19, 1998, and assigned the indicated accession numbers: 207000, 207001, and 207002. Each pool of clones contains a series of clones. When taken together, the three pools in the sample cover a portion of the chromosome, with a redundancy of slightly more than two. The total number of clones in the sample is 196.

The clones cover the following three regions of interest:

(i) position 30,000 to 40,000 of SEQ ID No. 1, referred to as region A;

(ii) position 501,500 to 557,000 of SEQ ID No. 1, referred to as region B; and (iii) position 815,000 to 830,000 of SEQ ID No. 1, referred to as region C.

Table 4 lists groups of oligonucleotides to be used to amplify each of ORFs 2–1291 according to standard procedures known to those skilled in the art. Such oligonucleotides are listed as SEQ ID Nos. 1292 to 6451. For each ORF, the following is listed: one forward primer positioned 2,000 bp upstream of the beginning of the ORF; one forward primer positioned 200 bp upstream of the beginning of the ORF; one reverse primer positioned 2,000 bp downstream at the end of ORF, which is 2,000 bp upstream of the end site of the ORF on the complementary strand; and one reverse primer 200 bp downstream at the end of ORF, which is 200 bp upstream of the end site of the ORF on the complementary strand. The corresponding SEQ ID Nos. for the primers are listed in Table 4, where Fp is the proximal forward primer; Fd is the distal forward primer; Bp is the proximal reverse primer; and Bd is the distal reverse primer. The positions of the 5' ends of each of these primers on the nucleotide sequence of SEQ ID No. 1 are shown in Table 5 (F refers to forward primers; R refers to reverse primers).

Table 6 lists oligonucleotides (SEQ ID Nos. 6452–6843) to be used to amplify the inserts of each of the 196 clones present in the pooled sample according to standard procedures well known to those of skill in the art. These primers can also be utilized to amplify the chromosomal region corresponding to the region A, B or C within which the particular insert lies. Their positions are indicated in Table 7 (F refers to forward primers; R refers to reverse primary).

The present invention is not to be limited in scope by the specific embodiments described herein, which are intended as single illustrations of individual aspects of the invention, and functionally equivalent methods and components are within the scope of the invention. Indeed, various modifications of the invention, in addition to those shown and described herein will become apparent to those skilled in the art from the foregoing description and accompanying drawings. Such modifications are intended to fall within the scope of the appended claims.

All publications and patent applications mentioned in this specification are herein incorporated by reference to the same extent as if each individual publication or patent application was specifically and individually indicated to be incorporated by reference.

TABLE 1

| ORF | Begin | End | Homology | ID | Species | Score | I % |
|---|---|---|---|---|---|---|---|
| ORF2 | 42 | 794 | triosephosphate isomerase | L27492 | *Thermotoga maritima* | 567 | 54 |
| ORF3 | 1258 | 1614 | putative | | | | |
| ORF4 | 1807 | 2418 | polypeptide deformylase | D90906 | Synechocystis sp. | 316 | 40 |

TABLE 1-continued

| ORF | Begin | End | Homology | ID | Species | Score | I % |
|---|---|---|---|---|---|---|---|
| ORF5 | 3393 | 2491 | hypothetical protein | Z75208 | Bacillus subtilis | 338 | 42 |
| ORF6 | 3639 | 4067 | unknown | U87792 | Bacillus subtilis | 117 | 38 |
| ORF7 | 5649 | 4270 | putative | | | | |
| ORF8 | 7463 | 6012 | putative | | | | |
| ORF9 | 8051 | 8962 | putative | | | | |
| ORF10 | 9129 | 9959 | putative | | | | |
| ORF11 | 10687 | 10361 | putative | | | | |
| ORF12 | 10927 | 11232 | putative | | | | |
| ORF13 | 11246 | 12727 | amidase | U49269 | Moraxella catarrhalis | 1108 | 42 |
| ORF14 | 12691 | 14190 | PET112 | D90913 | Synechocystis sp. | 1044 | 46 |
| ORF15 | 14484 | 17249 | POMP91A | U65942 | Chlamydia psittaci | 1074 | 43 |
| ORF16 | 16039 | 15770 | putative | | | | |
| ORF17 | 17845 | 20853 | putative | | | | |
| ORF18 | 21137 | 22042 | putative | | | | |
| ORF19 | 22046 | 23476 | putative | | | | |
| ORF20 | 23681 | 26110 | putative | | | | |
| ORF21 | 26109 | 25861 | putative | | | | |
| ORF22 | 26241 | 26978 | putative | | | | |
| ORF23 | 26960 | 27754 | putative | | | | |
| ORF24 | 27747 | 28577 | putative | | | | |
| ORF25 | 28887 | 29492 | POMP91A | U65942 | Chlamydia psittaci | 180 | 39 |
| ORF26 | 29432 | 30028 | POMP91A | U65942 | Chlamydia psittaci | 361 | 51 |
| ORF27 | 30024 | 31472 | POMP91A | U65942 | Chlamydia psittaci | 879 | 54 |
| ORF28 | 31758 | 32288 | putative 98 kDa outer membrane protein | U72499 | Chlamydia psittaci | 144 | 43 |
| ORF29 | 32201 | 33991 | putative 98 kDa outer membrane protein | U72499 | Chlamydia psittaci | 1126 | 48 |
| ORF30 | 33852 | 34541 | putative 98 kDa outer membrane protein | U72499 | Chlamydia psittaci | 589 | 62 |
| ORF31 | 34783 | 36063 | POMP91B precursor | U65943 | Chlamydia psittaci | 469 | 46 |
| ORF32 | 36009 | 37529 | putative 98 kDa outer membrane protein | U72499 | Chlamydia psittaci | 1338 | 51 |
| ORF33 | 37881 | 39362 | putative 98 kDa outer membrane protein | U72499 | Chlamydia psittaci | 671 | 40 |
| ORF34 | 39418 | 39161 | putative | | | | |
| ORF35 | 39366 | 40715 | POMP90A precursor | U65942 | Chlamydia psittaci | 904 | 47 |
| ORF36 | 43076 | 41094 | putative | | | | |
| ORF37 | 43800 | 43066 | putative | | | | |
| ORF38 | 44828 | 43785 | putative | | | | |
| ORF39 | 45340 | 44753 | homologous to unidentified E. coli protein | M96343 | Bacillus subtilis | 136 | 44 |
| ORF40 | 45752 | 45372 | o530; This 530 aa orf is 33 pct identical (14 gaps) to 525 residues of an approx. 640 aa protein YHES_HAEIN SW: P44808 | AE000184 | Escherichia coli | 269 | 43 |
| ORF41 | 46996 | 45701 | ABC transporter, ATP-binding protein (yheS) | AE000596 | Helicobacter pylori | 878 | 39 |
| ORF42 | 47961 | 47569 | putative | | | | |
| ORF43 | 48960 | 48040 | hypothetical protein | D64001 | Synechocystis sp. | 404 | 37 |
| ORF44 | 51452 | 50133 | Lon protease-like protein | X74215 | Homo sapiens | 1232 | 54 |
| ORF45 | 52606 | 51335 | unknown | Z54285 | Schizosaccharomyces pombe | 781 | 47 |
| ORF46 | 53684 | 53319 | putative | | | | |
| ORF47 | 54195 | 53746 | putative | | | | |
| ORF48 | 55278 | 56453 | heat-shock protein | U15010 | Legionella pneumophila | 975 | 45 |
| ORF49 | 56493 | 57266 | branched chain alpha-keto acid dehydrogenase E1-alpha | M97391 | Bacillus subtilis | 329 | 36 |
| ORF50 | 57297 | 58526 | branched chain alpha-keto acid dehydrogenase E1-beta | M97391 | Bacillus subtilis | 707 | 50 |
| ORF51 | 59851 | 58565 | putative | | | | |
| ORF52 | 61495 | 59924 | ComE | D90903 | Synechocystis sp. | 134 | 55 |
| ORF53 | 61324 | 62151 | putative | | | | |
| ORF54 | 62132 | 62470 | Hpr protein | X12832 | Bacillus subtilis | 136 | 36 |
| ORF55 | 62474 | 63733 | enzyme I (ptsI) | U32844 | Haemophilus influenzae | 381 | 35 |
| ORF56 | 63881 | 64186 | f831; This 831 aa orf is 46 pct identical (11 gaps) to 709 residues of an approx. 712 aa protein PT1A_ECOLI SW: P32670 | AE000326 | Escherichia coli | 123 | 34 |
| ORF57 | 64611 | 64318 | ORF107 | X17014 | Bacillus subtilis | 128 | 33 |
| ORF58 | 65485 | 64673 | putative | | | | |
| ORF59 | 65999 | 65301 | dnaZX-like ORF put. DNA polymerase III | X06803 | Bacillus subtilis | 596 | 52 |
| ORF60 | 66244 | 67281 | putative | | | | |
| ORF61 | 67265 | 67699 | putative | | | | |
| ORF62 | 67703 | 68539 | putative | | | | |
| ORF63 | 68805 | 70736 | putative | | | | |
| ORF64 | 69172 | 68831 | putative | | | | |
| ORF65 | 70642 | 71142 | putative | | | | |

TABLE 1-continued

| ORF | Begin | End | Homology | ID | Species | Score | I % |
|---|---|---|---|---|---|---|---|
| ORF66 | 71325 | 72029 | putative | | | | |
| ORF67 | 72060 | 73637 | putative | | | | |
| ORF68 | 74061 | 76175 | YqfF | D84432 | Bacillus subtilis | 542 | 44 |
| ORF69 | 78351 | 77680 | porphobilinogen deaminase | D28503 | Clostridium josui | 262 | 42 |
| ORF70 | 79356 | 78355 | sms protein | D90914 | Synechocystis sp. | 736 | 52 |
| ORF71 | 79983 | 79693 | ribonuclease III (rnc) | AE000579 | Helicobacter pylori | 98 | 33 |
| ORF72 | 80441 | 79938 | ORF3 | D64116 | Bacillus subtilis | 268 | 44 |
| ORF73 | 80475 | 80969 | putative | | | | |
| ORF74 | 81296 | 83080 | hypothetical protein | Y14079 | Bacillus subtilis | 893 | 38 |
| ORF75 | 83291 | 83932 | manganese superoxide dismutase | X77021 | Caenorhabditis elegans | 622 | 58 |
| ORF76 | 84005 | 84769 | acetyl-CoA carboxylase beta subunit (accD) | AE000604 | Helicobacter pylori | 602 | 50 |
| ORF77 | 84975 | 85244 | deoxyuridinetriphosphatase (dut) | U32776 | Haemophilus influenzae | 110 | 41 |
| ORF78 | 85123 | 85425 | deoxyuridine 5'-triphosphate nucleotidohydrolase (dut) | AE000596 | Helicobacter pylori | 265 | 68 |
| ORF79 | 85397 | 85903 | ORF2 | L26916 | Pseudomonas aeruginosa | 173 | 34 |
| ORF80 | 85909 | 86583 | enzyme IIANtr | U18997 | Escherichia coli | 170 | 42 |
| ORF81 | 86626 | 88065 | putative | | | | |
| ORF82 | 89257 | 91026 | putative | | | | |
| ORF83 | 91291 | 93030 | putative | | | | |
| ORF84 | 93295 | 94086 | putative | | | | |
| ORF85 | 95285 | 94707 | putative | | | | |
| ORF86 | 95667 | 96557 | putative | | | | |
| ORF87 | 96317 | 97456 | putative | | | | |
| ORF88 | 98435 | 97968 | putative | | | | |
| ORF89 | 99460 | 98426 | putative | | | | |
| ORF90 | 100144 | 101325 | elongation factor Tu | L22216 | Chlamydia trachomatis | 1917 | 95 |
| ORF91 | 101457 | 101720 | putative | | | | |
| ORF92 | 101704 | 102273 | transcription factor | L10348 | Thermus aquaticus thermophilus | 376 | 49 |
| ORF93 | 102356 | 102805 | ribosomal protein L11 | D13303 | Bacillus subtilis | 458 | 63 |
| ORF94 | 102835 | 103530 | ribosomal protein L1 | Z11839 | Thermotoga maritima | 642 | 51 |
| ORF95 | 103549 | 104058 | ribosomal protein L10 | M89911 | Streptomyces antibioticus | 82 | 31 |
| ORF96 | 104096 | 104491 | rp112 (AA 1-128) | X53178 | Synechocystis PCC6803 | 325 | 47 |
| ORF97 | 104601 | 108386 | DNA-directed RNA polymerase beta chain | X64172 | Staphylococcus aureus | 2740 | 52 |
| ORF98 | 108401 | 112054 | rpoC | V00339 | Escherichia coli | 2947 | 54 |
| ORF99 | 112033 | 112590 | acetylornithine deacetylase (EC 5.1.1.16) | M22622 | Leptospira biflexa | 514 | 62 |
| ORF100 | 112672 | 113682 | transaldolase | L19437 | Homo sapiens | 755 | 49 |
| ORF101 | 113726 | 114121 | putative | | | | |
| ORF102 | 114711 | 114136 | putative | | | | |
| ORF103 | 115267 | 115755 | putative | | | | |
| ORF104 | 115911 | 116543 | putative | | | | |
| ORF105 | 116736 | 118055 | ATPase alpha-subunit | X63855 | Thermus aquaticus thermophilus | 934 | 50 |
| ORF106 | 117968 | 118522 | adenosine triphosphatase A subunit | D50528 | Acetabularia acetabulum | 147 | 32 |
| ORF107 | 118530 | 119843 | V-ATPase B subunit | U96487 | Desulfurococcus sp. SY | 751 | 48 |
| ORF108 | 119816 | 120457 | putative | | | | |
| ORF109 | 120451 | 122430 | v-type Na-ATPase | X76913 | Enterococcus hirae | 264 | 35 |
| ORF110 | 122504 | 122950 | ATP synthase, subunit K | U67478 | Methanococcus jannaschii | 184 | 31 |
| ORF111 | 123528 | 126347 | valyl-tRNA synthetase | X05891 | Escherichia coli | 1679 | 49 |
| ORF112 | 126332 | 129166 | protein kinase-like protein | U19250 | Streptomyces coelicolor | 427 | 37 |
| ORF113 | 134690 | 129213 | UvrA | D49911 | Thermus thermophilus | 3107 | 41 |
| ORF114 | 134925 | 136382 | pyruvate kinase | U83196 | Chlamydia trachomatis | 1748 | 71 |
| ORF115 | 137870 | 136482 | HtrB protein | X61000 | Escherichia coli | 147 | 38 |
| ORF116 | 137899 | 138240 | putative | | | | |
| ORF117 | 138239 | 137928 | putative | | | | |
| ORF118 | 139558 | 138257 | putative | | | | |
| ORF119 | 140352 | 139516 | YbbP | AB002150 | Bacillus subtilis | 231 | 46 |
| ORF120 | 140498 | 141841 | cyanide insensitive terminal oxidase | Y10528 | Pseudomonas aeruginosa | 538 | 50 |
| ORF121 | 141855 | 142658 | cyanide insensitive terminal oxidase | Y10528 | Pseudomonas aeruginosa | 310 | 40 |
| ORF122 | 144258 | 143050 | putative | | | | |
| ORF123 | 145258 | 144494 | putative | | | | |
| ORF124 | 145454 | 146749 | product similar to E. coli PhoH protein | Z97025 | Bacillus subtilis | 836 | 47 |
| ORF125 | 147318 | 146767 | putative | | | | |
| ORF126 | 148261 | 147677 | putative | | | | |
| ORF127 | 149029 | 152157 | isoleucyl-tRNA synthetase | U04953 | Homo sapiens | 2361 | 52 |
| ORF128 | 154108 | 152201 | leader peptidase I | D90904 | Synechocystis sp. | 225 | 47 |
| ORF129 | 155135 | 154308 | putative | | | | |
| ORF130 | 155141 | 155467 | YtiA | AF008220 | Bacillus subtilis | 201 | 43 |
| ORF131 | 155703 | 156779 | orf 361; ranslated orf similarity to SW: RF1_SALTY peptide chain release factor 1 of Salmonella typhimurium | X78969 | Coxiella burnetii | 863 | 59 |

TABLE 1-continued

| ORF | Begin | End | Homology | ID | Species | Score | I % |
|---|---|---|---|---|---|---|---|
| ORF132 | 156748 | 157635 | product similar to E. coli PRFA2 protein | Z49782 | Bacillus subtilis | 144 | 37 |
| ORF133 | 157653 | 158996 | Ffh | U82109 | Thermus aquaticus | 797 | 45 |
| ORF134 | 159363 | 159986 | tRNA (guanine-N1)-methyltransferase (trmD) | U32705 | Haemophilus influenzae | 545 | 49 |
| ORF135 | 159880 | 160446 | putative | | | | |
| ORF136 | 160477 | 160839 | ribosomal protein L19 | X72627 | Synechocystis sp. | 319 | 50 |
| ORF137 | 160898 | 161539 | putative protein highly homologous to E. coli RNase HIII. | D32253 | Magnetospirillum sp. | 427 | 49 |
| ORF138 | 161527 | 162153 | 5' guanylate kinase (gmk) | U32848 | Haemophilus influenzae | 385 | 43 |
| ORF139 | 162144 | 162443 | putative | | | | |
| ORF140 | 162437 | 164098 | methionyl-tRNA synthetase | AB004537 | Schizosaccharomyces pombe | 861 | 54 |
| ORF141 | 165451 | 164228 | exodeoxyribonuclease V (recD) | U32811 | Haemophilus influenzae | 432 | 32 |
| ORF142 | 166349 | 165411 | putative | | | | |
| ORF143 | 166949 | 168442 | putative | | | | |
| ORF144 | 169416 | 171029 | putative | | | | |
| ORF145 | 170857 | 171459 | putative | | | | |
| ORF146 | 172652 | 173428 | putative biotin-protein ligase | Z97992 | Schizosaccharomyces pombe | 292 | 44 |
| ORF147 | 174626 | 173439 | putative | | | | |
| ORF148 | 174816 | 175613 | putative | | | | |
| ORF149 | 175598 | 175954 | putative | | | | |
| ORF150 | 175958 | 176935 | putative | | | | |
| ORF151 | 177708 | 176938 | orf 3' of chaperonin homolog hypB [Chlamydia psittaci, pigeon strain P-1041, Peptide Partial, 98 aa] | S40172 | Chlamydia psittaci | 376 | 74 |
| ORF152 | 177128 | 177376 | putative | | | | |
| ORF153 | 179472 | 177841 | putative | M69217 | Chlamydia pneumoniae | 2678 | 100 |
| ORF154 | 179822 | 179517 | putative | M69217 | Chlamydia pneumoniae | 498 | 99 |
| ORF155 | 181793 | 179943 | Pz-peptidase | D88209 | Bacillus licheniformis | 1088 | 38 |
| ORF156 | 182628 | 181876 | o247; This 247 aa orf is 51 pct identical (0 gaps) to 117 residues of an approx. 160 aa protein YPH7_CHRVI SW: P45371 | AE000174 | Escherichia coli | 401 | 42 |
| ORF157 | 184420 | 183074 | glutamate-1-semialdehyde 2,1-aminomutase | X53696 | Escherichia coli | 823 | 41 |
| ORF158 | 184988 | 184467 | ORF_o211 | U28377 | Escherichia coli | 87 | 54 |
| ORF159 | 185483 | 185112 | hypothetical protein | D90906 | Synechocystis sp. | 91 | 33 |
| ORF160 | 185902 | 185483 | ribose 5-phosphate isomerase | U28377 | Escherichia coli | 111 | 41 |
| ORF161 | 186174 | 185839 | ribose 5-phosphate isomerase A (SP: P27252) | U32729 | Haemophilus influenzae | 190 | 46 |
| ORF162 | 187720 | 186587 | hypothetical | D83026 | Bacillus subtilis | 536 | 42 |
| ORF163 | 188318 | 190933 | ATP-dependent protease binding subunit | M29364 | Escherichia coli | 2010 | 53 |
| ORF164 | 191090 | 191635 | putative | | | | |
| ORF165 | 191547 | 192743 | putative | | | | |
| ORF166 | 192969 | 193469 | putative | | | | |
| ORF167 | 194044 | 193610 | putative | | | | |
| ORF168 | 194196 | 195809 | unknown | Z84395 | Mycobacterium tuberculosis | 242 | 52 |
| ORF169 | 196088 | 198073 | DNA ligase (EC 6.5.1.2) | M24278 | Escherichia coli | 1317 | 46 |
| ORF170 | 198132 | 199454 | putative | | | | |
| ORF171 | 199351 | 202818 | putative | | | | |
| ORF172 | 204552 | 202999 | PcpB | U60175 | Sphingomonas chlorophenolica | 80 | 41 |
| ORF173 | 205648 | 204692 | putative | | | | |
| ORF174 | 205807 | 207327 | leucine tRNA synthetase | AF008220 | Bacillus subtilis | 1595 | 57 |
| ORF175 | 207182 | 207775 | leucyl-tRNA synthetase | X06331 | Escherichia coli | 363 | 51 |
| ORF176 | 207779 | 208267 | transfer RNA-Leu synthetase | M88581 | Bacillus subtilis | 285 | 43 |
| ORF177 | 208267 | 209577 | KDO-transferase | Z31593 | Chlamydia pneumoniae | 2262 | 100 |
| ORF178 | 211807 | 211271 | KDO-transferase | X80061 | Chlamydia psittaci | 105 | 38 |
| ORF179 | 212188 | 211844 | putative | | | | |
| ORF180 | 214079 | 212448 | pyrophosphate-dependent phosphofructokinase beta subunit | Z32850 | Ricinus communis | 1003 | 45 |
| ORF181 | 214907 | 214083 | CinI | U44893 | Butyrivibrio fibrisolvens | 111 | 41 |
| ORF182 | 216154 | 215429 | putative | | | | |
| ORF183 | 216115 | 216678 | putative | | | | |
| ORF184 | 216728 | 217282 | putative | | | | |
| ORF185 | 217267 | 217866 | putative | | | | |
| ORF186 | 218593 | 218261 | putative | | | | |
| ORF187 | 219821 | 218994 | putative | | | | |
| ORF188 | 221382 | 220309 | putative | | | | |
| ORF189 | 222719 | 221433 | GMP synthetase | M10101 | Escherichia coli | 1151 | 48 |
| ORF190 | 223521 | 222724 | IMP dehydrogenase | X66859 | Acinetobacter calcoaceticus | 778 | 58 |
| ORF191 | 224499 | 225008 | putative | | | | |
| ORF192 | 225140 | 225559 | putative | | | | |
| ORF193 | 225555 | 226802 | putative | | | | |
| ORF194 | 227800 | 226892 | putative | | | | |
| ORF195 | 228335 | 228072 | putative | | | | |

TABLE 1-continued

| ORF | Begin | End | Homology | ID | Species | Score | I % |
|---|---|---|---|---|---|---|---|
| ORF196 | 229251 | 228643 | putative | | | | |
| ORF197 | 230983 | 229622 | YqhX | D84432 | Bacillus subtilis | 1386 | 56 |
| ORF198 | 231483 | 230983 | acetyl-CoA carboxylase biotin carboxyl carrier protein | U38804 | Porphyra purpurea | 199 | 52 |
| ORF199 | 232063 | 231509 | elongation factor P | D64001 | Synechocystis sp. | 282 | 32 |
| ORF200 | 232739 | 232053 | pentose-5-phosphate-3-epimerase | D90911 | Synechocystis sp. | 463 | 43 |
| ORF201 | 233166 | 234356 | putative | | | | |
| ORF202 | 233518 | 233165 | putative | | | | |
| ORF203 | 234536 | 235186 | ORF2 | L35036 | Chlamydia psittaci | 570 | 60 |
| ORF204 | 235379 | 236689 | putative | | | | |
| ORF205 | 236680 | 237618 | putative | | | | |
| ORF206 | 237521 | 238345 | putative | | | | |
| ORF207 | 238281 | 238973 | putative | | | | |
| ORF208 | 238871 | 240115 | putative | | | | |
| ORF209 | 240191 | 241564 | putative | | | | |
| ORF210 | 242281 | 241604 | YqiZ | D84432 | Bacillus subtilis | 379 | 39 |
| ORF211 | 242933 | 242274 | f222; This 222 aa orf is 48 pct identical (0 gaps) to 208 residues of an approx. 232 aa protein YCKA_BACSU SW: P42399 | AE000284 | Escherichia coli | 382 | 45 |
| ORF212 | 243416 | 242976 | arginine repressor protein (argR) | U32800 | Haemophilus influenzae | 229 | 46 |
| ORF213 | 243500 | 244531 | sialoglycoprotease | U15958 | Pasteurella haemolytica | 565 | 53 |
| ORF214 | 244480 | 246021 | oligopeptide permease homolog AII | AF000366 | Borrelia burgdorferi | 457 | 34 |
| ORF215 | 246330 | 247811 | OppAIV | AF000948 | Borrelia burgdorferi | 453 | 35 |
| ORF216 | 247831 | 249174 | OppA gene product | X56347 | Bacillus subtilis | 255 | 37 |
| ORF217 | 249437 | 251038 | dciAE | X56678 | Bacillus subtilis | 469 | 37 |
| ORF218 | 251325 | 252212 | OppB gene product | X56347 | Bacillus subtilis | 652 | 42 |
| ORF219 | 253156 | 254007 | oligopeptidepermease | X89237 | Streptococcus pyogenes | 574 | 48 |
| ORF220 | 253974 | 254852 | ATP binding protein | L18760 | Lactococcus lactis | 433 | 40 |
| ORF221 | 255258 | 256094 | KDO-transferase | X80061 | Chlamydia psiitaci | 106 | 46 |
| ORF222 | 256640 | 257455 | putative | | | | |
| ORF223 | 257502 | 258239 | 2-OXOGLUTARAT | A47930 | Spinacia oleracea | 636 | 52 |
| ORF224 | 257869 | 257501 | putative | | | | |
| ORF225 | 259248 | 260897 | pyrophosphate-fructose 6-phosphate 1-phosphotransferase beta-subunit | M55191 | Solanum tuberosum | 1055 | 44 |
| ORF226 | 262753 | 261788 | putative | | | | |
| ORF227 | 263059 | 262757 | putative | | | | |
| ORF228 | 264375 | 263182 | putative | | | | |
| ORF229 | 265985 | 264747 | putative | | | | |
| ORF230 | 266637 | 266059 | putative | | | | |
| ORF231 | 267338 | 266538 | putative | | | | |
| ORF232 | 267922 | 267473 | putative | | | | |
| ORF233 | 269647 | 270771 | tRNA guanine transglycosylase | L33777 | Zymomonas mobilis | 628 | 44 |
| ORF234 | 272777 | 273145 | ORF4 | D00624 | Bacteriophage chp1 | 100 | 41 |
| ORF235 | 273253 | 273636 | putative | | | | |
| ORF236 | 273705 | 273977 | putative | | | | |
| ORF237 | 276016 | 275717 | putative | | | | |
| ORF238 | 276439 | 276020 | putative | | | | |
| ORF239 | 276792 | 277253 | putative | | | | |
| ORF240 | 277318 | 277599 | putative | | | | |
| ORF241 | 278578 | 277877 | putative | | | | |
| ORF242 | 279258 | 278554 | FbpC | U33937 | Neisseria gonorrhoeae | 312 | 39 |
| ORF243 | 280435 | 279533 | putative | | | | |
| ORF244 | 281547 | 280849 | putative | | | | |
| ORF245 | 281696 | 282325 | CMP-2-keto-3-deoxyoctulosonic acid synthetase | U15192 | Chlamydia trachomatis | 637 | 63 |
| ORF246 | 282459 | 284069 | CTP synthetase | U15192 | Chlamydia trachomatis | 2000 | 68 |
| ORF247 | 284056 | 284517 | ORF3 | U15192 | Chlamydia trachomatis | 453 | 65 |
| ORF248 | 284606 | 285775 | glucose 6-phosphate dehydrogenase | U83195 | Chlamydia trachomatis | 1263 | 77 |
| ORF249 | 285592 | 285987 | glucose 6-phosphate dehydrogenase | U83195 | Chlamydia trachomatis | 519 | 79 |
| ORF250 | 286179 | 286976 | glucose-6-phosphate dehydrogenase isozyme | D88189 | Actinobacillus actinomycetemcomitans | 216 | 40 |
| ORF251 | 287583 | 287002 | putative | | | | |
| ORF252 | 287951 | 287451 | putative | | | | |
| ORF253 | 288499 | 288816 | putative | | | | |
| ORF254 | 289674 | 288505 | putative | | | | |
| ORF255 | 288839 | 289213 | putative | | | | |
| ORF256 | 289970 | 290254 | putative | | | | |
| ORF257 | 291931 | 292803 | gamma-D-glutamyl-L-diamino acid endopeptidase II | X64809 | Bacillus sphaericus | 95 | 39 |
| ORF258 | 293258 | 292755 | ScoS9 | U43429 | Streptomyces coelicolor | 233 | 45 |
| ORF259 | 293718 | 293272 | ribosomal protein L13 (rpLl3) | U32823 | Haemophilus influenzae | 364 | 47 |
| ORF260 | 294630 | 293953 | glutamine transport ATP-binding protein Q | U67524 | Methanococcus jannaschii | 387 | 46 |
| ORF261 | 296153 | 294636 | putative | | | | |
| ORF262 | 294817 | 295068 | putative | | | | |
| ORF263 | 296354 | 297862 | conserved hypothetical protein | AE000586 | Helicobacter pylori | 641 | 46 |

TABLE 1-continued

| ORF | Begin | End | Homology | ID | Species | Score | I % |
|---|---|---|---|---|---|---|---|
| ORF264 | 298415 | 297879 | putative | | | | |
| ORF265 | 298777 | 298253 | putative | | | | |
| ORF266 | 299572 | 298781 | putative | | | | |
| ORF267 | 300487 | 299633 | putative | | | | |
| ORF268 | 301586 | 300702 | putative | | | | |
| ORF269 | 302440 | 301571 | putative | | | | |
| ORF270 | 302838 | 302437 | putative | | | | |
| ORF271 | 303335 | 302745 | putative | | | | |
| ORF272 | 304394 | 303852 | putative | | | | |
| ORF273 | 304606 | 305223 | f311; This 311 aa orf is 22 pct identical (13 gaps) to 186 residues of an approx. 488 aa protein YACA_BACSU SW: P37563; pyuI of D21139 | AE000232 | Escherichia coli | 250 | 38 |
| ORF274 | 305394 | 306236 | survival protein surE | U81296 | Sinorhizobium meliloti | 156 | 42 |
| ORF275 | 306501 | 307439 | YqfU | D84432 | Bacillus subtilis | 547 | 42 |
| ORF276 | 308033 | 307458 | 3-octaprenyl-4-hydroxybenzoate carboxy-lyase | U61168 | Bacillus firmus | 403 | 42 |
| ORF277 | 308924 | 308037 | 4-hydroxybenzoate octaprenyltransferase | U61168 | Bacillus firmus | 152 | 40 |
| ORF278 | 309485 | 310180 | putative | | | | |
| ORF279 | 310426 | 311214 | putative | | | | |
| ORF280 | 311597 | 311253 | putative | | | | |
| ORF281 | 312772 | 311780 | putative | | | | |
| ORF282 | 313425 | 312772 | putative | | | | |
| ORF283 | 313646 | 313377 | putative | | | | |
| ORF284 | 313937 | 314665 | lysophospholipase homolog | AF006678 | Schistosoma mansoni | 141 | 44 |
| ORF285 | 315576 | 314755 | dnaZX | X17014 | Bacillus subtilis | 154 | 39 |
| ORF286 | 316157 | 315531 | unknown | D26185 | Bacillus subtilis | 284 | 31 |
| ORF287 | 318657 | 316156 | DNA gyrase | L47978 | Aeromonas salmonicida | 1785 | 48 |
| ORF288 | 321042 | 318676 | DNA gyrase subunit B | U35453 | Clostridium acetobutylicum | 1838 | 59 |
| ORF289 | 321445 | 321098 | putative | | | | |
| ORF290 | 322309 | 321710 | putative | | | | |
| ORF291 | 323190 | 322366 | outer membrane protein | AE000654 | Helicobacter pylori | 376 | 43 |
| ORF292 | 323843 | 323181 | hypothetical | U70214 | Escherichia coli | 356 | 37 |
| ORF293 | 324878 | 323856 | ATP-binding protein (abc) | U32744 | Haemophilus influenzae | 545 | 44 |
| ORF294 | 325340 | 326410 | f374; This 374 aa orf is 30 pct identical (9 gaps) to 102 residues of an approx. 512 aa protein FLIC_SALMU SW: P06177 | AE000299 | Escherichia coli | 1194 | 62 |
| ORF295 | 326433 | 327836 | Xas A | AE000246 | Escherichia coli | 479 | 33 |
| ORF296 | 328465 | 327839 | putative | | | | |
| ORF297 | 329360 | 328857 | putative | | | | |
| ORF298 | 330907 | 329357 | putative | | | | |
| ORF299 | 332455 | 330956 | MgtE | U18744 | Bacillus firmus | 203 | 36 |
| ORF300 | 334536 | 332395 | putative | | | | |
| ORF301 | 336091 | 334877 | putative | | | | |
| ORF302 | 336103 | 337302 | putative | | | | |
| ORF303 | 338129 | 338830 | putative | | | | |
| ORF304 | 338965 | 339501 | putative | | | | |
| ORF305 | 339508 | 340143 | putative | | | | |
| ORF306 | 340247 | 342967 | putative | | | | |
| ORF307 | 343385 | 343810 | cAMP-dependent protein kinase type I regulatory subunit | U75932 | Rattus norvegicus | 102 | 37 |
| ORF308 | 344171 | 343935 | acyl carrier protein (acpP) | AE000570 | Helicobacter pylori | 198 | 55 |
| ORF309 | 345082 | 344330 | 3-ketoacyl-ACP reductase | U39441 | Vibrio harveyi | 598 | 48 |
| ORF310 | 346005 | 345082 | malonyl-CoA: Acyl carrier protein transacylase | U59433 | Bacillus subtilis | 538 | 45 |
| ORF311 | 346784 | 346437 | beta-ketoacyl-acyl carrier protein synthase III (fabH) | AE000540 | Helicobacter pylori | 273 | 50 |
| ORF312 | 347029 | 346715 | beta-ketoacyl-acyl carrier protein synthase III | M77744 | Escherichia coli | 265 | 63 |
| ORF313 | 347034 | 347723 | recombination protein | D90916 | Synechocystis sp. | 363 | 42 |
| ORF314 | 348075 | 350459 | putative | | | | |
| ORF315 | 350598 | 351071 | putative | | | | |
| ORF316 | 351075 | 352175 | rifampicin resistance protein | L22690 | Rickettsia rickettsii | 495 | 46 |
| ORF317 | 353291 | 352230 | putative | | | | |
| ORF318 | 353442 | 354467 | pyruvate dehydrogenase E1 component, alpha subunit | D90915 | Synechocystis sp. | 571 | 44 |
| ORF319 | 354451 | 354933 | pyruvate dehydrogenase E1 beta subunit | U09137 | Arabidopsis thaliana | 495 | 59 |
| ORF320 | 355000 | 355449 | pyruvate dehydrogenase E1 component, beta subunit | U38804 | Porphyra purpurea | 336 | 47 |
| ORF321 | 355448 | 356743 | F23B12.5 | Z77659 | Caenorhabditis elegans | 759 | 46 |
| ORF322 | 355953 | 355642 | putative | | | | |
| ORF323 | 359310 | 356827 | glycogen phosphorylase B | U47025 | Homo sapiens | 2193 | 57 |
| ORF324 | 359120 | 359377 | putative | | | | |

TABLE 1-continued

| ORF | Begin | End | Homology | ID | Species | Score | I % |
|---|---|---|---|---|---|---|---|
| ORF325 | 359525 | 359908 | putative | | | | |
| ORF326 | 361290 | 359947 | DnaA | D89066 | Staphylococcus aureus | 375 | 46 |
| ORF327 | 363785 | 361362 | hypothetical | U32781 | Haemophilus influenzae | 394 | 44 |
| ORF328 | 364496 | 363888 | putative | | | | |
| ORF329 | 364832 | 365290 | putative | | | | |
| ORF330 | 365304 | 365669 | dpj | M76470 | Escherichia coli | 160 | 45 |
| ORF331 | 366599 | 365667 | NADPH thioredoxin reductase | AC002329 | Arabidopsis thaliana | 975 | 60 |
| ORF332 | 367291 | 369030 | ribosomal protein S1 (rpS1) | U32801 | Haemophilus influenzae | 1209 | 41 |
| ORF333 | 369134 | 369808 | NusA | U74759 | Chlamydia trachomatis | 995 | 87 |
| ORF334 | 369917 | 370438 | NusA | U74759 | Chlamydia trachomatis | 760 | 87 |
| ORF335 | 370365 | 372647 | | U74759 | Chlamydia trachomatis | 2173 | 61 |
| ORF336 | 372557 | 373066 | initiation factor IF2-beta (infB; gtg start codon) | X00513 | Escherichia coli | 333 | 39 |
| ORF337 | 373020 | 373442 | ORF6 gene product | Z18631 | Bacillus subtilis | 192 | 34 |
| ORF338 | 373467 | 374195 | tRNA pseudouridine 55 synthase | D90917 | Synechocystis sp. | 358 | 47 |
| ORF339 | 374176 | 375099 | hypothetical 34.6 kD protein in rpsT-ileS intergenic region | AE000113 | Escherichia coli | 395 | 39 |
| ORF340 | 375676 | 375083 | hypothetical GTP-binding protein in pth 3' region | AE000219 | Escherichia coli | 507 | 53 |
| ORF341 | 376173 | 375634 | hypothetical | U32723 | Haemophilus influenzae | 480 | 59 |
| ORF342 | 376564 | 377643 | YscU | U08019 | Yersinia enterocolitica | 538 | 37 |
| ORF343 | 377956 | 379773 | IcrD gene product | X67771 | Yersinia enterocolitica | 1302 | 47 |
| ORF344 | 379781 | 380425 | putative | | | | |
| ORF345 | 380281 | 381000 | putative | | | | |
| ORF346 | 381008 | 381460 | putative | | | | |
| ORF347 | 381460 | 383037 | 4-alpha-glucanotransferase | L37874 | Clostridium butyricum | 302 | 38 |
| ORF348 | 383257 | 383523 | ribosomal protein L28 (rpL28) | U32776 | Haemophilus influenzae | 175 | 55 |
| ORF349 | 383553 | 385304 | hypothetical protein | D90901 | Synechocystis sp. | 565 | 38 |
| ORF350 | 385397 | 386458 | comE ORF1 | D64002 | Synechocystis sp. | 187 | 10 |
| ORF351 | 387242 | 386514 | putative | | | | |
| ORF352 | 388764 | 387013 | putative | | | | |
| ORF353 | 390120 | 390932 | methylenetetrahydrofolate dehydrogenase | D64000 | Synechocystis sp. | 588 | 53 |
| ORF354 | 390919 | 391818 | f351; Residues 1–121 are 100 pct identical to YOJL_ECOLI SW: P33944 (122 aa) and aa 152–351 are 100 pct identical to YOJK_ECOLI SW: P33943 | AE000310 | Escherichia coli | 186 | 39 |
| ORF355 | 392379 | 391885 | small protein | D90914 | Synechocystis sp. | 387 | 46 |
| ORF356 | 392582 | 392986 | putative | | | | |
| ORF357 | 392776 | 393684 | putative | | | | |
| ORF358 | 394151 | 394804 | RecF protein | D90907 | Synechocystis sp. | 232 | 34 |
| ORF359 | 394928 | 395308 | putative | | | | |
| ORF360 | 395259 | 395990 | putative | | | | |
| ORF361 | 397815 | 395953 | hypothetical | U32773 | Haemophilus influenzae | 391 | 36 |
| ORF362 | 398850 | 397831 | H. influenzae predicted coding region H10807 | U32763 | Haemophilus influenzae | 580 | 39 |
| ORF363 | 400085 | 399099 | putative | | | | |
| ORF364 | 401245 | 400073 | YtgC | AF008220 | Bacillus subtilis | 244 | 30 |
| ORF365 | 401474 | 401136 | putative | | | | |
| ORF366 | 402199 | 401423 | unknown | U52850 | Erysipelothrix rhusiopathiae | 534 | 46 |
| ORF367 | 403193 | 402186 | putative | | | | |
| ORF368 | 403650 | 404165 | putative | | | | |
| ORF369 | 404343 | 405914 | adenine nucleotide translocase | Z49227 | Arabidopsis thaliana | 1280 | 55 |
| ORF370 | 405984 | 407327 | putative | | | | |
| ORF371 | 407712 | 408806 | putative | | | | |
| ORF372 | 410439 | 409075 | putative | | | | |
| ORF373 | 411826 | 410954 | putative | | | | |
| ORF374 | 412482 | 414302 | lepA gene product | X91655 | Bacillus subtilis | 1827 | 59 |
| ORF375 | 415402 | 414407 | 6-phosphogluconate dehydrogenase, decarboxylating (gnd) | U32737 | Haemophilus influenzae | 687 | 51 |
| ORF376 | 415848 | 415237 | 6-phosphogluconate dehydrogenase, 6PGD [Ceratitis capitata = medflies, Peptide, 481 aa] | S67873 | Ceratitis capitata | 695 | 64 |
| ORF377 | 417131 | 415866 | tyrosyl-tRNA synthetase (tyrS) | J01719 | Escherichia coli | 821 | 45 |
| ORF378 | 417258 | 417566 | putative | | | | |
| ORF379 | 418326 | 417454 | whiG-Stv gene product | X68709 | Streptoverticillium griseocarneum | 464 | 41 |
| ORF380 | 420057 | 418426 | FLHA gene product | X63698 | Bacillus subtilis | 455 | 49 |
| ORF381 | 420448 | 420720 | ferredoxin IV | M59855 | Rhodobacter capsulatus | 174 | 63 |
| ORF382 | 420980 | 421552 | putative | | | | |
| ORF383 | 421556 | 422029 | putative | | | | |
| ORF384 | 422461 | 422925 | putative | | | | |
| ORF385 | 423562 | 424320 | putative | | | | |
| ORF386 | 424250 | 424591 | putative | | | | |
| ORF387 | 424830 | 426047 | putative | | | | |
| ORF388 | 426240 | 427397 | putative | | | | |

TABLE 1-continued

| ORF | Begin | End | Homology | ID | Species | Score | I % |
|---|---|---|---|---|---|---|---|
| ORF389 | 428841 | 430703 | GcpE | D90908 | Synechocystis sp. | 877 | 47 |
| ORF390 | 430694 | 431446 | YfiH | U50134 | Escherichia coli | 136 | 35 |
| ORF391 | 431597 | 432100 | putative | | | | |
| ORF392 | 432165 | 432779 | putative | | | | |
| ORF393 | 433272 | 432832 | dihydrolipoamide succinyltransferase (sucB) | U32839 | Haemophilus influenzae | 475 | 64 |
| ORF394 | 433925 | 433227 | dihydrolipoamide succinyltransferase (sucB) | U32839 | Haemophilus influenzae | 332 | 45 |
| ORF395 | 436678 | 433934 | alpha-ketoglutarate dehydrogenase | U41762 | Rhodobacter capsulatus | 1530 | 44 |
| ORF396 | 437176 | 438357 | oxygen-independent coproporphyrinogen III oxidase (hemN) | AE000628 | Helicobacter pylori | 442 | 42 |
| ORF397 | 440317 | 438518 | putative | | | | |
| ORF398 | 440001 | 440345 | putative | | | | |
| ORF399 | 441233 | 440517 | ORF_f286 | U18997 | Escherichia coli | 168 | 45 |
| ORF400 | 440719 | 441012 | putative | | | | |
| ORF401 | 442192 | 441230 | putative | | | | |
| ORF402 | 442888 | 442343 | putative | | | | |
| ORF403 | 442371 | 442961 | putative | | | | |
| ORF404 | 443578 | 443003 | [karp] gene products | M86605 | Chlamydia trachomatis | 505 | 78 |
| ORF405 | 444500 | 443526 | aminopeptidase | D17450 | Mycoplasma salivarium | 273 | 39 |
| ORF406 | 444842 | 444528 | putative | | | | |
| ORF407 | 445009 | 444743 | putative | L39923 | Mycobacterium leprae | 133 | 33 |
| ORF408 | 445718 | 445182 | putative | | | | |
| ORF409 | 445807 | 447804 | Sulp | U18908 | Zea mays | 1307 | 52 |
| ORF410 | 448738 | 447803 | putative | | | | |
| ORF411 | 449628 | 448618 | RuvB protein | U38840 | Thermotoga maritima | 845 | 53 |
| ORF412 | 450298 | 450867 | deoxycytidine triphosphate deaminase (dcd) | AE000554 | Helicobacter pylori | 573 | 58 |
| ORF413 | 450713 | 451207 | putative | | | | |
| ORF414 | 451211 | 452452 | hemolysin | D90914 | Synechocystis sp. | 227 | 39 |
| ORF415 | 452448 | 453659 | similar to [SwissProt Accession Number P37908] | D90888 | Escherichia coli | 96 | 33 |
| ORF416 | 454843 | 453725 | NifS gene product | L34879 | Anabaena azollae | 533 | 38 |
| ORF417 | 455608 | 454865 | hypothetical protein | D90908 | Synechocysus sp. | 371 | 36 |
| ORF418 | 456243 | 457007 | putative | | | | |
| ORF419 | 457016 | 457708 | putative | | | | |
| ORF420 | 458368 | 457979 | unknown | D26185 | Bacillus subtilis | 152 | 36 |
| ORF421 | 459496 | 458372 | mutY homolog | U63329 | Homo sapiens | 466 | 46 |
| ORF422 | 459493 | 460194 | hypothetical protein | D90914 | Synechocystis sp. | 98 | 38 |
| ORF423 | 461446 | 460355 | putative | | | | |
| ORF424 | 462298 | 461450 | putative | | | | |
| ORF425 | 462444 | 463349 | enoyl-ACP reductase | Y13861 | Nicotiana tabacum | 1008 | 69 |
| ORF426 | 464241 | 463342 | putative | | | | |
| ORF427 | 464574 | 465065 | putative | | | | |
| ORF428 | 465129 | 465611 | putative | | | | |
| ORF429 | 465571 | 466317 | putative | | | | |
| ORF430 | 466317 | 467093 | H. pylori predicted coding region HP0152 | AE000536 | Helicobacter pylori | 246 | 36 |
| ORF431 | 466999 | 467502 | putative | | | | |
| ORF432 | 469691 | 467715 | unidentified transporter-ATP binding | Z82044 | Bacillus subtilis | 496 | 45 |
| ORF433 | 470691 | 469660 | acetyl-CoA carboxylase subunit | AF008220 | Bacillus subtilis | 781 | 52 |
| ORF434 | 472010 | 470709 | putative | | | | |
| ORF435 | 471545 | 471799 | putative | | | | |
| ORF436 | 472359 | 472045 | putative | | | | |
| ORF437 | 473523 | 472732 | orf1 | X75413 | Escherichia coli | 313 | 42 |
| ORF438 | 474889 | 473441 | murE gene product | Z15056 | Bacillus subtilis | 679 | 37 |
| ORF439 | 477323 | 475365 | penicillin-binding protein 2 | X59630 | Neisseria meningitidis | 451 | 42 |
| ORF440 | 478496 | 477597 | hypothetical protein | D90906 | Synechocystis sp. | 534 | 52 |
| ORF441 | 478722 | 479273 | putative | | | | |
| ORF442 | 479277 | 479705 | putative | | | | |
| ORF443 | 480050 | 481450 | chromosomal replication initiator protein DnaA | D90909 | Synechocystis sp. | 793 | 40 |
| ORF444 | 481469 | 482053 | OrfH | U35673 | Borrelia burgdorferi | 157 | 37 |
| ORF445 | 482600 | 482025 | putative | | | | |
| ORF446 | 482654 | 484204 | NADH: ubiquinone oxidoreductase subunit B | Z37111 | Vibrio alginolyticus | 801 | 49 |
| ORF447 | 484211 | 485170 | NADH: ubiquinone oxidoreductase (GP: Z37111_4) | U32702 | Haemophilus influenzae | 258 | 48 |
| ORF448 | 485170 | 485838 | NADH: uniquinone oxidoreductase | Z37111 | Vibrio alginolyticus | 543 | 55 |
| ORF449 | 485813 | 486580 | unidentified protein of Na+-translocating NADH-quinone reductase | D49364 | Vibrio alginolyticus | 488 | 48 |
| ORF450 | 486976 | 486638 | putative | | | | |
| ORF451 | 489071 | 487764 | putative | | | | |
| ORF452 | 489341 | 489090 | putative | | | | |
| ORF453 | 489958 | 489152 | putative | | | | |

TABLE 1-continued

| ORF | Begin | End | Homology | ID | Species | Score | I % |
|---|---|---|---|---|---|---|---|
| ORF454 | 490549 | 489962 | putative | | | | |
| ORF455 | 491163 | 490522 | putative | | | | |
| ORF456 | 491396 | 491112 | putative | | | | |
| ORF457 | 492121 | 491390 | putative | | | | |
| ORF458 | 492304 | 494838 | ClpC adenosine triphosphatase | U02604 | Bacillus subtilis | 2370 | 46 |
| ORF459 | 495943 | 494822 | hypothetical protein in purB 5' region | AE000213 | Escherichia coli | 927 | 53 |
| ORF460 | 496011 | 496565 | putative | | | | |
| ORF461 | 496569 | 497228 | putative | | | | |
| ORF462 | 497358 | 497834 | putative | | | | |
| ORF463 | 497770 | 498327 | putative | | | | |
| ORF464 | 499209 | 499589 | putative | | | | |
| ORF465 | 499520 | 499792 | putative | | | | |
| ORF466 | 500774 | 504169 | putative 98 kDa outer membrane protein | U72499 | Chlamydia psittaci | 1215 | 45 |
| ORF467 | 504139 | 504600 | putative 98 kDa outer membrane protein | U72499 | Chlamydia psittaci | 319 | 47 |
| ORF468 | 504865 | 506877 | putative 98 kDa outer membrane protein | U72499 | Chlamydia psittaci | 992 | 42 |
| ORF469 | 506790 | 507671 | putative 98 kDa outer membrane protein | U72499 | Chlamydia psittaci | 739 | 46 |
| ORF470 | 507718 | 510507 | putative 98 kDa outer membrane protein | U72499 | Chlamydia psittaci | 1813 | 42 |
| ORF471 | 508325 | 507912 | putative | | | | |
| ORF472 | 510660 | 513440 | POMP90A precursor | U65942 | Chlamydia psittaci | 1830 | 46 |
| ORF473 | 514965 | 513787 | hypothetical | D83026 | Bacillus subtilis | 482 | 48 |
| ORF474 | 517347 | 515419 | putative 98 kDa outer membrane protein | U72499 | Chlamydia psittaci | 1554 | 51 |
| ORF475 | 517058 | 517363 | putative | | | | |
| ORF476 | 517798 | 517277 | putative 98 kDa outer membrane protein | U72499 | Chlamydia psittaci | 222 | 41 |
| ORF477 | 518200 | 517847 | POMP91B precursor | U65943 | Chlamydia psittaci | 162 | 42 |
| ORF478 | 518300 | 521146 | putative 98 kDa outer membrane protein | U72499 | Chlamydia psittaci | 1900 | 45 |
| ORF479 | 521392 | 522948 | POMP91A | U65942 | Chlamydia psittaci | 490 | 39 |
| ORF480 | 523244 | 524809 | putative 98 kDa outer membrane protein | U72499 | Chlamydia psittaci | 507 | 35 |
| ORF481 | 524379 | 524125 | putative | | | | |
| ORF482 | 524649 | 526238 | putative 98 kDa outer membrane protein | U72499 | Chlamydia psittaci | 969 | 41 |
| ORF483 | 526265 | 527104 | putative | | | | |
| ORF484 | 526947 | 526702 | putative | | | | |
| ORF485 | 526975 | 528450 | putative 98 kDa outer membrane protein | U72499 | Chlamydia psittaci | 197 | 48 |
| ORF486 | 528408 | 529199 | putative outer membrane protein | U72499 | Chlamydia psittaci | 154 | 37 |
| ORF487 | 530612 | 529542 | putative | | | | |
| ORF488 | 531656 | 530616 | putative | | | | |
| ORF489 | 533974 | 532067 | putative | | | | |
| ORF490 | 536432 | 534324 | putative | | | | |
| ORF491 | 537150 | 536707 | putative | | | | |
| ORF492 | 537928 | 537080 | putative | | | | |
| ORF493 | 538438 | 537932 | putative | | | | |
| ORF494 | 538737 | 538333 | putative | | | | |
| ORF495 | 539594 | 539127 | putative | | | | |
| ORF496 | 541215 | 539590 | putative | | | | |
| ORF497 | 542571 | 541282 | putative | | | | |
| ORF498 | 543014 | 542457 | putative | | | | |
| ORF499 | 543369 | 542962 | putative | | | | |
| ORF500 | 543809 | 546628 | putative 98 kDa outer membrane protein | U72499 | Chlamydia psittaci | 506 | 89 |
| ORF501 | 546619 | 549525 | POMP91A | U65942 | Chlamydia psittaci | 128 | 50 |
| ORF502 | 547293 | 546994 | putative | | | | |
| ORF503 | 549699 | 550523 | putative 98 kDa outer membrane protein | U72499 | Chlamydia psittaci | 96 | 32 |
| ORF504 | 550490 | 551551 | putative 98 kDa outer membrane protein | U72499 | Chlamydia psittaci | 223 | 33 |
| ORF505 | 551448 | 552623 | putative 98 kDa outer membrane protein | U72499 | Chlamydia psittaci | 139 | 46 |
| ORF506 | 552652 | 555117 | putative 98 kDa outer membrane protein | U72499 | Chlamydia psittaci | 487 | 48 |
| ORF507 | 555029 | 555493 | putative | | | | |
| ORF508 | 558006 | 555673 | putative | | | | |
| ORF509 | 559694 | 558162 | putative | | | | |
| ORF510 | 558208 | 558573 | putative | | | | |
| ORF511 | 561692 | 559899 | putative | | | | |
| ORF512 | 561412 | 561708 | putative | | | | |
| ORF513 | 563942 | 561777 | 1,4-alpha-glucan branching enzyme | X73903 | Streptomyces coelicolor | 1743 | 45 |

TABLE 1-continued

| ORF | Begin | End | Homology | ID | Species | Score | I % |
|---|---|---|---|---|---|---|---|
| ORF514 | 564969 | 563950 | putative | | | | |
| ORF515 | 566204 | 564936 | YqeV | D84432 | Bacillus subtilis | 639 | 38 |
| ORF516 | 567717 | 566302 | putative GTPase required for high frequency lysogenization by bacteriophage lambda | U00005 | Escherichia coli | 686 | 41 |
| ORF517 | 568526 | 567708 | putative | | | | |
| ORF518 | 569467 | 568742 | putative | | | | |
| ORF519 | 571065 | 569431 | putative | | | | |
| ORF520 | 571828 | 571118 | arginine-binding periplasmic protein 1 precursor | AE000188 | Escherichia coli | 197 | 45 |
| ORF521 | 572202 | 573308 | putative | | | | |
| ORF522 | 573146 | 575056 | putative | | | | |
| ORF523 | 575023 | 575916 | carboxysome formation protein | D90901 | Synechocystis sp. | 557 | 59 |
| ORF524 | 577891 | 576497 | putative | | | | |
| ORF525 | 578914 | 578204 | putative | | | | |
| ORF526 | 579924 | 578857 | putative | | | | |
| ORF527 | 580187 | 579858 | protein kinase C inhibitor | D90906 | Synechocystis sp. | 260 | 49 |
| ORF528 | 580017 | 580406 | putative | | | | |
| ORF529 | 581086 | 580187 | Yer156cp | U18917 | Saccharomyces cerevisiae | 176 | 34 |
| ORF530 | 581367 | 581828 | putative | | | | |
| ORF531 | 581678 | 582367 | putative | | | | |
| ORF532 | 582361 | 583428 | putative | | | | |
| ORF533 | 584690 | 583431 | putative | | | | |
| ORF534 | 585237 | 584950 | putative | | | | |
| ORF535 | 585626 | 586888 | hypothetical protein | D64004 | Synechocystis sp. | 805 | 45 |
| ORF536 | 586846 | 587907 | putative | | | | |
| ORF537 | 589049 | 588180 | putative | | | | |
| ORF538 | 590500 | 589301 | putative | | | | |
| ORF539 | 590755 | 592458 | aminoacyl-tRNA synthetase | L25105 | Chlamydia trachomatis | 2125 | 71 |
| ORF540 | 592526 | 592903 | has homology to putative heat shock proteins of Bacillus subtilis and Clostridium acetobutylicum; ORFA; putative | L25105 | Chlamydia trachomatis | 324 | 59 |
| ORF541 | 592836 | 593747 | Possible negative regulator of CIRCE element; Homologs in B. subtilis and Clostridia spp. referred to as hrcA or orfA | U52216 | Chlamydia trachomatis | 960 | 65 |
| ORF542 | 593747 | 594298 | grpE | M62819 | Chlamydia trachomatis | 661 | 71 |
| ORF543 | 594331 | 595947 | DnaK protein homolog; 71,550 Da; putative | M69227 | Chlamydia pneumoniae | 2619 | 100 |
| ORF544 | 595905 | 596309 | DnaK protein homolog; 71,550 Da; putative | M69227 | Chlamydia pneumoniae | 674 | 100 |
| ORF545 | 596514 | 597215 | putative | | | | |
| ORF546 | 597184 | 597957 | vacB gene product | U14003 | Escherichia coli | 306 | 48 |
| ORF547 | 597755 | 598612 | ORF-2 | D11024 | Shigella flexneri | 168 | 46 |
| ORF548 | 598602 | 599204 | homologous to DNA glycosylases; hypothetical | D83026 | Bacillus subtilis | 374 | 47 |
| ORF549 | 599373 | 599939 | putative | | | | |
| ORF550 | 600903 | 602072 | hemolysin | X73141 | Serpulina hyodysenteriae | 362 | 36 |
| ORF551 | 602240 | 602587 | hypothetical protein | D90908 | Synechocystis sp. | 182 | 35 |
| ORF552 | 602637 | 603272 | putative | | | | |
| ORF553 | 603142 | 604512 | putative | | | | |
| ORF554 | 604627 | 605853 | conserved hypothetical protein | AE000579 | Helicobacter pylori | 423 | 40 |
| ORF555 | 605790 | 606620 | putative | | | | |
| ORF556 | 606571 | 607281 | putative | L14679 | Lactococcus lactis | 384 | 45 |
| ORF557 | 609004 | 607355 | putative | | | | |
| ORF558 | 610906 | 609932 | putative | | | | |
| ORF559 | 611786 | 611004 | diaminopimelate epimerase | D90917 | Synechocystis sp. | 207 | 55 |
| ORF560 | 612333 | 611746 | ATP-dependent Clp protease proteolytic subunit | D90915 | Synechocystis sp. | 389 | 44 |
| ORF561 | 613897 | 612341 | serine hydroxymethyltransferase | D90903 | Synechocystis sp. | 909 | 52 |
| ORF562 | 615179 | 616279 | putative | | | | |
| ORF563 | 616610 | 617383 | putative | | | | |
| ORF564 | 618796 | 617810 | ORF_o328 | U18997 | Esherichia coli | 413 | 45 |
| ORF565 | 620004 | 618826 | branched chain alpha-keto acid dehydrogenase E2 | M97391 | Bacillus subtilis | 688 | 41 |
| ORF566 | 619649 | 619918 | putative | | | | |
| ORF567 | 621265 | 620021 | Hypothetical protein | Y14083 | Bacillus subtilis | 727 | 37 |
| ORF568 | 622359 | 621265 | hypothetical | U32691 | Haemophilus influenzae | 294 | 52 |
| ORF569 | 623420 | 622560 | rRNA methylase | D90913 | Synechocyslis sp. | 244 | 38 |
| ORF570 | 624297 | 623335 | hypothetical protein (SP: P39587) | U67605 | Methanococcus jannaschii | 147 | 35 |
| ORF571 | 624773 | 624174 | riboflavin synthase alpha chain | AE000261 | Escherichia coli | 424 | 50 |
| ORF572 | 625029 | 625484 | ORF168 | D28752 | Synechococcus sp. | 323 | 43 |
| ORF573 | 625488 | 625883 | YteA | AF008220 | Bacillus subtilis | 172 | 35 |
| ORF574 | 625892 | 626395 | signalpeptidase II | X78084 | Staphylococcus carnosus | 204 | 38 |
| ORF575 | 626444 | 627790 | D-alanine permease (dagA) | U32770 | Haemophilus influenzae | 566 | 33 |
| ORF576 | 627912 | 628607 | putative | | | | |

TABLE 1-continued

| ORF | Begin | End | Homology | ID | Species | Score | I % |
|---|---|---|---|---|---|---|---|
| ORF577 | 628774 | 629697 | putative | | | | |
| ORF578 | 629660 | 631639 | POMP91A | U65942 | *Chlamydia psittaci* | 579 | 44 |
| ORF579 | 631725 | 633551 | putative | | | | |
| ORF580 | 633520 | 636957 | putative 98 kDa outer membrane protein | U72499 | *Chlamydia psittaci* | 266 | 45 |
| ORF581 | 637232 | 638098 | adhesion protein | D90903 | *Synechocystis sp.* | 267 | 38 |
| ORF582 | 640648 | 639593 | GTP-binding protein | D90901 | *Synechocystis sp.* | 759 | 45 |
| ORF583 | 640979 | 640728 | 50S ribosomal protein L27 | U38804 | *Porphyra purpurea* | 265 | 65 |
| ORF584 | 641327 | 641007 | 50S ribosomal subunit protein L21 | U18997 | *Escherichia coli* | 210 | 41 |
| ORF585 | 641687 | 642283 | hypothetical protein | D90906 | *Synechocystis sp.* | 76 | 39 |
| ORF586 | 643023 | 642286 | assimilatory sulfite reductase | L26503 | *Saccharomyces cerevisiae* | 284 | 42 |
| ORF587 | 643330 | 643076 | putative | | | | |
| ORF588 | 643704 | 643351 | ribosomal protein S10 (rpS10) | U32761 | *Haemophilus influenzae* | 349 | 69 |
| ORF589 | 645628 | 643676 | translation elongation factor EF-G (fusA) | AF000625 | *Helicobacter pylori* | 1991 | 58 |
| ORF590 | 645783 | 645538 | elongation factor G (AA 1-691) | X16278 | *Thermus aquaticus thermophilus* | 170 | 80 |
| ORF591 | 646269 | 645793 | ribosomal protein S7 | Z11567 | *Chlamydia trachomatis* | 730 | 88 |
| ORF592 | 646751 | 646314 | ribosomal protein S12 (AA 1-123) | X52912 | *Cryptomonas phi* | 485 | 67 |
| ORF593 | 647848 | 647045 | putative | | | | |
| ORF594 | 648393 | 650336 | ORF of prc gene (alt.) | D00674 | *Escherichia coli* | 554 | 42 |
| ORF595 | 651016 | 650420 | hypothetical sulfur-rich protein | U41759 | *Chlamydia psittaci* | 301 | 50 |
| ORF596 | 652956 | 651289 | 60 kDa CrP | X53511 | *Chlamydia pneumoniae* | 2951 | 100 |
| ORF597 | 653395 | 653126 | 9 kDa CrP | X53511 | *Chlamydia pneumoniae* | 502 | 99 |
| ORF598 | 655740 | 654193 | glutamyl-tRNA synthetase homolog | U41759 | *Chlamydia psittaci* | 2259 | 82 |
| ORF599 | 656508 | 655966 | early stage-specific transcription experimentally demonstrated; early upstream open reading frame (EUO) | L13598 | *Chlamydia psittaci* | 666 | 62 |
| ORF600 | 658140 | 657022 | unknown | U41759 | *Chlamydia psittaci* | 950 | 44 |
| ORF601 | 660216 | 658525 | RecJ recombination protein | U41759 | *Chlamydia psittaci* | 807 | 73 |
| ORF602 | 663238 | 660248 | protein-export membrane protein SecD | D64000 | *Synechocystis sp.* | 413 | 41 |
| ORF603 | 664461 | 663157 | putative | | | | |
| ORF604 | 665735 | 664635 | putative | | | | |
| ORF605 | 666212 | 666994 | hypothetical protein | D64006 | *Synechocystis sp.* | 538 | 58 |
| ORF606 | 666998 | 667921 | o298; This 298 aa orf is 33 pct identical (24 gaps) to 248 residues of an approx. 256 aa protein CDSA_ECOLI SW: P06466 | AE000238 | *Escherichia coli* | 253 | 45 |
| ORF607 | 667909 | 668568 | cytidylate kinase | AE000193 | *Escherichia coli* | 400 | 48 |
| ORF608 | 668502 | 669203 | hypothetical protein | D90915 | *Synechocyslis sp.* | 225 | 33 |
| ORF609 | 669154 | 670893 | arginyl-tRNA-synthetase | D64006 | *Synechocystis sp.* | 1365 | 49 |
| ORF610 | 672226 | 670853 | UDP-N-acetylglucosamine enolpyruvyl transferase (murZ) | U32788 | *Haemophilus influenzae* | 642 | 40 |
| ORF611 | 671137 | 671424 | putative | | | | |
| ORF612 | 672453 | 673001 | putative | | | | |
| ORF613 | 673072 | 674721 | putative | | | | |
| ORF614 | 674549 | 674262 | putative | | | | |
| ORF615 | 675518 | 674796 | ORF246 gene product | X59551 | *Escherichia coli* | 520 | 43 |
| ORF616 | 676083 | 675499 | putative | | | | |
| ORF617 | 676630 | 676067 | putative | | | | |
| ORF618 | 677016 | 676600 | ORF3 | D10279 | *Bacillus subtilis* | 361 | 63 |
| ORF619 | 677647 | 677015 | peptide release factor 2 | X99401 | *Bacillus firmus* | 427 | 43 |
| ORF620 | 677990 | 678259 | unknown | Z49939 | *Saccharomyces cerevisiae* | 175 | 48 |
| ORF621 | 679444 | 680097 | unknown | D26185 | *Bacillus subtilis* | 263 | 38 |
| ORF622 | 680097 | 680897 | unknown | D64126 | *Bacillus subtilis* | 506 | 45 |
| ORF623 | 681637 | 680849 | putative | | | | |
| ORF624 | 681409 | 682281 | putative | | | | |
| ORF625 | 682453 | 682821 | putative | | | | |
| ORF626 | 682763 | 683902 | sensor protein | L39904 | *Myxococcus xanthus* | 190 | 48 |
| ORF627 | 684616 | 683969 | putative | | | | |
| ORF628 | 685169 | 684534 | putative | | | | |
| ORF629 | 685986 | 685117 | putative | | | | |
| ORF630 | 686278 | 687288 | NtrC/NifA-like protein regulator | U17902 | *Escherichia coli* | 820 | 45 |
| ORF631 | 687483 | 688151 | putative | | | | |
| ORF632 | 688740 | 689501 | putative | | | | |
| ORF633 | 690242 | 689622 | putative | | | | |
| ORF634 | 690470 | 691126 | unknown | Z48008 | *Saccharomyces cerevisiae* | 380 | 46 |
| ORF635 | 692600 | 691497 | putative | | | | |
| ORF636 | 692674 | 695064 | phenylalanyl-tRNA synthetase beta-subunit (pheT) | U32810 | *Haemophilus influenzae* | 593 | 45 |
| ORF637 | 695049 | 696032 | putative | | | | |
| ORF638 | 697964 | 696585 | OppC-like protein | D85103 | *Synechococcus sp.* | 371 | 37 |
| ORF639 | 699803 | 698274 | OppB gene product | X56347 | *Bacillus subtilis* | 197 | 40 |
| ORF640 | 701926 | 699788 | AppA | U20909 | *Bacillus subtilis* | 324 | 43 |
| ORF641 | 703196 | 702567 | putative | | | | |
| ORF642 | 704221 | 703208 | putative | | | | |

TABLE 1-continued

| ORF | Begin | End | Homology | ID | Species | Score | I % |
|---|---|---|---|---|---|---|---|
| ORF643 | 704240 | 705289 | ferrochelatase | X73417 | Arabidopsis thaliana | 266 | 42 |
| ORF644 | 706070 | 705300 | histidine periplasmic binding protein P29 | U58045 | Campylobacter jejuni | 128 | 31 |
| ORF645 | 706841 | 706254 | conserved hypothetical protein | AE000592 | Helicobacter pylori | 155 | 37 |
| ORF646 | 707596 | 706811 | putative | | | | |
| ORF647 | 708666 | 707677 | ADP-glucose pyrophosphorylase | X55650 | Solanum tuberosum | 595 | 43 |
| ORF648 | 709793 | 709119 | pyrE-F gene product | X71842 | Arabidopsis thaliana | 400 | 44 |
| ORF649 | 711523 | 710132 | transcription termination factor | J01673 | Escherichia coli | 1251 | 60 |
| ORF650 | 712236 | 711523 | putative | | | | |
| ORF651 | 714734 | 712125 | DNA polymerase I | J04479 | Streptococcus pneumoniae | 1334 | 43 |
| ORF652 | 715759 | 714761 | protease IV | U67512 | Methanococcus jannaschii | 101 | 55 |
| ORF653 | 717538 | 715886 | adenine nucleotide translocase | Z49227 | Arabidopsis thaliana | 832 | 39 |
| ORF654 | 719113 | 720243 | replicative DNA helicase | D26185 | Bacillus subtilis | 776 | 44 |
| ORF655 | 720590 | 722422 | homologous to E. coli gidA | X62540 | Pseudomonas putida | 1575 | 52 |
| ORF656 | 722406 | 723056 | putative | | | | |
| ORF657 | 723551 | 723120 | nucleoside 5'-diphosphate phosphotransferase (EC 2.7.4.6) | J05207 | Myxococcus xanthus | 451 | 62 |
| ORF658 | 724246 | 723626 | Holliday junction DNA helicase (ruvA) | U32716 | Haemophilus influenzae | 293 | 43 |
| ORF659 | 724754 | 724251 | crossover junction endodeoxyribonuclease (ruvC) | U32717 | Haemophilus influenzae | 296 | 53 |
| ORF660 | 725868 | 724900 | putative | | | | |
| ORF661 | 727115 | 726270 | putative | | | | |
| ORF662 | 728126 | 727119 | glyceraldehyde-3-phosphate dehydrogenase | U83198 | Chlamydia trachomatis | 1340 | 75 |
| ORF663 | 728594 | 728208 | ribosomal protein L17 | L33834 | Chlamydia trachomatis | 439 | 82 |
| ORF664 | 729614 | 728604 | RNA polymerase alpha-subunit | L33834 | Chlamydia trachomatis | 1356 | 89 |
| ORF665 | 729778 | 729533 | RNA polymerase alpha-subunit | L33834 | Chlamydia trachomatis | 273 | 82 |
| ORF666 | 730149 | 729751 | ribosomal protein S11 | L33834 | Chlamydia trachomatis | 562 | 90 |
| ORF667 | 730539 | 730174 | ribosomal protein S13 | L33834 | Chlamydia trachomatis | 544 | 89 |
| ORF668 | 731983 | 730598 | homolog | L25077 | Chlamydia trachomatis | 1956 | 83 |
| ORF669 | 732427 | 731996 | ribosomal protein CtrL15e | M80325 | Chlamydia trachomatis | 563 | 77 |
| ORF670 | 732917 | 732423 | ribosomal protein CtrS5e | M80325 | Chlamydia trachomatis | 702 | 84 |
| ORF671 | 733598 | 733320 | ribosomal protein L6 | M60652 | Chlamydia trachomatis | 316 | 87 |
| ORF672 | 733869 | 733492 | ribosomal protein L6 | M60652 | Chlamydia trachomatis | 469 | 77 |
| ORF673 | 734298 | 733900 | ribosomal protein CtrS8e | M80325 | Chlamydia trachomatis | 572 | 82 |
| ORF674 | 734858 | 734319 | ribosomal protein CtrL5e | M80325 | Chlamydia trachomatis | 730 | 90 |
| ORF675 | 735195 | 734863 | ribosomal protein CtrL24e | M80325 | Chlamydia trachomatis | 420 | 70 |
| ORF676 | 735578 | 735342 | ribosomal protein CtrL14e | M80325 | Chlamydia trachomatis | 270 | 95 |
| ORF677 | 735861 | 735604 | ribosomal protein S17e | M80325 | Chlamydia trachomatis | 322 | 77 |
| ORF678 | 736492 | 736079 | 50S ribosomal protein L16 | D90905 | Synechocystis sp. | 439 | 60 |
| ORF679 | 737192 | 736524 | ribosomal protein S3 | D64071 | Actinobacillus actinomycetemcomitans | 612 | 58 |
| ORF680 | 737555 | 737211 | ribosomal protein L22 | Z21677 | Thermotoga maritima | 228 | 48 |
| ORF681 | 738688 | 737837 | 50S ribosomal subunit protein L2 | U18997 | Escherichia coli | 769 | 62 |
| ORF682 | 739048 | 738713 | putative | | | | |
| ORF683 | 739736 | 739065 | ribosomal protein L4 | X67014 | Bacillus stearothermophilus | 308 | 46 |
| ORF684 | 740477 | 739773 | ribosomal protein L3 | Z46265 | Thermus aquaticus thermophilus | 463 | 50 |
| ORF685 | 740659 | 740958 | putative | | | | |
| ORF686 | 741722 | 740721 | putative | | | | |
| ORF687 | 742789 | 741827 | methionyl-tRNA formyltransferase | D64001 | Synechocystis sp. | 511 | 48 |
| ORF688 | 743618 | 742782 | UDP-N-acetylglucosamine acyltransferase | L22690 | Rickettsia rickettsii | 542 | 43 |
| ORF689 | 744092 | 743634 | (3R)-hydroxymyristol acyl carrier protein dehydrase | D90910 | Synechocystis sp. | 339 | 55 |
| ORF690 | 744604 | 744107 | UDP-3-0-acyl N-acetylglcosamine deacetylase | D90902 | Synechocystis sp. | 287 | 45 |
| ORF691 | 744953 | 744498 | UDP-3-O-acyl-GlcNAc deacetylase | U67855 | Pseudomonas aeruginosa | 262 | 51 |
| ORF692 | 746608 | 744986 | apolipoprotein N-acyltransferase (cute) | U32716 | Haemophilus influenzae | 194 | 50 |
| ORF693 | 747085 | 746621 | low homology to P14 protein of Heamophilus influenzar and 14.2 kDa protein of Escherichia coli | D78189 | Bacillus subtilis | 235 | 37 |
| ORF694 | 747974 | 747219 | polymerase III | M22996 | Bacillus subtilis | 180 | 34 |
| ORF695 | 748594 | 748169 | hypothetical protein | D90914 | Synechocystis sp. | 160 | 43 |
| ORF696 | 749145 | 748573 | putative | | | | |
| ORF697 | 749652 | 749957 | trxA | L39892 | Chlamydia psittaci | 393 | 72 |
| ORF698 | 750446 | 749979 | spoU | L39892 | Chlamydia psittaci | 559 | 72 |
| ORF699 | 751219 | 750446 | mip | L39892 | Chlamydia psittaci | 948 | 60 |
| ORF700 | 753042 | 751291 | aspartyl-tRNA synthetase | D90910 | Synechocystis sp. | 1347 | 47 |
| ORF701 | 754309 | 753020 | histidine-tRNA ligase | Z17214 | Streptococcus equisimilis | 757 | 44 |
| ORF702 | 755120 | 756175 | hexosephosphate transport protein | M89480 | Salmonella typhimurium | 870 | 49 |
| ORF703 | 756120 | 756485 | hexosephosphate transport protein | M89479 | Escherichia coli | 321 | 45 |
| ORF704 | 756499 | 760227 | DNA polymerase III alpha-subunit (dnaE) | AE000646 | Helicobacter pylori | 1977 | 42 |
| ORF705 | 761217 | 760297 | putative | | | | |

TABLE 1-continued

| ORF | Begin | End | Homology | ID | Species | Score | I % |
|---|---|---|---|---|---|---|---|
| ORF706 | 761297 | 761809 | putative | | | | |
| ORF707 | 761782 | 762282 | putative | | | | |
| ORF708 | 762260 | 762895 | putative | | | | |
| ORF709 | 762867 | 763316 | hypothetical protein | D90908 | Synechocystis sp. | 177 | 43 |
| ORF710 | 763780 | 763325 | putative | | | | |
| ORF711 | 763861 | 765168 | DD-carboxypeptidase | M85047 | Bacillus subtilis | 292 | 37 |
| ORF712 | 766809 | 765697 | fmu and fmv protein | D90902 | Synechocystis sp. | 130 | 36 |
| ORF713 | 768051 | 766888 | putative | | | | |
| ORF714 | 768566 | 768321 | putative | | | | |
| ORF715 | 769342 | 768551 | putative | | | | |
| ORF716 | 770532 | 769378 | putative | | | | |
| ORF717 | 771451 | 770804 | putative | | | | |
| ORF718 | 773058 | 771847 | 3-phosphoglycerate kinase | U83197 | Chlamydia trachomatis | 1540 | 72 |
| ORF719 | 773094 | 773456 | putative | | | | |
| ORF720 | 774376 | 773093 | putative phosphate permease | U84890 | Mesembryanthemum crystallinum | 870 | 45 |
| ORF721 | 775123 | 774380 | putative | | | | |
| ORF722 | 775398 | 774916 | putative | | | | |
| ORF723 | 775046 | 776077 | sporulation protein | M57689 | Bacillus subtilis | 698 | 43 |
| ORF724 | 776070 | 777041 | was dppE | U00039 | Escherichia coli | 565 | 56 |
| ORF725 | 777964 | 777536 | orf288; translated orf similarity to SWISS-PROT: YGI2_PSEPU hypothetical 32.4 kDa protein of Pseudomomas putida | Y10436 | Coxiella burnetii | 256 | 46 |
| ORF726 | 778176 | 777904 | B. subtilis genes rpmH, rnpA, 50 kd, gidA and gidB | X62539 | Bacillus subtilis | 112 | 37 |
| ORF727 | 778621 | 779334 | putative | | | | |
| ORF728 | 781173 | 780307 | f406; This 406 aa orf is 28 pct identical (12 gaps) to 264 residues of an approx. 440 aa protein YAOA_SCHPO SW: Q10089 | AE000263 | Escherichia coli | 603 | 40 |
| ORF729 | 781526 | 781116 | f406; This 406 aa orf is 28 pct identical (12 gaps) to 264 residues of an approx. 440 aa protein YAOA_SCHPO SW: Q10089 | AE000263 | Escherichia coli | 258 | 45 |
| ORF730 | 782784 | 781555 | f423; This 423 aa orf is 29 pct identical (1 gaps) to 172 residues of an approx. 488 aa protein YC24_CYAPA SW: P48260 | AE000263 | Escherichia coli | 197 | 44 |
| ORF731 | 783572 | 782805 | hypothetical chloroplast ORF16 | U38804 | Porphyra purpurea | 597 | 52 |
| ORF732 | 785032 | 783581 | ABC transporter subunit | D64004 | Synechocystis sp. | 1720 | 62 |
| ORF733 | 786412 | 785360 | putative | | | | |
| ORF734 | 788429 | 786450 | pbp | Y14206 | Streptomyces coelicolor | 148 | 55 |
| ORF735 | 788944 | 788528 | penicillin-binding protein 3 | X84053 | Pseudomonas aeruginosa | 148 | 38 |
| ORF736 | 789758 | 788901 | putative | | | | |
| ORF737 | 790332 | 791504 | major outer membrane protein | M64064 | Chlamydia pneumoniae | 2028 | 99 |
| ORF738 | 791846 | 792721 | ribosomal protein S2 | U60196 | Chlamydia trachomatis | 904 | 70 |
| ORF739 | 792724 | 793569 | elongation factor Ts | U60196 | Chlamydia trachomatis | 1023 | 71 |
| ORF740 | 793580 | 794323 | UMP kinase | U60196 | Chlamydia trachomatis | 891 | 72 |
| ORF741 | 794304 | 794843 | ribosome-releasing factor | U60196 | Chlamydia trachomatis | 673 | 73 |
| ORF742 | 795217 | 795732 | unknown | D26185 | Bacillus subtilis | 105 | 42 |
| ORF743 | 795722 | 796795 | unknown | D26185 | Bacillus subtilis | 208 | 33 |
| ORF744 | 798735 | 797053 | putative | L33796 | Vibrio cholerae | 386 | 34 |
| ORF745 | 799823 | 798681 | putative | | | | |
| ORF746 | 799297 | 799578 | putative | | | | |
| ORF747 | 801313 | 799808 | Pkn5 | U40656 | Myxococcus xanthus | 345 | 33 |
| ORF748 | 802453 | 801332 | putative | | | | |
| ORF749 | 803299 | 802457 | putative | | | | |
| ORF750 | 803811 | 803290 | putative | | | | |
| ORF751 | 805151 | 803826 | YscN | U02499 | Yersinia enterocolitica | 1185 | 53 |
| ORF752 | 805860 | 805156 | putative | | | | |
| ORF753 | 806604 | 806332 | putative | | | | |
| ORF754 | 806913 | 806608 | putative | | | | |
| ORF755 | 808222 | 806903 | putative | | | | |
| ORF756 | 808751 | 808146 | putative | | | | |
| ORF757 | 809437 | 808673 | putative | | | | |
| ORF758 | 809939 | 809454 | putative | | | | |
| ORF759 | 811235 | 810213 | delta-aminolevulinate synthase (EC 2.3.1.37) | M30785 | Escherichia coli | 172 | 40 |
| ORF760 | 811779 | 813056 | DNA gyrase subunit B | U35453 | Clostridium acetobutylicum | 584 | 38 |
| ORF761 | 812890 | 812516 | putative | | | | |
| ORF762 | 812954 | 813583 | DNA gyrase subunit B | Z19108 | Spiroplasma citri | 371 | 39 |
| ORF763 | 813587 | 815023 | gyrA | X92503 | Mycobacterium smegmatis | 414 | 55 |
| ORF764 | 815420 | 815746 | putative | | | | |
| ORF765 | 816036 | 817010 | orf-X; hypothetical protein; Method: conceptual translation supplied by author | U48870 | Bacillus subtilis | 569 | 47 |

TABLE 1-continued

| ORF | Begin | End | Homology | ID | Species | Score | I % |
|---|---|---|---|---|---|---|---|
| ORF766 | 817111 | 817356 | unknown | Z74024 | Mycobacterium tuberculosis | 114 | 34 |
| ORF767 | 817791 | 818609 | 3-deoxy-d-manno-octulosonic acid 8-phosphate synthetase | Z50747 | Chlamydia psittaci | 1112 | 78 |
| ORF768 | 818609 | 819094 | protein of unknown function | Z50747 | Chlamydia psittaci | 545 | 65 |
| ORF769 | 819104 | 819823 | ATP binding protein | U72493 | Chlamydia trachomatis | 1099 | 88 |
| ORF770 | 820722 | 819826 | putative | | | | |
| ORF771 | 822313 | 821000 | putative | | | | |
| ORF772 | 823503 | 822238 | putative | | | | |
| ORF773 | 823678 | 825612 | putative | | | | |
| ORF774 | 825461 | 826312 | putative | | | | |
| ORF775 | 827280 | 826645 | putative | | | | |
| ORF776 | 828604 | 827171 | 76 kDa protein | L23921 | Chlamydia pneumoniae | 2179 | 100 |
| ORF777 | 830026 | 828713 | 76 kDa protein | L23921 | Chlamydia pneumoniae | 1162 | 100 |
| ORF778 | 831047 | 830085 | mviB homolog | U50732 | Chlamydia trachomatis | 982 | 58 |
| ORF779 | 831725 | 831051 | mviB homolog | U50732 | Chlamydia trachomatis | 740 | 65 |
| ORF780 | 832220 | 833098 | T05H10.2 | Z47812 | Caenorhabditis elegans | 407 | 34 |
| ORF781 | 833851 | 833396 | ribosomal protein S4 (rps4) | AE000633 | Helicobacter pylori | 372 | 53 |
| ORF782 | 834068 | 835039 | This ORF is homologous to a 40.0 kd hypothetical protein in the htrB 3' region from E. coli, Accession Number X61000 | L22217 | Mycoplasma-like organism | 377 | 49 |
| ORF783 | 835792 | 835127 | uridine kinase | L31783 | Mus musculus | 436 | 43 |
| ORF784 | 837624 | 836116 | ORF_f397 | U29581 | Escherichia coli | 92 | 38 |
| ORF785 | 838951 | 840882 | putative | | | | |
| ORF786 | 840869 | 842185 | exodeoxyribonuclease V (recB) | U32811 | Haemophilus influenzae | 409 | 40 |
| ORF787 | 841989 | 843455 | DNA helicase II | U39703 | Mycoplasma genitalium | 110 | 46 |
| ORF788 | 843242 | 844021 | exodeoxyribonuclease V (recB) | U32811 | Haemophilus influenzae | 196 | 40 |
| ORF789 | 845018 | 843987 | MreC protein | M31792 | Escherichia coli | 76 | 53 |
| ORF790 | 846174 | 844990 | aspartate aminotransferase (aspC) | X03629 | Escherichia coli | 754 | 40 |
| ORF791 | 848509 | 846311 | GreA | U02878 | Rickettsia prowazekii | 190 | 35 |
| ORF792 | 848568 | 849014 | putative | | | | |
| ORF793 | 849082 | 850488 | NADH: ubiquinone oxidoreducatase subunit A (GP: Z37111_2) | U32702 | Haemophilus influenzae | 445 | 37 |
| ORF794 | 851512 | 850574 | porphobilinogen synthase | U38348 | Chlorobium vibrioforme | 769 | 45 |
| ORF795 | 852064 | 852447 | putative | | | | |
| ORF796 | 852398 | 853690 | putative | | | | |
| ORF797 | 855118 | 854243 | geranylgeranyl pyrophosphate synthase | D85029 | Arabidopsis thaliana | 408 | 41 |
| ORF798 | 855751 | 855128 | f147; This 147 aa orf is 26 pct identical (1 gaps) to 99 residues of an approx. 728 aa protein E2BE_RABIT SW: P47823 | AE000143 | Escherichia coli | 187 | 36 |
| ORF799 | 856551 | 855829 | membrane associated regulatory protein | M28368 | Salmonella typhimurium | 172 | 36 |
| ORF800 | 856730 | 858556 | unknown function | Z32530 | Chlamydia trachomatis | 842 | 35 |
| ORF801 | 858717 | 859601 | exodeoxyribonuclease V (recD) | U32811 | Haemophilus influenzae | 182 | 51 |
| ORF802 | 859591 | 860205 | exonuclease V alpha subunit (AA 1-608) | X04582 | Escherichia coli | 235 | 45 |
| ORF803 | 861132 | 860284 | putative | | | | |
| ORF804 | 861426 | 861163 | 30S ribosomal protein S20 | Z67753 | Odontella sinensis | 153 | 41 |
| ORF805 | 861701 | 862921 | putative | | | | |
| ORF806 | 863026 | 864798 | major sigma factor | U04442 | Chlamydia psiitaci | 2661 | 94 |
| ORF807 | 864831 | 865256 | putative | | | | |
| ORF808 | 865226 | 866581 | dihydropterin pyrophosphokinase/ dihydropteroate synthase | Y08611 | Pisum sativum | 455 | 48 |
| ORF809 | 866562 | 867119 | dehydrofolate reductase, type I (folA) | U32772 | Haemophilus influenzae | 213 | 49 |
| ORF810 | 867025 | 867816 | M. jannaschii predicted coding region MJ0768 | U67522 | Methanococcus jannaschii | 207 | 36 |
| ORF811 | 867820 | 868497 | putative | | | | |
| ORF812 | 869743 | 868661 | RecA | U16739 | Chlamydia trachomatis | 1512 | 87 |
| ORF813 | 870633 | 870094 | unknown function | Z32530 | Chlamydia trachomatis | 308 | 45 |
| ORF814 | 871929 | 870646 | unknown function | Z32530 | Chlamydia trachomatis | 1410 | 63 |
| ORF815 | 872538 | 872086 | putative | | | | |
| ORF816 | 873908 | 872517 | putative | | | | |
| ORF817 | 874281 | 874670 | nifR3-like gene product | Z37984 | Azospirillum brasilense | 181 | 32 |
| ORF818 | 874582 | 875286 | ORF1 gene product | X62399 | Escherichia coli | 307 | 42 |
| ORF819 | 877857 | 875377 | DNA topoisomerase I | L27797 | Bacillus subtilis | 1488 | 50 |
| ORF820 | 878446 | 879255 | putative | | | | |
| ORF821 | 880635 | 879268 | sigma factor (ntrA) (AA 1-502) | X05888 | Azotobacter vinelandii | 257 | 47 |
| ORF822 | 882524 | 880593 | DNA helicase II | D90906 | Synechocystis sp. | 1140 | 50 |
| ORF823 | 882612 | 883319 | ipa-57d gene product | X73124 | Bacillus subtilis | 601 | 51 |
| ORF824 | 884155 | 883538 | hypothetical protein | D90915 | Synechocystis sp. | 344 | 39 |
| ORF825 | 884340 | 885611 | 19/20 residue stretch (32–51) identical to N-terminal putative signal sequence of unknown, partly cloned B. subtilis gene.; putative | L19954 | Bacillus subtilis | 456 | 37 |

TABLE 1-continued

| ORF | Begin | End | Homology | ID | Species | Score | I % |
|---|---|---|---|---|---|---|---|
| ORF826 | 885722 | 887302 | heat shock protein | L12004 | Chlamydia trachomatis | 915 | 39 |
| ORF827 | 887587 | 888153 | bas1 protein | Z34917 | Hordeum vulgare | 474 | 50 |
| ORF828 | 888627 | 888220 | putative | | | | |
| ORF829 | 889330 | 888716 | hypothetical protein | Y14079 | Bacillus subtilis | 223 | 55 |
| ORF830 | 889898 | 889323 | peptidoglycan-associated lipoprotein | X65796 | Escherichia coli | 222 | 50 |
| ORF831 | 891190 | 889898 | TolB | U32470 | Haemophilus influenzae | 280 | 35 |
| ORF832 | 891828 | 891247 | putative | | | | |
| ORF833 | 892421 | 892017 | exbD peptide | M28819 | Escherichia coli | 77 | 48 |
| ORF834 | 893116 | 892421 | inner membrane protein (tolQ) | U32722 | Haemophilus influenzae | 157 | 54 |
| ORF835 | 892521 | 892925 | putative | | | | |
| ORF836 | 893392 | 895419 | inner membrane copper tolerance protein | Z36905 | Escherichia coli | 120 | 35 |
| ORF837 | 895745 | 896527 | unknown | D26185 | Bacillus subtilis | 381 | 41 |
| ORF838 | 896668 | 897558 | succinate dehydrogenase subunit C | Y08563 | Paenibacillus macerans | 253 | 40 |
| ORF839 | 897565 | 899442 | succinate dehydrogenase subunit A | Y08563 | Paenibacillus macerans | 1667 | 57 |
| ORF840 | 899420 | 900229 | succinate dehydrogenase subunit B | Y08563 | Paenibacillus macerans | 656 | 54 |
| ORF841 | 903230 | 900237 | putative | | | | |
| ORF842 | 905081 | 903234 | putative | | | | |
| ORF843 | 906931 | 905045 | sigma factor SibG regulation protein RsbU | D90905 | Synechocystis sp. | 117 | 35 |
| ORF844 | 907248 | 907832 | putative | | | | |
| ORF845 | 907784 | 908128 | putative | | | | |
| ORF846 | 908132 | 908677 | putative | | | | |
| ORF847 | 908589 | 909320 | putative | | | | |
| ORF848 | 909405 | 911465 | putative | | | | |
| ORF849 | 911677 | 912360 | putative | | | | |
| ORF850 | 912303 | 912821 | putative | | | | |
| ORF851 | 912937 | 913983 | putative | | | | |
| ORF852 | 915128 | 914067 | putative | | | | |
| ORF853 | 916658 | 915303 | enolase | L29475 | Bacillus subtilis | 1036 | 60 |
| ORF854 | 915627 | 915376 | enolase | U43738 | Mycoplasma pneumoniae | 226 | 65 |
| ORF855 | 917707 | 916853 | excinuclease ABC subunit B (uvrB) | U32804 | Haemophilus influenzae | 724 | 46 |
| ORF856 | 918837 | 917722 | excinuclease ABC subunit B (uvrB) | U32804 | Haemophilus influenzae | 1029 | 54 |
| ORF857 | 919868 | 918837 | tryptophanyl-tRNA synthetase (trpS) | U32746 | Haemophilus influenzae | 376 | 40 |
| ORF858 | 920434 | 919880 | putative | | | | |
| ORF859 | 921187 | 920438 | ORF8 | X82078 | Chlamydia sp. | 164 | 50 |
| ORF860 | 921959 | 921195 | hypothetical protein | X62475 | Chlamydia psittaci | 511 | 44 |
| ORF861 | 923773 | 921995 | Threonyl tRNA Synthetase | Z80360 | Bacillus subtilis | 1476 | 44 |
| ORF862 | 922146 | 922415 | putative | | | | |
| ORF863 | 923943 | 923674 | putative | | | | |
| ORF864 | 924077 | 925006 | putative | | | | |
| ORF865 | 925436 | 925083 | putative | | | | |
| ORF866 | 926524 | 925349 | putative | | | | |
| ORF867 | 927920 | 926433 | putative | | | | |
| ORF868 | 928319 | 927951 | putative | | | | |
| ORF869 | 928963 | 928334 | putative | | | | |
| ORF870 | 929248 | 930987 | DNA mismatch repair protein (mutL) | U32692 | Haemophilus influenzae | 585 | 40 |
| ORF871 | 930995 | 932059 | YqhT | D84432 | Bacillus subtilis | 445 | 39 |
| ORF872 | 932121 | 933515 | putative | | | | |
| ORF873 | 932881 | 932513 | putative | | | | |
| ORF874 | 933485 | 935746 | pulD (ttg start codon) | M32613 | Klebsiella pneumoniae | 210 | 33 |
| ORF875 | 935724 | 937082 | epsE | M96172 | Vibrio cholerae | 890 | 55 |
| ORF876 | 937229 | 938410 | PilG | U32588 | Neisseria gonorrhoeae | 280 | 38 |
| ORF877 | 938281 | 938805 | putative | | | | |
| ORF878 | 938809 | 939255 | putative | | | | |
| ORF879 | 939165 | 939782 | putative | | | | |
| ORF880 | 939760 | 940791 | putative | | | | |
| ORF881 | 940822 | 941106 | putative | | | | |
| ORF882 | 940977 | 941351 | putative | | | | |
| ORF883 | 942537 | 941623 | yscT | L25667 | Yersinia pseudotuberculosis | 169 | 44 |
| ORF884 | 942784 | 942500 | yscS | L25667 | Yersinia pseudotuberculosis | 173 | 42 |
| ORF885 | 943149 | 942799 | HrcR | AE000107 | Rhizobium sp. NGR234 | 265 | 52 |
| ORF886 | 943799 | 943029 | pathogenicity protein | M64094 | Xanthomonas campestris | 252 | 41 |
| ORF887 | 944055 | 943732 | putative | M74011 | Yersinia enterocolitica | 112 | 33 |
| ORF888 | 944413 | 943994 | putative | | | | |
| ORF889 | 945395 | 944556 | putative | | | | |
| ORF890 | 945853 | 945389 | putative | | | | |
| ORF891 | 946392 | 945751 | HrcJ | U56662 | Erwinia amylovora | 229 | 44 |
| ORF892 | 947410 | 948081 | putative | | | | |
| ORF893 | 949871 | 948915 | ORF YOR196c | Z75104 | Saccharomyces cerevisiae | 702 | 44 |
| ORF894 | 951058 | 949868 | dihydrolipoamide dehydrogenase E3 subunit | M57435 | Bacillus subtilis | 745 | 39 |
| ORF895 | 951249 | 950959 | dihydrolipoamide acetyltransferase E3 subunit | M73535 | Staphylococcus aureus | 166 | 49 |
| ORF896 | 951664 | 952134 | putative | | | | |
| ORF897 | 952674 | 952165 | SNF | X98455 | Bacillus aereus | 229 | 47 |

TABLE 1-continued

| ORF | Begin | End | Homology | ID | Species | Score | I % |
|---|---|---|---|---|---|---|---|
| ORF898 | 953491 | 952589 | helicase | U39680 | Mycoplasma genitalium | 307 | 42 |
| ORF899 | 955324 | 953495 | F01G4.1 | Z68341 | Caenorhabditis elegans | 133 | 57 |
| ORF900 | 955823 | 955281 | putative | | | | |
| ORF901 | 957082 | 955847 | branched-chain amino acid carrier | Z48676 | Lactobacillus delbrueckii | 297 | 40 |
| ORF902 | 957902 | 957270 | endonuclease III | U11289 | Bacillus subtilis | 317 | 37 |
| ORF903 | 959231 | 957906 | homologous to E. coli 50K | X62539 | Bacillus subtilis | 805 | 45 |
| ORF904 | 959376 | 960284 | phosphatidylserine decarboxylase | U72715 | Chlamydia trachomatis | 776 | 51 |
| ORF905 | 960266 | 961669 | putative | | | | |
| ORF906 | 961856 | 964765 | secretory component | U06928 | Caulobacter crescentus | 1812 | 55 |
| ORF907 | 966855 | 965395 | 28.2% of identity to the Escherichia coli GTP-binding protein Era; putative | L47648 | Bacillus subtilis | 778 | 41 |
| ORF908 | 968204 | 966975 | poly(A) polymerase | L47709 | Bacillus subtilis | 383 | 41 |
| ORF909 | 968791 | 968237 | ClpX-like protein | U18229 | Bacillus subtilis | 340 | 39 |
| ORF910 | 969498 | 968731 | ATP-dependent protease ATPase subunit | D64006 | Synechocystis sp. | 846 | 66 |
| ORF911 | 969858 | 969511 | ClpP | U16135 | Synechococcus sp. | 257 | 54 |
| ORF912 | 970118 | 969762 | ATP-dependent clp protease proteolytic component (clpP) | AE000591 | Helicobacter pylori | 362 | 63 |
| ORF913 | 970593 | 970300 | putative | | | | |
| ORF914 | 971261 | 970542 | putative | | | | |
| ORF915 | 971680 | 971123 | putative | | | | |
| ORF916 | 971876 | 975100 | SNF | X98455 | Bacillus cereus | 778 | 49 |
| ORF917 | 975419 | 976516 | MreB protein | M96343 | Bacillus subtilis | 960 | 55 |
| ORF918 | 976584 | 978320 | phospho enol pyruvate carboxykinase | S56812 | Chlorobium limicola | 1667 | 64 |
| ORF919 | 977680 | 977231 | putative | | | | |
| ORF920 | 978399 | 980738 | putative | | | | |
| ORF921 | 980756 | 981928 | putative | | | | |
| ORF922 | 982974 | 981931 | precursor protein (AA-22 to 371) | X52557 | Chlamydia trachomatis | 97 | 50 |
| ORF923 | 984120 | 983119 | NAD+ dependent glycerol-3-phosphate dehydrogenase | L47648 | Bacillus subtilis | 618 | 43 |
| ORF924 | 985502 | 984120 | AgX-1 antigen [human, infertile patient, testis, Peptide, 505 aa] | S73498 | Homo sapiens | 254 | 34 |
| ORF925 | 987180 | 985882 | ORF4 | M72718 | Bacillus subtilis | 697 | 38 |
| ORF926 | 987172 | 987444 | putative | | | | |
| ORF927 | 989846 | 989049 | nifU-like protein | AE000542 | Helicobacter pylori | 302 | 31 |
| ORF928 | 991048 | 989846 | putative | | | | |
| ORF929 | 991638 | 990955 | phosphoglyceromutase | L09651 | Zymomonas mobilis | 471 | 53 |
| ORF930 | 991794 | 992498 | ORFX13 | L09228 | Bacillus subtilis | 403 | 39 |
| ORF931 | 993619 | 993041 | biotin [acetyl-COA-carboxylase] ligase | L47709 | Bacillus subtilis | 136 | 38 |
| ORF932 | 993530 | 994792 | rod-shape-determining protein | M22857 | Escherichia coli | 312 | 44 |
| ORF933 | 995970 | 994795 | cadmium-transporting ATPase | D64005 | Synechocystis sp. | 358 | 47 |
| ORF934 | 996857 | 995739 | ATPase | L28104 | Transposon Tn5422 | 449 | 39 |
| ORF935 | 997603 | 996782 | putative | | | | |
| ORF936 | 998969 | 997572 | seryl-trna synthetase | Y09924 | Staphylococcus aureus | 851 | 42 |
| ORF937 | 998896 | 1000023 | orf2, homologue to B. subtilis ribG | X64395 | Escherichia coli | 596 | 40 |
| ORF938 | 1000087 | 1001340 | GTP cyclohydrolase II | D90912 | Synechocystis sp. | 1078 | 52 |
| ORF939 | 1001357 | 1001818 | riboflavin synthase beta subunit | U27202 | Actinobacillus pleuropneumoniae | 278 | 36 |
| ORF940 | 1003288 | 1001873 | putative | | | | |
| ORF941 | 1003487 | 1004146 | putative | | | | |
| ORF942 | 1004485 | 1005639 | D-alanine glycine permease (dagA) | AE000603 | Helicobacter pylori | 394 | 33 |
| ORF943 | 1005643 | 1005972 | hypothetical protein MTCY180.08 | Z97193 | Mycobacterium tuberculosis | 274 | 58 |
| ORF944 | 1006784 | 1006116 | similar to trithorax protein in final three exons | U13875 | Caenorhabditis elegans | 155 | 46 |
| ORF945 | 1007563 | 1006769 | yycJ | D78193 | Bacillus subtilis | 406 | 38 |
| ORF946 | 1009226 | 1007568 | YtpT | AF008220 | Bacillus subtilis | 992 | 47 |
| ORF947 | 1009989 | 1009336 | putative | | | | |
| ORF948 | 1015852 | 1016337 | putative | | | | |
| ORF949 | 1016561 | 1016181 | putative | | | | |
| ORF950 | 1016297 | 1017532 | putative | | | | |
| ORF951 | 1016802 | 1016452 | putative | | | | |
| ORF952 | 1018993 | 1017701 | phenolhydroxylase component | U32702 | Haemophilus influenzae | 909 | 47 |
| ORF953 | 1019454 | 1019137 | ORF | M63939 | Escherichia coli | 96 | 45 |
| ORF954 | 1020764 | 1019562 | pCTHom1 gene product | M94254 | Chlamydia trachomatis | 1185 | 65 |
| ORF955 | 1021405 | 1021037 | histone H1-like protein | M80324 | Chlamydia psittaci | 319 | 62 |
| ORF956 | 1021821 | 1024286 | phosphoprotein | L25078 | Chlamydia trachomatis | 739 | 41 |
| ORF957 | 1024697 | 1024248 | putative | | | | |
| ORF958 | 1025569 | 1024508 | protoporphyrinogen oxidase | U25114 | Mus musculus | 86 | 38 |
| ORF959 | 1026969 | 1025590 | oxygen independent coprophyrinogen III oxidase | D90912 | Synechocystis sp. | 880 | 42 |
| ORF960 | 1027789 | 1026947 | uroporphyrinogen decarboxylase | M97208 | Bacillus subtilis | 372 | 38 |
| ORF961 | 1031199 | 1027945 | transcription-repair coupling factor (trcF) (mfd) | U32805 | Haemophilus influenzae | 1584 | 42 |
| ORF962 | 1031717 | 1031172 | alanyl-tRNA synthetase | X95571 | Thiobacillus ferrooxidans | 76 | 31 |

TABLE 1-continued

| ORF | Begin | End | Homology | ID | Species | Score | I % |
|---|---|---|---|---|---|---|---|
| ORF963 | 1033057 | 1031612 | alanyl-tRNA synthetase | AE000353 | Escherichia coli | 889 | 40 |
| ORF964 | 1033425 | 1033039 | alanyl-tRNA synthetase (alaS) | AE000629 | Helicobacter pylori | 327 | 51 |
| ORF965 | 1033784 | 1033200 | alanyl-tRNA synthetase | X59956 | Rhizobium leguminosarum | 416 | 47 |
| ORF966 | 1033963 | 1036038 | transketolase | Z73234 | Bacillus subtilis | 1398 | 44 |
| ORF967 | 1036945 | 1036010 | AMP nucleosidase | AE000290 | Escherichia coli | 265 | 42 |
| ORF968 | 1037110 | 1037679 | elongation factor P | U140003 | Escherichia coli | 458 | 51 |
| ORF969 | 1037696 | 1037944 | putative | | | | |
| ORF970 | 1038916 | 1037975 | putative | | | | |
| ORF971 | 1040582 | 1039026 | HSP60 chaperonin | X62914 | Clostridium perfringens | 284 | 31 |
| ORF972 | 1040997 | 1042337 | PROBABLE UDP-N-ACETYLMURAMOYLAL ANYL-D-GLUTAMYL-2, 6-DIAMINOLIGASE (EC 6.3.2.15). | AB001488 | Bacillus subtilis | 446 | 39 |
| ORF973 | 1042357 | 1043403 | ORF-Y (AA 1-360) | X51584 | Escherichia coli | 582 | 45 |
| ORF974 | 1043367 | 1044623 | UDP-N-acetylmuramoylalanine-D-glutamate ligase (murD) | U32793 | Haemophilus influenzae | 348 | 42 |
| ORF975 | 1044607 | 1045362 | hypothetical protein | Y14079 | Bacillus subtilis | 115 | 38 |
| ORF976 | 1045384 | 1046538 | spoVE gene product (AA 1-366) | X51419 | Bacillus subtilis | 479 | 35 |
| ORF977 | 1046447 | 1047517 | mur | Y13922 | Enterococcus hirae | 256 | 45 |
| ORF978 | 1047521 | 1049956 | UDP-N-acetylmuramate-alanine ligase (murC) | U32794 | Haemophilus influenzae | 756 | 38 |
| ORF979 | 1050611 | 1050036 | unknown | Z74024 | Mycobacterium tuberculosis | 78 | 44 |
| ORF980 | 1050925 | 1050566 | cycY gene product | U14003 | Escherichia coli | 179 | 34 |
| ORF981 | 1051728 | 1051090 | putative | | | | |
| ORF982 | 1051743 | 1052063 | hypothetical protein | D90908 | Synechocystis sp. | 135 | 33 |
| ORF983 | 1052101 | 1053126 | trna delta(2)-isopentenylpyrophosphate transferase | Z98209 | Mycobacterium tuberculosis | 441 | 37 |
| ORF984 | 1054201 | 1053107 | conserved hypothetical protein | AE000579 | Helicobacter pylori | 826 | 44 |
| ORF985 | 1054242 | 1055555 | putative | | | | |
| ORF986 | 1055483 | 1055908 | putative | | | | |
| ORF987 | 1056609 | 1056965 | YqeL | D84432 | Bacillus subtilis | 202 | 38 |
| ORF988 | 1056961 | 1058232 | beta-ketoacyl-ACP synthase | L13242 | Ricinus communis | 1266 | 55 |
| ORF989 | 1058238 | 1058687 | diadenosine tetraphosphatase | U30313 | Homo sapiens | 122 | 42 |
| ORF990 | 1059371 | 1058727 | inorganic pyrophosphatase (ppa) | AE000576 | Helicobacter pylori | 209 | 39 |
| ORF991 | 1059526 | 1060578 | leucine dehydrogenase LeuDH | U51099 | Bacillus cereus | 680 | 45 |
| ORF992 | 1061553 | 1060579 | 3'(2'),5'-bisphosphate nucleotidase | U40433 | Arabidopsis thaliana | 335 | 43 |
| ORF993 | 1061674 | 1062411 | putative | | | | |
| ORF994 | 1062377 | 1064077 | 2-acylglycerophosphoethanolamine acyl transferase/acyl carrier protein synthetase | U29581 | Escherichia coli | 383 | 44 |
| ORF995 | 1064116 | 1065243 | 7-keto-8-aminopelargonic acid synthetase (bioF) | M29291 | Bacillus sphaericus | 200 | 35 |
| ORF996 | 1067451 | 1065178 | priA | Y10304 | Bacillus subtilis | 1009 | 43 |
| ORF997 | 1068065 | 1067376 | putative | | | | |
| ORF998 | 1068209 | 1068706 | putative | | | | |
| ORF999 | 1069958 | 1068819 | unknown | U41759 | Chlamydia psittaci | 777 | 41 |
| ORF1000 | 1071163 | 1070033 | unknown | U41759 | Chlamydia psittaci | 381 | 36 |
| ORF1001 | 1072438 | 1071332 | unknown | U41759 | Chlamydia psittaci | 254 | 37 |
| ORF1002 | 1072997 | 1073476 | putative | | | | |
| ORF1003 | 1074239 | 1075864 | lysyl-tRNA synthetase | D90906 | Synechocystis sp. | 1007 | 48 |
| ORF1004 | 1076790 | 1075867 | cysteinyl-tRNA synthetase | L14580 | Bacillus subtilis | 395 | 52 |
| ORF1005 | 1077268 | 1076573 | cys-tRNA synthetase (cysS) | U32693 | Haemophilus influenzae | 431 | 56 |
| ORF1006 | 1077999 | 1078724 | putative | | | | |
| ORF1007 | 1079088 | 1078672 | ribonuclease P protein component (gtg start codon) | M11056 | Escherichia coli | 78 | 46 |
| ORF1008 | 1079642 | 1079944 | 30S ribosomal subunit protein S14 | U18997 | Escherichia coli | 260 | 50 |
| ORF1009 | 1080501 | 1079995 | F18C12.2 | Z75536 | Caenorhabditis elegans | 118 | 38 |
| ORF1010 | 1080775 | 1081341 | putative | | | | |
| ORF1011 | 1083158 | 1081350 | deoxyribodipyrimidine photolyase | J03294 | Bacillus subtilis | 687 | 44 |
| ORF1012 | 1084677 | 1083235 | DNA mismatch repair protein | U71154 | Aquifex pyrophilus | 735 | 48 |
| ORF1013 | 1085648 | 1084632 | DNA mismatch repair protein | D90909 | Synechocystis sp. | 565 | 39 |
| ORF1014 | 1086117 | 1086737 | DNA primase (dnaG) | U32735 | Haemophilus influenzae | 303 | 40 |
| ORF1015 | 1086692 | 1087897 | DnaG | Z83860 | Mycobacterium tuberculosis | 222 | 37 |
| ORF1016 | 1088646 | 1089005 | putative | | | | |
| ORF1017 | 1089146 | 1089805 | putative | | | | |
| ORF1018 | 1092931 | 1089890 | glycyl-tRNA synthetase | U20547 | Chlamydia trachomatis | 2569 | 48 |
| ORF1019 | 1093179 | 1092889 | putative | | | | |
| ORF1020 | 1093584 | 1094204 | phosphatidylglycerophosphate synthase | U87792 | Bacillus subtilis | 163 | 55 |
| ORF1021 | 1095619 | 1094192 | glycogen (starch) synthase | D90899 | Synechocystis sp. | 574 | 40 |
| ORF1022 | 1096074 | 1096628 | partial ctc gene product (AA 1-186) | X16518 | Bacillus subtilis | 86 | 37 |
| ORF1023 | 1096633 | 1097082 | peptidyl-tRNA hydrolase | U31570 | Chlamydia trachomatis | 378 | 53 |
| ORF1024 | 1097266 | 1097601 | ribosomal protein S6 (rps6) | AE000630 | Helicobacter pylori | 179 | 39 |
| ORF1025 | 1097622 | 1097867 | ribosomal protein S18 homolog; putative | M62820 | Chlamydia trachomatis | 324 | 86 |

TABLE 1-continued

| ORF | Begin | End | Homology | ID | Species | Score | I % |
|---|---|---|---|---|---|---|---|
| ORF1026 | 1097886 | 1098392 | putative heat shock protein ORF; putative | M62820 | Chlamydia trachomatis | 190 | 79 |
| ORF1027 | 1699521 | 1099279 | putative | | | | |
| ORF1028 | 1099689 | 1101053 | putative | | | | |
| ORF1029 | 1102192 | 1101107 | putative | | | | |
| ORF1030 | 1104950 | 1102116 | glycerol-3-phosphate acyltransferase | M80571 | Cucumis sativus | 574 | 43 |
| ORF1031 | 1106508 | 1104946 | ORF_f495; orfF of ECMRED, uses 2nd start | U18997 | Escherichia coli | 855 | 38 |
| ORF1032 | 1106722 | 1107249 | putative | | | | |
| ORF1033 | 1107463 | 1108101 | PlsX | U59433 | Bacillus subtilis | 282 | 45 |
| ORF1034 | 1108041 | 1108421 | fatty acid/phospholipid synthesis protein (plsX) | AE000540 | Helicobacter pylori | 205 | 35 |
| ORF1035 | 1108520 | 1113370 | putative 98 kDa outer membrane protein | U72499 | Chlamydia psittaci | 352 | 44 |
| ORF1036 | 1114958 | 1113447 | putative | | | | |
| ORF1037 | 1116915 | 1115071 | lipid A disaccharide synthetase (lpxB) | U32786 | Haemophilus influenzae | 477 | 42 |
| ORF1038 | 1118183 | 1116894 | poly(A) polymerase | AE000123 | Escherichia coli | 555 | 46 |
| ORF1039 | 1118846 | 1120030 | putative | L12968 | Escherichia coli | 880 | 50 |
| ORF1040 | 1120040 | 1120522 | glucosamine fructose-6-phosphate aminotransferase (isomerizing) (glmS) | AE000651 | Helicobacter pylori | 396 | 52 |
| ORF1041 | 1120510 | 1121430 | glutamine amidotransferase; glucosamine-fructose-6-phosphate aminotransferase | AE000450 | Escherichia coli | 494 | 44 |
| ORF1042 | 1121321 | 1121866 | L-glutamine: D-fructose-6-P amidotransferase precursor | U17352 | Thermus aquaticus thermophilus | 374 | 50 |
| ORF1043 | 1122123 | 1122899 | tyrosine-specific transport protein | AE000284 | Escherichia coli | 281 | 41 |
| ORF1044 | 1124842 | 1125564 | putative | | | | |
| ORF1045 | 1126526 | 1125579 | cell division protein (ftsY) | U32760 | Haemophilus influenzae | 497 | 41 |
| ORF1046 | 1126519 | 1127676 | succinyl-CoA synthetase beta-subunit | J01619 | Escherichia coli | 784 | 43 |
| ORF1047 | 1127672 | 1128571 | succinyl coenzyme A synthetase alpha subunit | U23408 | Dictyostelium discoideum | 978 | 63 |
| ORF1048 | 1130230 | 1131336 | putative | | | | |
| ORF1049 | 1131480 | 1132553 | putative | | | | |
| ORF1050 | 1132830 | 1133843 | putative | | | | |
| ORF1051 | 1134121 | 1134855 | serine protease HtrA | D90905 | Synechocystis sp. | 307 | 51 |
| ORF1052 | 1134642 | 1135592 | GsrA protein | D78376 | Yersinia enterocolitica | 497 | 41 |
| ORF1053 | 1135964 | 1135653 | putative | | | | |
| ORF1054 | 1137132 | 1135954 | R11H6.1 | Z93386 | Caenorhabditis elegans | 445 | 37 |
| ORF1055 | 1137169 | 1140102 | Ydr430cp; CAI: 0.15 | U33007 | Saccharomyces cerevisiae | 559 | 40 |
| ORF1056 | 1141365 | 1140112 | hypothetical 54.7 kD protein in udp 3' region precursor (o475) | AE000459 | Escherichia coli | 222 | 34 |
| ORF1057 | 1142150 | 1141356 | phosphatidylserine synthase (pssA) | AE000614 | Helicobacter pylori | 307 | 41 |
| ORF1058 | 1142520 | 1145660 | ribonucleotide reductase subunit M1 | K02927 | Mus musculus | 1433 | 45 |
| ORF1059 | 1145627 | 1146721 | ribonucleoside diphosphate reductase, beta subunit (nrdB) | AE000553 | Helicobacter pylori | 443 | 32 |
| ORF1060 | 1146862 | 1147545 | unknown | Z95398 | Mycobacterium leprae | 191 | 35 |
| ORF1061 | 1147666 | 1148190 | YtqB | AF008220 | Bacillus subtilis | 262 | 44 |
| ORF1062 | 1148514 | 1148224 | ORF2 | U01958 | Bacillus licheniformis | 135 | 54 |
| ORF1063 | 1149136 | 1148348 | ORF2 | M31827 | Bacillus subtilis | 268 | 40 |
| ORF1064 | 1149702 | 1149166 | putative | | | | |
| ORF1065 | 1150031 | 1150591 | unknown | Z85982 | Mycobacterium tuberculosis | 445 | 49 |
| ORF1066 | 1150785 | 1151147 | ribosomal protein L20 (AA 1-119) | X16188 | Bacillus stearothermophilus | 273 | 44 |
| ORF1067 | 1151165 | 1152181 | phenylalany-tRNA synthetase beta subunit | Z75208 | Bacillus subtilis | 777 | 40 |
| ORF1068 | 1152522 | 1154591 | putative | | | | |
| ORF1069 | 1155666 | 1154566 | putative | | | | |
| ORF1070 | 1156743 | 1155670 | putative | | | | |
| ORF1071 | 1156859 | 1157815 | hypothetical | U32723 | Haemophilus influenzae | 252 | 42 |
| ORF1072 | 1157982 | 1160735 | ATP-binding protein | U01376 | Escherichia coli | 1314 | 56 |
| ORF1073 | 1162620 | 1160917 | polynucleotide phosphorylase | AF010578 | Pisum sativum | 1416 | 52 |
| ORF1074 | 1162970 | 1162590 | polyribonucleotide phophorylase | U52048 | Spinacia oleracea | 312 | 53 |
| ORF1075 | 1163532 | 1164020 | orf150 gene product | X95938 | Porphyromonas gingivalis | 335 | 43 |
| ORF1076 | 1163995 | 1164294 | putative | | | | |
| ORF1077 | 1165569 | 1165030 | putative | | | | |
| ORF1078 | 1166108 | 1165566 | putative | | | | |
| ORF1079 | 1166644 | 1166141 | putative | | | | |
| ORF1080 | 1167055 | 1168374 | putative | | | | |
| ORF1081 | 1169218 | 1168337 | methionine aminopeptidase | D64003 | Synechocystis sp. | 488 | 54 |
| ORF1082 | 1169823 | 1169218 | ORF_o197 | U18997 | Escherichia coli | 281 | 30 |
| ORF1083 | 1171324 | 1170572 | putative | | | | |
| ORF1084 | 1172085 | 1171177 | hypothetical | U32720 | Haemophilus influenzae | 162 | 44 |
| ORF1085 | 1172394 | 1173773 | fumarase | D64000 | Synechocystis sp. | 1292 | 57 |
| ORF1086 | 1175209 | 1173881 | prs-associated putative membrane protein | U02424 | Escherichia coli | 570 | 39 |

TABLE 1-continued

| ORF | Begin | End | Homology | ID | Species | Score | I % |
|---|---|---|---|---|---|---|---|
| ORF1087 | 1175555 | 1175127 | hypothetical protein in pth-prs intergenic region | AE000219 | Escherichia coli | 278 | 46 |
| ORF1088 | 1175778 | 1177043 | hypothetical protein | Z96072 | Mycobacterium tuberculosis | 109 | 43 |
| ORF1089 | 1177177 | 1179048 | putative | | | | |
| ORF1090 | 1179156 | 1180085 | penicillin tolerance protein (lytB) | U32781 | Haemophilus influenzae | 731 | 54 |
| ORF1091 | 1180045 | 1180779 | putative | | | | |
| ORF1092 | 1181942 | 1180788 | putative | | | | |
| ORF1093 | 1182296 | 1181961 | putative | | | | |
| ORF1094 | 1183844 | 1182300 | putative | | | | |
| ORF1095 | 1184420 | 1183848 | putative | | | | |
| ORF1096 | 1185382 | 1184366 | putative | | | | |
| ORF1097 | 1185858 | 1185226 | putative | | | | |
| ORF1098 | 1186164 | 1186481 | putative | | | | |
| ORF1099 | 1187386 | 1186484 | site-specific recombinase | U92524 | Salmonella typhimurium | 401 | 48 |
| ORF1100 | 1187370 | 1189028 | phophoglucoisomerase-like protein | L40822 | Chlamydia trachomatis | 1154 | 63 |
| ORF1101 | 1189321 | 1190889 | putative | | | | |
| ORF1102 | 1191142 | 1192146 | NADP-malate dehydrogenase | L40958 | Flaveria bidentis | 775 | 46 |
| ORF1103 | 1191974 | 1191729 | putative | | | | |
| ORF1104 | 1193815 | 1192991 | putative | | | | |
| ORF1105 | 1195702 | 1194248 | o460; This 460 aa orf is 46 pct identical (26 gaps) to 458 residues of an approx. 488 aa protein ARCD_PSEAE SW: P18275 | AE000256 | Escherichia coli | 1022 | 44 |
| ORF1106 | 1196303 | 1195716 | putative | | | | |
| ORF1107 | 1196831 | 1196337 | putative | | | | |
| ORF1108 | 1197807 | 1196746 | putative | | | | |
| ORF1109 | 1198740 | 1197883 | putative | | | | |
| ORF1110 | 1200232 | 1198721 | shikimate 5-dehydrogenase | U67551 | Methanococcus jannaschii | 245 | 37 |
| ORF1111 | 1201286 | 1200135 | 3-dehydroquinate synthase (aroB) | U32705 | Haemophilus influenzae | 478 | 45 |
| ORF1112 | 1202386 | 1201259 | 2,3-dihydroxybenzoic acid | L29562 | Vibrio anguillarum | 780 | 50 |
| ORF1113 | 1202901 | 1202350 | putative | | | | |
| ORF1114 | 1204162 | 1202816 | 5-enolpyruvylshikimate 3-phosphate synthase | U67500 | Methanococcus jannaschii | 520 | 40 |
| ORF1115 | 1203177 | 1203464 | putative | | | | |
| ORF1116 | 1205028 | 1204180 | putative | | | | |
| ORF1117 | 1206392 | 1204878 | bioA gene product | A02587 | unidentified | 834 | 48 |
| ORF1118 | 1206742 | 1206086 | dethiobiotin synthase (bioD) | U32830 | Haemophilus influenzae | 243 | 37 |
| ORF1119 | 1207872 | 1206724 | L-alanine-pimelyl CoA ligase | U51868 | Bacillus subtilis | 601 | 41 |
| ORF1120 | 1208852 | 1207851 | biotin sythase | U24147 | Arabidopsis thaliana | 892 | 52 |
| ORF1121 | 1210518 | 1209742 | tryptophan hydroxylase | U26428 | Gallus gallus | 237 | 34 |
| ORF1122 | 1210703 | 1211494 | dihydrodipicolinate reductase | U47017 | Pseudomonas syringae pv. tabaci | 345 | 37 |
| ORF1123 | 1211870 | 1212754 | aspartate-semialdehyde dehydrogenase | U67476 | Methanococcus jannaschii | 444 | 43 |
| ORF1124 | 1212742 | 1214064 | aspartokinase III | U00006 | Escherichia coli | 473 | 47 |
| ORF1125 | 1214046 | 1214858 | dihydrodipicolinate synthase | D64006 | Synechocystis sp. | 238 | 40 |
| ORF1126 | 1215551 | 1216318 | putative | | | | |
| ORF1127 | 1216493 | 1216849 | putative | | | | |
| ORF1128 | 1217183 | 1219612 | putative | | | | |
| ORF1129 | 1220068 | 1219673 | putative | | | | |
| ORF1130 | 1219710 | 1220669 | putative | | | | |
| ORF1131 | 1220630 | 1221376 | putative | | | | |
| ORF1132 | 1221645 | 1223681 | unknown | D26185 | Bacillus subtilis | 621 | 43 |
| ORF1133 | 1223894 | 1224988 | putative | | | | |
| ORF1134 | 1225000 | 1225830 | high level kasgamycin resistance | D26185 | Bacillus subtilis | 422 | 41 |
| ORF1135 | 1227810 | 1225879 | hypothetical protein | D90903 | Synechocystis sp. | 1129 | 43 |
| ORF1136 | 1226528 | 1226908 | putative | | | | |
| ORF1137 | 1229972 | 1228311 | exonuclease VII, large subunit (xseA) | U32723 | Haemophilus influenzae | 666 | 46 |
| ORF1138 | 47569 | 47018 | Integrase/recombinase | AE001308 | Chlamydia trachomatis | 716 | 72 |
| ORF1139 | 49980 | 49117 | putative | | | | |
| ORF1140 | 53356 | 52898 | putative | | | | |
| ORF1141 | 54477 | 54884 | O-Sialoglycoprotein Endopeptidase | AE001307 | Chlamydia trachomatis | 311 | 51 |
| ORF1142 | 63753 | 63998 | PTS PEP Phosphotransferase | AE001306 | Chlamydia trachomatis | 198 | 61 |
| ORF1143 | 77164 | 77487 | putative | | | | |
| ORF1144 | 79724 | 79302 | Sms Protein | AE001302 | Chlamydia trachomatis | 458 | 57 |
| ORF1145 | 88721 | 88951 | putative | | | | |
| ORF1146 | 94067 | 94429 | putative | | | | |
| ORF1147 | 122832 | 123341 | hypothetical protein | AE001303 | Chlamydia trachomatis | 398 | 61 |
| ORF1148 | 147536 | 147234 | putative | | | | |
| ORF1149 | 158990 | 159346 | S16 Ribosomal Protein | AE001277 | Chlamydia trachomatis | 467 | 78 |
| ORF1150 | 168470 | 168979 | putative | | | | |
| ORF1151 | 169183 | 169452 | putative | | | | |
| ORF1152 | 171785 | 171504 | Cationic Amino Acid Transporter | AE001278 | Chlamydia trachomatis | 262 | 68 |
| ORF1153 | 172518 | 171775 | Cationic Amino Acid Transporter | AE001278 | Chlamydia trachomatis | 533 | 48 |
| ORF1154 | 193599 | 194045 | putative | | | | |
| ORF1155 | 195704 | 196075 | S/T Protein Kinase | AE001288 | Chlamydia trachomatis | 536 | 82 |
| ORF1156 | 210687 | 210145 | KDO-transferase | X80061 | Chlamydia pneumoniae | 856 | 96 |

TABLE 1-continued

| ORF | Begin | End | Homology | ID | Species | Score | I % |
|---|---|---|---|---|---|---|---|
| ORF1157 | 211100 | 210708 | putative | | | | |
| ORF1158 | 215420 | 215088 | putative | | | | |
| ORF1159 | 217914 | 218246 | putative | | | | |
| ORF1160 | 218925 | 218701 | putative | | | | |
| ORF1161 | 223785 | 223525 | IMP dehydrogenase | U13372 | *Borrelia burgdorferi* | 270 | 63 |
| ORF1162 | 224271 | 223999 | putative | | | | |
| ORF1163 | 228691 | 228407 | putative | | | | |
| ORF1164 | 235050 | 235334 | (Methylase) | AE001287 | *Chlamydia trachomatis* | 331 | 66 |
| ORF1165 | 252308 | 253021 | Oligopeptide Permease | AE001293 | *Chlamydia trachomatis* | 838 | 72 |
| ORF1166 | 258280 | 258912 | Dicarboxylate Translocator | AE001294 | *Chlamydia trachomatis* | 909 | 80 |
| ORF1167 | 261325 | 261567 | putative | | | | |
| ORF1168 | 268195 | 268878 | hypothetical protein | AE001287 | *Chlamydia trachomatis* | 556 | 52 |
| ORF1169 | 269447 | 268881 | putative | | | | |
| ORF1170 | 271263 | 271538 | putative | | | | |
| ORF1171 | 271957 | 272346 | putative | | | | |
| ORF1172 | 274176 | 274550 | putative | | | | |
| ORF1173 | 275736 | 275314 | Disulfide bond Oxidoreductase | AE001291 | *Chlamydia trachomatis* | 519 | 73 |
| ORF1174 | 276490 | 276927 | hypothetical protein | AE001291 | *Chlamydia trachomatis* | 249 | 53 |
| ORF1175 | 277577 | 277861 | hypothetical protein | AE001291 | *Chlamydia trachomatis* | 256 | 52 |
| ORF1176 | 288163 | 287909 | putative | | | | |
| ORF1177 | 290130 | 289789 | putative | | | | |
| ORF1178 | 290989 | 291225 | putative | | | | |
| ORF1179 | 291372 | 291860 | adenylate cyclase | AE001286 | *Chlamydia trachomatis* | 388 | 48 |
| ORF1180 | 311239 | 311622 | putative | | | | |
| ORF1181 | 328665 | 328384 | putative | | | | |
| ORF1182 | 337348 | 338289 | sodium-dependent transporter | AF017105 | *Chlamydia psittaci* | 1112 | 72 |
| ORF1183 | 364764 | 364369 | Prolipoprotein Diacylglycerol Transferase | AE001298 | *Chlamydia trachomatis* | 300 | 54 |
| ORF1184 | 389623 | 390135 | hypothetical protein | AE001282 | *Chlamydia trachomatis* | 75 | 33 |
| ORF1185 | 393729 | 394343 | ABC superfamily ATPase | AE001282 | *Chlamydia trachomatis* | 473 | 52 |
| ORF1186 | 407379 | 407621 | putative | | | | |
| ORF1187 | 410944 | 410708 | putative | | | | |
| ORF1188 | 427632 | 427988 | putative | | | | |
| ORF1189 | 428172 | 428486 | putative | | | | |
| ORF1190 | 436761 | 437246 | hypothetical protein | AE001279 | *Chlamydia trachomatis* | 661 | 81 |
| ORF1191 | 460911 | 461159 | putative | | | | |
| ORF1192 | 477597 | 477313 | hypothetical protein | AE001300 | *Chlamydia trachomatis* | 309 | 62 |
| ORF1193 | 487303 | 487001 | putative | | | | |
| ORF1194 | 487764 | 487534 | Glycine Cleavage System H Protein | AE001300 | *Chlamydia trachomatis* | 221 | 67 |
| ORF1195 | 498502 | 499017 | hypothetical protein | AE001275 | *Chlamydia trachomatis* | 206 | 32 |
| ORF1196 | 499795 | 500466 | putative | | | | |
| ORF1197 | 571928 | 572344 | putative | | | | |
| ORF1198 | 572367 | 572131 | putative | | | | |
| ORF1199 | 588184 | 587915 | hypothetical protein | AE001312 | *Chlamydia trachomatis* | 256 | 62 |
| ORF1200 | 600587 | 600907 | (Metalloenzyme) | AE001316 | *Chlamydia trachomatis* | 314 | 61 |
| ORF1201 | 609731 | 608895 | putative | | | | |
| ORF1202 | 614039 | 614755 | hypothetical protein | AE001317 | *Chlamydia trachomatis* | 475 | 46 |
| ORF1203 | 614823 | 615152 | putative | | | | |
| ORF1204 | 638244 | 638831 | ABC Transporter ATPase | AE001315 | *Chlamydia trachomatis* | 614 | 61 |
| ORF1205 | 638819 | 639094 | (Metal Transport Protein) | AE001315 | *Chlamydia trachomatis* | 265 | 63 |
| ORF1206 | 639073 | 639636 | (Metal Transport Protein) | AE001315 | *Chlamydia trachomatis* | 687 | 69 |
| ORF1207 | 647901 | 648236 | hypothetical protein | AE001317 | *Chlamydia trachomatis* | 139 | 38 |
| ORF1208 | 678510 | 679469 | phosphohydrolase | AE001320 | *Chlamydia trachomatis* | 995 | 63 |
| ORF1209 | 688178 | 688732 | hypothetical protein | AE001320 | *Chlamydia trachomatis* | 366 | 43 |
| ORF1210 | 696045 | 696563 | methyltransferase | AE001321 | *Chlamydia trachomatis* | 369 | 49 |
| ORF1211 | 708998 | 708588 | Glucose-1-P Adenyltransferase | AE001322 | *Chlamydia trachomatis* | 507 | 83 |
| ORF1212 | 709808 | 710089 | putative | | | | |
| ORF1213 | 718240 | 717737 | Glycerol-3-P Phosphatidyltransferase | AE001323 | *Chlamydia trachomatis* | 573 | 66 |
| ORF1214 | 737828 | 737565 | S19 Ribosomal Protein | AE001323 | *Chlamydia trachomatis* | 439 | 94 |
| ORF1215 | 779502 | 780257 | hypothetical protein | AE001322 | *Chlamydia trachomatis* | 476 | 48 |
| ORF1216 | 806310 | 805864 | hypothetical protein | AE001337 | *Chlamydia trachomatis* | 512 | 67 |
| ORF1217 | 820931 | 820707 | putative | | | | |
| ORF1218 | 837696 | 839096 | Exodeoxyribonuclease V, Gamma | AE001334 | *Chlamydia trachomatis* | 967 | 49 |
| ORF1219 | 883307 | 883549 | putative | | | | |
| ORF1220 | 892010 | 891726 | putative | | | | |
| ORF1221 | 893277 | 893564 | putative | | | | |
| ORF1222 | 936998 | 937225 | Gen. Secretion Protein E | AE001327 | *Chlamydia trachomatis* | 256 | 67 |
| ORF1223 | 946865 | 947419 | putative | | | | |
| ORF1224 | 975187 | 975411 | SWF/SNF family helicase | AE001341 | *Chlamydia trachomatis* | 363 | 96 |
| ORF1225 | 985882 | 985517 | hypothetical protein | AE001342 | *Chlamydia trachomatis* | 166 | 33 |
| ORF1226 | 987713 | 987180 | hypothetical protein | AE001342 | *Chlamydia trachomatis* | 447 | 59 |
| ORF1227 | 988215 | 987733 | Flagellar M-Ring Protein | AE001342 | *Chlamydia trachomatis* | 304 | 44 |
| ORF1228 | 988754 | 988530 | Flagellar M-Ring Protein | AE001342 | *Chlamydia trachomatis* | 92 | 36 |
| ORF1229 | 992542 | 992841 | hypothetical protein | AE001343 | *Chlamydia trachomatis* | 112 | 39 |
| ORF1230 | 992759 | 993067 | hypothetical protein | AE001343 | *Chlamydia trachomatis* | 100 | 32 |
| ORF1231 | 1004247 | 1004528 | D-Ala/Gly Permease | AE001344 | *Chlamydia trachomatis* | 283 | 64 |
| ORF1232 | 1015013 | 1014294 | 235aa long hypothetical protein | AB009472 | *Pyrococcus horikoshii* | 104 | 54 |

TABLE 1-continued

| ORF | Begin | End | Homology | ID | Species | Score | I % |
|---|---|---|---|---|---|---|---|
| ORF1233 | 1056147 | 1056545 | putative | | | | |
| ORF1234 | 1077682 | 1078035 | predicted disulfide bond isomerase | AE001351 | Chlamydia trachomatis | 233 | 46 |
| ORF1235 | 1088121 | 1088381 | putative | | | | |
| ORF1236 | 1098430 | 1098852 | Predicted Kinase | AE001352 | Chlamydia trachomatis | 384 | 59 |
| ORF1237 | 1098798 | 1099319 | Predicted Kinase | AE001352 | Chlamydia trachomatis | 322 | 45 |
| ORF1238 | 1123198 | 1123515 | Transport Permease | AE001354 | Chlamydia trachomatis | 313 | 72 |
| ORF1239 | 1123606 | 1124256 | Tyrosine Transport | AE001354 | Chlamydia trachomatis | 577 | 58 |
| ORF1240 | 1124453 | 1124797 | Tyrosine Transport | AE001354 | Chlamydia trachomalis | 323 | 50 |
| ORF1241 | 1129253 | 1129567 | putative | | | | |
| ORF1242 | 1164947 | 1164474 | hypothetical protein | AE001357 | Chlamydia trachomatis | 412 | 56 |
| ORF1243 | 1170457 | 1170053 | hypothetical protein | AE001358 | Chlamydia trachomatis | 283 | 59 |
| ORF1244 | 1172342 | 1171863 | ABC transporter permease | AE001358 | Chlamydia trachomatis | 457 | 55 |
| ORF1245 | 1192155 | 1192835 | putative | | | | |
| ORF1246 | 1192759 | 1192992 | putative | | | | |
| ORF1247 | 1193861 | 1194142 | putative | | | | |
| ORF1248 | 1194036 | 1193779 | (D-Amino Acid Dehydrogenase) | AE001311 | Chlamydia trachomatis | 269 | 79 |
| ORF1249 | 1209748 | 1209053 | conserved hypothetical protein | AE000958 | Archaeoglobus fulgidus | 121 | 38 |
| ORF1250 | 1215111 | 1215419 | putative | | | | |
| ORF1251 | 1216302 | 1216538 | putative | | | | |
| ORF1252 | 1228072 | 1227818 | hypothetical protein | AE001306 | Chlamydia trachomatis | 134 | 39 |
| ORF1253 | 1228304 | 1228080 | xseB | AL021897 | Mycobacterium tuberculosis | 89 | 33 |
| ORF1254 | 26599 | 26222 | putative | | | | |
| ORF1255 | 27609 | 27367 | putative | | | | |
| ORF1256 | 67206 | 66967 | putative | | | | |
| ORF1257 | 70612 | 70352 | putative | | | | |
| ORF1258 | 132703 | 132945 | putative | | | | |
| ORF1259 | 178073 | 178393 | putative | | | | |
| ORF1260 | 208576 | 208349 | putative | | | | |
| ORF1261 | 209156 | 208929 | putative | | | | |
| ORF1262 | 209263 | 209024 | putative | | | | |
| ORF1263 | 210304 | 210639 | putative | | | | |
| ORF1264 | 299009 | 299452 | putative | | | | |
| ORF1265 | 352106 | 351717 | putative | | | | |
| ORF1266 | 420182 | 419949 | Flagellar Secretion Protein | AE001280 | Chlamydia trachomatis | 115 | 43 |
| ORF1267 | 553602 | 553381 | putative | | | | |
| ORF1268 | 556538 | 556807 | putative | | | | |
| ORF1269 | 594348 | 593797 | putative | | | | |
| ORF1270 | 595169 | 594876 | putative | | | | |
| ORF1271 | 662148 | 662381 | putative | | | | |
| ORF1272 | 706528 | 706893 | putative | | | | |
| ORF1273 | 803315 | 803650 | putative | | | | |
| ORF1274 | 849551 | 849306 | putative | | | | |
| ORF1275 | 913676 | 913275 | putative | | | | |
| ORF1276 | 927087 | 926836 | putative | | | | |
| ORF1277 | 930587 | 930360 | putative | | | | |
| ORF1278 | 986531 | 986764 | ORF12 | M72718 | Bacillus subtilis | 106 | 48 |
| ORF1279 | 996229 | 996486 | putative | | | | |
| ORF1280 | 1000373 | 1000002 | putative | | | | |
| ORF1281 | 1010291 | 1010037 | putative | | | | |
| ORF1282 | 1011128 | 1010793 | 106 aa long hypothetical protein | AB009472 | Pyrococcus horikoshii | 159 | 50 |
| ORF1283 | 1012924 | 1012694 | putative | | | | |
| ORF1284 | 1028659 | 1028913 | putative | | | | |
| ORF1285 | 1086481 | 1086762 | putative | | | | |
| ORF1286 | 1118658 | 1118879 | Phosphoglucomutase | AE001354 | Chlamydia trachomatis | 291 | 84 |
| ORF1287 | 1170098 | 1169835 | hypothetical protein | AE001358 | Chlamydia trachomatis | 187 | 53 |
| ORF1288 | 1180828 | 1181184 | putative | | | | |
| ORF1289 | 1182658 | 1183035 | putative | | | | |
| ORF1290 | 1195076 | 1194795 | putative | | | | |
| ORF1291 | 1195890 | 1196183 | putative | | | | |

TABLE 2

| ORF Nos | begin | end | potential start |
|---|---|---|---|
| 2 | 42 | 794 | 42 |
| 3 | 1258 | 1614 | 1261 |
| 4 | 1807 | 2418 | 1807 |
| 5 | 3393 | 2491 | 3393 |
| 6 | 3639 | 4067 | 3639 |
| 7 | 5649 | 4270 | 5649 |
| 8 | 7463 | 6012 | 7463 |
| 9 | 8051 | 8962 | 8051 |
| 10 | 9129 | 9959 | 9138 |
| 11 | 10687 | 10361 | 10639 |
| 12 | 10927 | 11232 | 10927 |
| 13 | 11246 | 12727 | 11246 |
| 14 | 12691 | 14190 | 12691 |
| 15 | 14484 | 17249 | 14484 |
| 16 | 16039 | 15770 | 16036 |
| 17 | 17845 | 20853 | 17845 |
| 18 | 21137 | 22042 | 21137 |
| 19 | 22046 | 23476 | 22046 |

TABLE 2-continued

| ORF Nos | begin | end | potential start |
|---|---|---|---|
| 20 | 23681 | 26110 | 23681 |
| 21 | 26109 | 25861 | 26109 |
| 22 | 26241 | 26978 | 26241 |
| 23 | 26960 | 27754 | 26960 |
| 24 | 27747 | 28577 | 27747 |
| 25 | 28887 | 29492 | 28950 |
| 26 | 29432 | 30028 | 29432 |
| 27 | 30024 | 31472 | 30024 |
| 28 | 31758 | 32288 | 31758 |
| 29 | 32201 | 33991 | 32201 |
| 30 | 33852 | 34541 | 33852 |
| 31 | 34783 | 36063 | 34783 |
| 32 | 36009 | 37529 | 36009 |
| 33 | 37881 | 39362 | 37881 |
| 34 | 39418 | 39161 | 39418 |
| 35 | 39366 | 40715 | 39366 |
| 36 | 43076 | 41094 | 43076 |
| 37 | 43800 | 43066 | 43800 |
| 38 | 44828 | 43785 | 44768 |
| 39 | 45340 | 44753 | 45340 |
| 40 | 45752 | 45372 | 45752 |
| 41 | 46996 | 45701 | 46996 |
| 42 | 47961 | 47569 | 47961 |
| 43 | 48960 | 48040 | 48960 |
| 44 | 51452 | 50133 | 51452 |
| 45 | 52606 | 51335 | 52606 |
| 46 | 53684 | 53319 | 53684 |
| 47 | 54195 | 53746 | 54195 |
| 48 | 55278 | 56453 | 55278 |
| 49 | 56493 | 57266 | 56493 |
| 50 | 57297 | 58526 | 57297 |
| 51 | 59851 | 58565 | 59851 |
| 52 | 61495 | 59924 | 61495 |
| 53 | 61324 | 62151 | 61324 |
| 54 | 62132 | 62470 | 62132 |
| 55 | 62474 | 63733 | 62474 |
| 56 | 63881 | 64186 | 63881 |
| 57 | 64611 | 64318 | 64611 |
| 58 | 65485 | 64673 | 65485 |
| 59 | 65999 | 65301 | 65999 |
| 60 | 66244 | 67281 | 66244 |
| 61 | 67265 | 67699 | 67265 |
| 62 | 67703 | 68539 | 67760 |
| 63 | 68805 | 70736 | 68805 |
| 64 | 69172 | 68831 | 69172 |
| 65 | 70642 | 71142 | 70642 |
| 66 | 71325 | 72029 | 71325 |
| 67 | 72060 | 73637 | 72060 |
| 68 | 74061 | 76175 | 74061 |
| 69 | 78351 | 77680 | 78351 |
| 70 | 79356 | 78355 | 79356 |
| 71 | 79983 | 79693 | 79983 |
| 72 | 80441 | 79938 | 80441 |
| 73 | 80475 | 80969 | 80475 |
| 74 | 81296 | 83080 | 81332 |
| 75 | 83291 | 83932 | 83291 |
| 76 | 84005 | 84769 | 84005 |
| 77 | 84975 | 85244 | 84975 |
| 78 | 85123 | 85425 | 85123 |
| 79 | 85397 | 85903 | 85397 |
| 80 | 85909 | 86583 | 85909 |
| 81 | 86626 | 88065 | 86626 |
| 82 | 89257 | 91026 | 89257 |
| 83 | 91291 | 93030 | 91291 |
| 84 | 93295 | 94086 | 93295 |
| 85 | 95285 | 94707 | 95279 |
| 86 | 95667 | 96557 | 95667 |
| 87 | 96317 | 97456 | 96317 |
| 88 | 98435 | 97968 | 98435 |
| 89 | 99460 | 98426 | 99460 |
| 90 | 100144 | 101325 | 100144 |
| 91 | 101457 | 101720 | 101457 |
| 92 | 101704 | 102273 | 101704 |
| 93 | 102356 | 102805 | i02356 |
| 94 | 102835 | 103530 | 102835 |
| 95 | 103549 | 104058 | 103549 |
| 96 | 104096 | 104491 | 104096 |
| 97 | 104601 | 108386 | 104601 |
| 98 | 108401 | 112054 | 108401 |
| 99 | 112033 | 112590 | 112033 |
| 100 | 112672 | 113682 | 112672 |
| 101 | 113726 | 114121 | 113726 |
| 102 | 114711 | 114136 | 114711 |
| 103 | 115267 | 115755 | 115267 |
| 104 | 115911 | 116543 | 115911 |
| 105 | 116736 | 118055 | 116778 |
| 106 | 117968 | 118522 | 117968 |
| 107 | 118530 | 119843 | 118530 |
| 108 | 119816 | 120457 | 119816 |
| 109 | 120451 | 122430 | 120451 |
| 110 | 122504 | 122950 | 122504 |
| 111 | 123528 | 126347 | 123528 |
| 112 | 126332 | 129166 | 126332 |
| 113 | 134690 | 129213 | 134690 |
| 114 | 134925 | 136382 | 134931 |
| 115 | 137870 | 136482 | 137867 |
| 116 | 137899 | 138240 | 137899 |
| 117 | 138239 | 137928 | 138239 |
| 118 | 139558 | 138257 | 139558 |
| 119 | 140352 | 139516 | 140352 |
| 120 | 140498 | 141841 | 140498 |
| 121 | 141855 | 142658 | 141855 |
| 122 | 144258 | 143050 | 144258 |
| 123 | 145258 | 144494 | 145258 |
| 124 | 145454 | 146749 | 145454 |
| 125 | 147318 | 146767 | 147318 |
| 126 | 148261 | 147677 | 148261 |
| 127 | 149029 | 152157 | 149029 |
| 128 | 154108 | 152201 | 154108 |
| 129 | 155135 | 154308 | 155135 |
| 130 | 155141 | 155467 | 155141 |
| 131 | 155703 | 156779 | 155703 |
| 132 | 156748 | 157635 | 156748 |
| 133 | 157653 | 158996 | 157653 |
| 134 | 159363 | 159986 | 159363 |
| 135 | 159880 | 160446 | 159880 |
| 136 | 160477 | 160839 | 160477 |
| 137 | 160898 | 161539 | 160898 |
| 138 | 161527 | 162153 | 161527 |
| 139 | 162144 | 162443 | 162144 |
| 140 | 162437 | 164098 | 162437 |
| 141 | 165451 | 164228 | 165451 |
| 142 | 166349 | 165411 | 166349 |
| 143 | 166949 | 168442 | 166949 |
| 144 | 169416 | 171029 | 169416 |
| 145 | 170857 | 171459 | 170857 |
| 146 | 172652 | 173428 | 172652 |
| 147 | 174626 | 173439 | 174626 |
| 148 | 174816 | 175613 | 174816 |
| 149 | 175598 | 175954 | 175598 |
| 150 | 175958 | 176935 | 175958 |
| 151 | 177708 | 176938 | 177708 |
| 152 | 177128 | 177376 | 177128 |
| 153 | 179472 | 177841 | 179472 |
| 154 | 179822 | 179517 | 179822 |
| 155 | 181793 | 179943 | 181793 |
| 156 | 182628 | 181876 | 182628 |
| 157 | 184420 | 183074 | 184420 |
| 158 | 184988 | 184467 | 184988 |
| 159 | 185483 | 185112 | 185483 |
| 160 | 185902 | 185483 | 185902 |
| 161 | 186174 | 185839 | 186174 |
| 162 | 187720 | 186587 | 187720 |
| 163 | 188318 | 190933 | 188318 |
| 164 | 191090 | 191635 | 191090 |
| 165 | 191547 | 192743 | 191547 |
| 166 | 192969 | 193469 | 192969 |
| 167 | 194044 | 193610 | 194044 |
| 168 | 194196 | 195809 | 194196 |
| 169 | 196088 | 198073 | 196088 |
| 170 | 198132 | 199454 | 198132 |
| 171 | 199351 | 202818 | 199351 |
| 172 | 204552 | 202999 | 204552 |
| 173 | 205648 | 204692 | 205639 |

TABLE 2-continued

| ORF Nos | begin | end | potential start |
|---|---|---|---|
| 174 | 205807 | 207327 | 205807 |
| 175 | 207182 | 207775 | 207182 |
| 176 | 207779 | 208267 | 207779 |
| 177 | 208267 | 209577 | 208267 |
| 178 | 211807 | 211271 | 211807 |
| 179 | 212188 | 211844 | 212188 |
| 180 | 214079 | 212448 | 214079 |
| 181 | 214907 | 214083 | 214907 |
| 182 | 216154 | 215429 | 216154 |
| 183 | 216115 | 216678 | 216115 |
| 184 | 216728 | 217282 | 216728 |
| 185 | 217267 | 217866 | 217267 |
| 186 | 218593 | 218261 | 218590 |
| 187 | 219821 | 218994 | 219821 |
| 188 | 221382 | 220309 | 221382 |
| 189 | 222719 | 221433 | 222719 |
| 190 | 223521 | 222724 | 223521 |
| 191 | 224499 | 225008 | 224499 |
| 192 | 225140 | 225559 | 225140 |
| 193 | 225555 | 226802 | 225555 |
| 194 | 227800 | 226892 | 227743 |
| 195 | 228335 | 228072 | 228335 |
| 196 | 229251 | 228643 | 229251 |
| 197 | 230983 | 229622 | 230983 |
| 198 | 231483 | 230983 | 231483 |
| 199 | 232063 | 231509 | 232063 |
| 200 | 232739 | 232053 | 232739 |
| 201 | 233166 | 234356 | 233166 |
| 202 | 233518 | 233165 | 233518 |
| 203 | 234536 | 235186 | 234536 |
| 204 | 235379 | 236689 | 235379 |
| 205 | 236680 | 237618 | 236689 |
| 206 | 237521 | 238345 | 237521 |
| 207 | 238281 | 238973 | 238281 |
| 208 | 238871 | 240115 | 238871 |
| 209 | 240191 | 241564 | 240191 |
| 210 | 242281 | 241604 | 242281 |
| 211 | 242933 | 242274 | 242933 |
| 212 | 243416 | 242976 | 243416 |
| 213 | 243500 | 244531 | 243500 |
| 214 | 244480 | 246021 | 244480 |
| 215 | 246330 | 247811 | 246330 |
| 216 | 247831 | 249174 | 247870 |
| 217 | 249437 | 251038 | 249455 |
| 218 | 251325 | 252212 | 251325 |
| 219 | 253156 | 254007 | 253156 |
| 220 | 253974 | 254852 | 253974 |
| 221 | 255258 | 256094 | 255258 |
| 222 | 256640 | 257455 | 256640 |
| 223 | 257502 | 258239 | 257502 |
| 224 | 257869 | 257501 | 257869 |
| 225 | 259248 | 260897 | 259248 |
| 226 | 262753 | 261788 | 262753 |
| 227 | 263059 | 262757 | 263059 |
| 228 | 264375 | 263182 | 264375 |
| 229 | 265985 | 264747 | 265985 |
| 230 | 266637 | 266059 | 266637 |
| 231 | 267338 | 266538 | 267338 |
| 232 | 267922 | 267473 | 267922 |
| 233 | 269647 | 270771 | 269647 |
| 234 | 272777 | 273145 | 272777 |
| 235 | 273253 | 273636 | 273253 |
| 236 | 273705 | 273977 | 273705 |
| 237 | 276016 | 275717 | 276016 |
| 238 | 276439 | 276020 | 276418 |
| 239 | 276792 | 277253 | 276792 |
| 240 | 277318 | 277599 | 277318 |
| 241 | 278578 | 277877 | 278578 |
| 242 | 279258 | 278554 | 279258 |
| 243 | 280435 | 279533 | 280435 |
| 244 | 281547 | 280849 | 281547 |
| 245 | 281696 | 282325 | 281717 |
| 246 | 282459 | 284069 | 282459 |
| 247 | 284056 | 284517 | 284056 |
| 248 | 284606 | 285775 | 284606 |
| 249 | 285592 | 285987 | 285592 |
| 250 | 286179 | 286976 | 286179 |
| 251 | 287583 | 287002 | 287583 |
| 252 | 287951 | 287451 | 287951 |
| 253 | 288499 | 288816 | 288499 |
| 254 | 289674 | 288505 | 289674 |
| 255 | 288839 | 289213 | 288839 |
| 256 | 289970 | 290254 | 289970 |
| 257 | 291931 | 292803 | 291931 |
| 258 | 293258 | 292755 | 293258 |
| 259 | 293718 | 293272 | 293718 |
| 260 | 294630 | 293953 | 294630 |
| 261 | 296153 | 294636 | 296153 |
| 262 | 294817 | 295068 | 294817 |
| 263 | 296354 | 297862 | 296354 |
| 264 | 298415 | 297879 | 298415 |
| 265 | 298777 | 298253 | 298777 |
| 266 | 299572 | 298781 | 299572 |
| 267 | 300487 | 299633 | 300487 |
| 268 | 301586 | 300702 | 301568 |
| 269 | 302440 | 301571 | 302440 |
| 270 | 302838 | 302437 | 302838 |
| 271 | 303335 | 302745 | 303335 |
| 272 | 304394 | 303852 | 304394 |
| 273 | 304606 | 305223 | 304606 |
| 274 | 305394 | 306236 | 305394 |
| 275 | 306501 | 307439 | 306501 |
| 276 | 308033 | 307458 | 308033 |
| 277 | 308924 | 308037 | 308924 |
| 278 | 309485 | 310180 | 309485 |
| 279 | 310426 | 311214 | 310426 |
| 280 | 311597 | 311253 | 311504 |
| 281 | 312772 | 311780 | 312772 |
| 282 | 313425 | 312772 | 313425 |
| 283 | 313646 | 313377 | 313646 |
| 284 | 313937 | 314665 | 313937 |
| 285 | 315576 | 314755 | 315576 |
| 286 | 316157 | 315531 | 316157 |
| 287 | 318657 | 316156 | 318657 |
| 288 | 321042 | 318676 | 321042 |
| 289 | 321445 | 321098 | 321445 |
| 290 | 322309 | 321710 | 322309 |
| 291 | 323190 | 322366 | 323181 |
| 292 | 323843 | 323181 | 323843 |
| 293 | 324878 | 323856 | 324878 |
| 294 | 325340 | 326410 | 325340 |
| 295 | 326433 | 327836 | 326433 |
| 296 | 328465 | 327839 | 328465 |
| 297 | 329360 | 328857 | 329360 |
| 298 | 330907 | 329357 | 330907 |
| 299 | 332455 | 330956 | 332455 |
| 300 | 334536 | 332395 | 334536 |
| 301 | 336091 | 334877 | 336091 |
| 302 | 336103 | 337302 | 336103 |
| 303 | 338129 | 338830 | 338129 |
| 304 | 338965 | 339501 | 338965 |
| 305 | 339508 | 340143 | 339508 |
| 306 | 340247 | 342967 | 340247 |
| 307 | 343385 | 343810 | 343385 |
| 308 | 344171 | 343935 | 344171 |
| 309 | 345082 | 344330 | 345073 |
| 310 | 346005 | 345082 | 346005 |
| 311 | 346784 | 346437 | 346784 |
| 312 | 347029 | 346715 | 347029 |
| 313 | 347034 | 347723 | 347034 |
| 314 | 348075 | 350459 | 348075 |
| 315 | 350598 | 351071 | 350598 |
| 316 | 351075 | 352175 | 351096 |
| 317 | 353291 | 352230 | 353267 |
| 318 | 353442 | 354467 | 353442 |
| 319 | 354451 | 354933 | 354451 |
| 320 | 355000 | 355449 | 355000 |
| 321 | 355448 | 356743 | 355448 |
| 322 | 355953 | 355642 | 355953 |
| 323 | 359310 | 356827 | 359310 |
| 324 | 359120 | 359377 | 359120 |
| 325 | 359525 | 359908 | 359525 |
| 326 | 361290 | 359947 | 361290 |
| 327 | 363785 | 361362 | 363746 |

TABLE 2-continued

| ORF Nos | begin | end | potential start |
|---|---|---|---|
| 328 | 364496 | 363888 | 364496 |
| 329 | 364832 | 365290 | 364832 |
| 330 | 365304 | 365669 | 365304 |
| 331 | 366599 | 365667 | 366599 |
| 332 | 367291 | 369030 | 367291 |
| 333 | 369134 | 369808 | 369134 |
| 334 | 369917 | 370438 | 369917 |
| 335 | 370365 | 372647 | 370365 |
| 336 | 372557 | 373066 | 372557 |
| 337 | 373020 | 373442 | 373020 |
| 338 | 373467 | 374195 | 373467 |
| 339 | 374176 | 375099 | 374176 |
| 340 | 375676 | 375083 | 375608 |
| 341 | 376173 | 375634 | 376173 |
| 342 | 376564 | 377643 | 376564 |
| 343 | 377956 | 379773 | 377956 |
| 344 | 379781 | 380425 | 379805 |
| 345 | 380281 | 381000 | 380281 |
| 346 | 381008 | 381460 | 381008 |
| 347 | 381460 | 383037 | 381460 |
| 348 | 383257 | 383523 | 383257 |
| 349 | 383553 | 385304 | 383553 |
| 350 | 385397 | 386458 | 385400 |
| 351 | 387242 | 386514 | 387242 |
| 352 | 388764 | 387013 | 388764 |
| 353 | 390120 | 390932 | 390120 |
| 354 | 390919 | 391818 | 390961 |
| 355 | 392379 | 391885 | 392379 |
| 356 | 392582 | 392986 | 392582 |
| 357 | 392776 | 393684 | 392776 |
| 358 | 394151 | 394804 | 394151 |
| 359 | 394928 | 395308 | 394928 |
| 360 | 395259 | 395990 | 395259 |
| 361 | 397815 | 395953 | 397815 |
| 362 | 398850 | 397831 | 398850 |
| 363 | 400085 | 399099 | 400085 |
| 364 | 401245 | 400073 | 401236 |
| 365 | 401474 | 401136 | 401474 |
| 366 | 402199 | 401423 | 402199 |
| 367 | 403193 | 402186 | 403166 |
| 368 | 403650 | 404165 | 403650 |
| 369 | 404343 | 405914 | 404343 |
| 370 | 405984 | 407327 | 405984 |
| 371 | 407712 | 408806 | 407712 |
| 372 | 410439 | 409075 | 410439 |
| 373 | 411826 | 410954 | 411826 |
| 374 | 412482 | 414302 | 412482 |
| 375 | 415402 | 414407 | 415402 |
| 376 | 415848 | 415237 | 415848 |
| 377 | 417131 | 415866 | 417131 |
| 378 | 417258 | 417566 | 417258 |
| 379 | 418326 | 417454 | 418326 |
| 380 | 420057 | 418426 | 420057 |
| 381 | 420448 | 420720 | 420448 |
| 382 | 420980 | 421552 | 420980 |
| 383 | 421556 | 422029 | 421556 |
| 384 | 422461 | 422925 | 422461 |
| 385 | 423562 | 424320 | 423562 |
| 386 | 424250 | 424591 | 424250 |
| 387 | 424830 | 426047 | 424830 |
| 388 | 426240 | 427397 | 426240 |
| 389 | 428841 | 430703 | 428841 |
| 390 | 430694 | 431446 | 430694 |
| 391 | 431597 | 432100 | 431597 |
| 392 | 432165 | 432779 | 432165 |
| 393 | 433272 | 432832 | 433272 |
| 394 | 433925 | 433227 | 433922 |
| 395 | 436678 | 433934 | 436678 |
| 396 | 437176 | 438357 | 437176 |
| 397 | 440317 | 438518 | 440317 |
| 398 | 440001 | 440345 | 440001 |
| 399 | 441233 | 440517 | 441233 |
| 400 | 440719 | 441012 | 440719 |
| 401 | 442192 | 441230 | 442192 |
| 402 | 442888 | 442343 | 442888 |
| 403 | 442371 | 442961 | 442371 |
| 404 | 443578 | 443003 | 443578 |
| 405 | 444500 | 443526 | 444500 |
| 406 | 444842 | 444528 | 444842 |
| 407 | 445009 | 444743 | 445009 |
| 408 | 445718 | 445182 | 445718 |
| 409 | 445807 | 447804 | 445807 |
| 410 | 448738 | 447803 | 448738 |
| 411 | 449628 | 448618 | 449628 |
| 412 | 450298 | 450867 | 450298 |
| 413 | 450713 | 451207 | 450713 |
| 414 | 451211 | 452452 | 451211 |
| 415 | 452448 | 453659 | 452448 |
| 416 | 454843 | 453725 | 454843 |
| 417 | 455608 | 454865 | 455608 |
| 418 | 456243 | 457007 | 456243 |
| 419 | 457016 | 457708 | 457016 |
| 420 | 458368 | 457979 | 458368 |
| 421 | 459496 | 458372 | 459496 |
| 422 | 459493 | 460194 | 459493 |
| 423 | 461446 | 460355 | 461446 |
| 424 | 462298 | 461450 | 462298 |
| 425 | 462444 | 463349 | 462444 |
| 426 | 464241 | 463342 | 464241 |
| 427 | 464574 | 465065 | 464574 |
| 428 | 465129 | 465611 | 465129 |
| 429 | 465571 | 466317 | 465571 |
| 430 | 466317 | 467093 | 466317 |
| 431 | 466999 | 467502 | 466999 |
| 432 | 469691 | 467715 | 469691 |
| 433 | 470691 | 469660 | 470691 |
| 434 | 472010 | 470709 | 472010 |
| 435 | 471545 | 471799 | 471545 |
| 436 | 472359 | 472045 | 472359 |
| 437 | 473523 | 472732 | 473523 |
| 438 | 474889 | 473441 | 474889 |
| 439 | 477323 | 475365 | 477323 |
| 440 | 478496 | 477597 | 478496 |
| 441 | 478722 | 479273 | 478722 |
| 442 | 479277 | 479705 | 479277 |
| 443 | 480050 | 481450 | 480050 |
| 444 | 481469 | 482053 | 481469 |
| 445 | 482600 | 482025 | 482600 |
| 446 | 482654 | 484204 | 482654 |
| 447 | 484211 | 485170 | 484211 |
| 448 | 485170 | 485838 | 485170 |
| 449 | 485813 | 486580 | 485813 |
| 450 | 486976 | 486638 | 486976 |
| 451 | 489071 | 487764 | 489071 |
| 452 | 489341 | 489090 | 489341 |
| 453 | 489958 | 489152 | 489958 |
| 454 | 490549 | 489962 | 490549 |
| 455 | 491163 | 490522 | 491163 |
| 456 | 491396 | 491112 | 491396 |
| 437 | 492121 | 491390 | 492121 |
| 458 | 492304 | 494838 | 492304 |
| 459 | 495943 | 494822 | 495943 |
| 460 | 496011 | 496565 | 496170 |
| 461 | 496569 | 497228 | 496569 |
| 462 | 497358 | 497834 | 497358 |
| 463 | 497770 | 498327 | 497770 |
| 464 | 499209 | 499589 | 499209 |
| 465 | 499520 | 499792 | 499520 |
| 466 | 500774 | 504169 | 500774 |
| 467 | 504139 | 504600 | 504139 |
| 468 | 504865 | 506877 | 504865 |
| 469 | 506790 | 507671 | 506790 |
| 470 | 507718 | 510507 | 507718 |
| 471 | 508325 | 507912 | 508325 |
| 472 | 510660 | 513440 | 510660 |
| 473 | 51495 | 513787 | 514920 |
| 474 | 517347 | 515419 | 517347 |
| 475 | 517058 | 517363 | 517058 |
| 476 | 517798 | 517277 | 517798 |
| 477 | 518200 | 517847 | 518200 |
| 478 | 518300 | 521146 | 518363 |
| 479 | 521392 | 522948 | 521407 |
| 480 | 523244 | 524809 | 523322 |
| 481 | 524379 | 524125 | 524379 |

TABLE 2-continued

| ORF Nos | begin | end | potential start |
|---|---|---|---|
| 482 | 524649 | 526238 | 524649 |
| 483 | 526265 | 527104 | 526268 |
| 484 | 526947 | 526702 | 526947 |
| 485 | 526975 | 528450 | 526975 |
| 486 | 528408 | 529199 | 528408 |
| 487 | 530612 | 529542 | 530612 |
| 488 | 531656 | 530616 | 53156 |
| 489 | 533974 | 532067 | 533974 |
| 490 | 536432 | 534324 | 536432 |
| 491 | 537150 | 53707 | 537150 |
| 492 | 537928 | 537080 | 537928 |
| 493 | 538438 | 537932 | 538438 |
| 494 | 538737 | 538333 | 538737 |
| 495 | 539594 | 539127 | 539594 |
| 496 | 541215 | 539590 | 541215 |
| 497 | 542571 | 541282 | 542571 |
| 498 | 543014 | 542457 | 543014 |
| 499 | 543369 | 542962 | 543369 |
| 500 | 543809 | 546628 | 543815 |
| 501 | 546619 | 549525 | 546619 |
| 502 | 547293 | 546994 | 547293 |
| 503 | 549699 | 550523 | 549699 |
| 504 | 550490 | 551551 | 550490 |
| 505 | 551448 | 552623 | 551448 |
| 506 | 552652 | 555117 | 552652 |
| 507 | 555029 | 555493 | 555029 |
| 508 | 558006 | 555673 | 558006 |
| 509 | 559694 | 558162 | 559694 |
| 510 | 558208 | 558573 | 558208 |
| 511 | 561692 | 559899 | 561692 |
| 512 | 561412 | 561708 | 561412 |
| 513 | 563942 | 561777 | 563942 |
| 514 | 564969 | 563950 | 564969 |
| 515 | 566204 | 564936 | 566198 |
| 516 | 567717 | 566302 | 567717 |
| 517 | 568526 | 567708 | 568526 |
| 518 | 569467 | 568742 | 569467 |
| 519 | 571865 | 569431 | 571065 |
| 520 | 571828 | 571118 | 571783 |
| 521 | 572202 | 573308 | 572202 |
| 522 | 573146 | 575056 | 573146 |
| 523 | 575023 | 575916 | 575023 |
| 524 | 577891 | 576497 | 577891 |
| 525 | 578914 | 578204 | 578914 |
| 526 | 579924 | 578857 | 579924 |
| 527 | 580187 | 579858 | 580187 |
| 528 | 580017 | 580406 | 580017 |
| 529 | 581086 | 580187 | 581086 |
| 530 | 581367 | 581828 | 581367 |
| 531 | 581678 | 582367 | 581678 |
| 532 | 582361 | 583428 | 582361 |
| 533 | 584690 | 583431 | 584690 |
| 534 | 585237 | 584950 | 585237 |
| 535 | 585626 | 586888 | 585626 |
| 536 | 586846 | 587907 | 586888 |
| 537 | 589049 | 588180 | 589049 |
| 538 | 590500 | 589301 | 590455 |
| 539 | 590755 | 592458 | 590755 |
| 540 | 592526 | 592903 | 592526 |
| 541 | 592836 | 593747 | 592836 |
| 542 | 593747 | 594298 | 593747 |
| 543 | 594331 | 595947 | 594331 |
| 544 | 595905 | 596309 | 595905 |
| 545 | 596514 | 597215 | 596514 |
| 546 | 597184 | 597957 | 597184 |
| 547 | 597755 | 598612 | 597755 |
| 548 | 598602 | 599204 | 598602 |
| 549 | 599373 | 599939 | 599373 |
| 550 | 600903 | 602072 | 600903 |
| 551 | 602240 | 602587 | 602240 |
| 552 | 602637 | 603272 | 602637 |
| 553 | 603142 | 604512 | 603142 |
| 554 | 604627 | 605853 | 604627 |
| 555 | 605790 | 606620 | 605790 |
| 556 | 606571 | 607281 | 606571 |
| 557 | 609004 | 607355 | 609004 |
| 558 | 610906 | 609932 | 610906 |
| 559 | 611786 | 611004 | 611786 |
| 560 | 612333 | 611746 | 612333 |
| 561 | 613897 | 612341 | 613897 |
| 562 | 615179 | 616279 | 615179 |
| 563 | 616610 | 617383 | 616610 |
| 564 | 618796 | 617810 | 618796 |
| 565 | 620004 | 618826 | 620004 |
| 566 | 619649 | 619918 | 619649 |
| 567 | 621265 | 620021 | 621265 |
| 568 | 622359 | 621265 | 622359 |
| 569 | 623420 | 622560 | 623420 |
| 570 | 624297 | 623335 | 624297 |
| 571 | 624773 | 624174 | 624773 |
| 572 | 625029 | 625484 | 625029 |
| 573 | 625488 | 625883 | 625488 |
| 574 | 625892 | 626395 | 625892 |
| 575 | 626444 | 627790 | 626444 |
| 576 | 627912 | 628607 | 627930 |
| 577 | 628774 | 629697 | 628774 |
| 578 | 629660 | 631639 | 629660 |
| 579 | 631725 | 633551 | 631725 |
| 580 | 633520 | 636957 | 633520 |
| 581 | 637232 | 638098 | 637232 |
| 582 | 640648 | 639593 | 640648 |
| 583 | 640979 | 640728 | 640979 |
| 584 | 641327 | 641007 | 641327 |
| 585 | 641687 | 642283 | 641687 |
| 586 | 643023 | 642286 | 643023 |
| 587 | 643330 | 643076 | 643330 |
| 588 | 643704 | 643351 | 643704 |
| 589 | 645628 | 643676 | 645628 |
| 590 | 645783 | 645538 | 645756 |
| 591 | 646269 | 645793 | 646269 |
| 592 | 646751 | 646314 | 646751 |
| 593 | 647848 | 647045 | 647848 |
| 594 | 648393 | 650336 | 648393 |
| 595 | 651016 | 650420 | 651007 |
| 596 | 652956 | 651289 | 652956 |
| 597 | 653395 | 653126 | 653395 |
| 598 | 655740 | 654193 | 655740 |
| 599 | 656508 | 655966 | 656508 |
| 600 | 658140 | 657022 | 658140 |
| 601 | 660216 | 658525 | 660216 |
| 602 | 663238 | 660248 | 663238 |
| 603 | 664461 | 663157 | 664452 |
| 604 | 665735 | 664635 | 665735 |
| 605 | 666212 | 666994 | 666212 |
| 606 | 666998 | 667921 | 666998 |
| 607 | 667909 | 668568 | 667909 |
| 608 | 668502 | 669203 | 668502 |
| 609 | 669154 | 670893 | 669175 |
| 610 | 672226 | 670853 | 672226 |
| 611 | 671137 | 671424 | 671137 |
| 612 | 672453 | 673001 | 672453 |
| 613 | 673072 | 674721 | 673072 |
| 614 | 674549 | 674262 | 674549 |
| 615 | 675518 | 674796 | 675518 |
| 616 | 676083 | 675499 | 676083 |
| 617 | 676630 | 676067 | 676630 |
| 618 | 677016 | 676600 | 677016 |
| 619 | 677647 | 677015 | 677647 |
| 620 | 67799Q | 678259 | 677990 |
| 621 | 679444 | 680097 | 679444 |
| 622 | 680097 | 680897 | 680097 |
| 623 | 681637 | 680849 | 681637 |
| 624 | 681409 | 682281 | 681409 |
| 625 | 682453 | 682821 | 682453 |
| 626 | 682763 | 683902 | 682763 |
| 627 | 684616 | 683969 | 684616 |
| 628 | 685169 | 684534 | 685169 |
| 629 | 685986 | 685117 | 685986 |
| 630 | 686278 | 687288 | 686278 |
| 631 | 687483 | 688151 | 687483 |
| 632 | 688740 | 689501 | 688740 |
| 633 | 690242 | 689622 | 690242 |
| 634 | 690470 | 691126 | 690470 |
| 635 | 692600 | 691497 | 692600 |

TABLE 2-continued

| ORF Nos | begin | end | potential start |
|---|---|---|---|
| 636 | 692674 | 695064 | 692674 |
| 637 | 695049 | 696032 | 695064 |
| 638 | 697964 | 696585 | 697964 |
| 639 | 699803 | 698274 | 699803 |
| 640 | 701926 | 699788 | 701926 |
| 641 | 703196 | 702567 | 703196 |
| 642 | 704221 | 703208 | 704221 |
| 643 | 704240 | 705289 | 704240 |
| 644 | 706070 | 705300 | 706070 |
| 645 | 706841 | 706254 | 706838 |
| 646 | 707596 | 706811 | 707596 |
| 647 | 708666 | 707677 | 708666 |
| 648 | 709793 | 709119 | 709793 |
| 649 | 711523 | 710132 | 711523 |
| 650 | 712236 | 711523 | 712236 |
| 651 | 714734 | 712125 | 714734 |
| 652 | 715759 | 714761 | 715759 |
| 653 | 717538 | 715886 | 717538 |
| 654 | 719113 | 720243 | 719113 |
| 655 | 720590 | 722422 | 720590 |
| 656 | 722406 | 723056 | 722406 |
| 657 | 723551 | 723120 | 723551 |
| 658 | 724246 | 723626 | 724246 |
| 659 | 724754 | 724251 | 724754 |
| 660 | 725868 | 724900 | 725868 |
| 661 | 727115 | 726270 | 727115 |
| 662 | 728126 | 727119 | 728126 |
| 663 | 728594 | 728208 | 728594 |
| 664 | 729614 | 728604 | 729614 |
| 665 | 729778 | 729533 | 729778 |
| 666 | 730149 | 729751 | 730149 |
| 667 | 730539 | 730174 | 730539 |
| 668 | 731983 | 730598 | 731983 |
| 669 | 732427 | 731996 | 732427 |
| 670 | 732917 | 732423 | 732917 |
| 671 | 733598 | 733320 | 733598 |
| 672 | 733869 | 733492 | 733869 |
| 673 | 734298 | 733900 | 734298 |
| 674 | 734858 | 734319 | 734858 |
| 675 | 735195 | 734863 | 735195 |
| 676 | 735578 | 735342 | 735578 |
| 677 | 735861 | 735604 | 735861 |
| 678 | 736492 | 736079 | 736492 |
| 679 | 737192 | 736524 | 737192 |
| 680 | 737555 | 737211 | 737555 |
| 681 | 738688 | 737837 | 738688 |
| 682 | 739048 | 738713 | 739048 |
| 683 | 739736 | 739065 | 739736 |
| 684 | 740477 | 739773 | 740477 |
| 685 | 740659 | 740958 | 740659 |
| 686 | 741722 | 740721 | 741722 |
| 687 | 742789 | 741827 | 742789 |
| 688 | 743618 | 742782 | 743618 |
| 689 | 744092 | 743634 | 744092 |
| 690 | 744604 | 744107 | 744604 |
| 691 | 744953 | 744498 | 744953 |
| 692 | 746608 | 744986 | 746608 |
| 693 | 747085 | 746621 | 747085 |
| 694 | 747974 | 747219 | 747974 |
| 695 | 748594 | 748169 | 748594 |
| 696 | 749145 | 748573 | 749145 |
| 697 | 749652 | 749957 | 749652 |
| 698 | 750446 | 749979 | 750446 |
| 699 | 751219 | 750446 | 751219 |
| 700 | 753042 | 751291 | 753042 |
| 701 | 754309 | 753020 | 754309 |
| 702 | 755120 | 756175 | 755120 |
| 703 | 756120 | 756485 | 756120 |
| 704 | 756499 | 760227 | 756499 |
| 705 | 761217 | 760297 | 761178 |
| 706 | 761297 | 761809 | 761330 |
| 707 | 761782 | 762282 | 761782 |
| 708 | 762260 | 762895 | 762299 |
| 709 | 762867 | 763316 | 762867 |
| 710 | 763780 | 763325 | 763780 |
| 711 | 763861 | 765168 | 763861 |
| 712 | 766809 | 765697 | 766809 |
| 713 | 768051 | 766888 | 768051 |
| 714 | 768566 | 768321 | 768566 |
| 715 | 769342 | 768551 | 769342 |
| 716 | 770532 | 769378 | 770532 |
| 717 | 771451 | 770804 | 771451 |
| 718 | 773058 | 771847 | 773058 |
| 719 | 773094 | 773456 | 773094 |
| 720 | 774376 | 773093 | 774376 |
| 721 | 775123 | 774380 | 775123 |
| 722 | 775398 | 774916 | 775398 |
| 723 | 775046 | 776077 | 775046 |
| 724 | 776070 | 777041 | 776070 |
| 725 | 777964 | 777536 | 777964 |
| 726 | 778176 | 777904 | 778176 |
| 727 | 778621 | 779334 | 778684 |
| 728 | 781173 | 780307 | 781173 |
| 729 | 781526 | 781116 | 781526 |
| 730 | 782784 | 781555 | 782784 |
| 731 | 783572 | 782805 | 783572 |
| 732 | 785032 | 783581 | 785032 |
| 733 | 786412 | 785360 | 786412 |
| 734 | 788429 | 786450 | 788429 |
| 735 | 788944 | 788528 | 788944 |
| 736 | 789758 | 788901 | 789758 |
| 737 | 790332 | 791504 | 790338 |
| 738 | 791846 | 792721 | 791846 |
| 739 | 792724 | 793569 | 792724 |
| 740 | 793580 | 794323 | 793580 |
| 741 | 794304 | 794843 | 794304 |
| 742 | 795217 | 795732 | 795217 |
| 743 | 795722 | 796795 | 795722 |
| 744 | 798735 | 797053 | 798735 |
| 745 | 799823 | 798681 | 799823 |
| 746 | 799297 | 799578 | 799297 |
| 747 | 801313 | 799808 | 801313 |
| 748 | 802453 | 801332 | 802453 |
| 749 | 803299 | 802457 | 803299 |
| 750 | 803811 | 803290 | 803811 |
| 751 | 805151 | 803826 | 805151 |
| 752 | 805860 | 805156 | 805860 |
| 753 | 806604 | 806332 | 806604 |
| 754 | 806913 | 806608 | 806913 |
| 755 | 808222 | 806903 | 808222 |
| 756 | 808751 | 808146 | 808751 |
| 757 | 809437 | 808673 | 809437 |
| 758 | 809939 | 809454 | 809939 |
| 759 | 811235 | 810213 | 811235 |
| 760 | 811779 | 813056 | 811779 |
| 761 | 812890 | 812516 | 812890 |
| 762 | 812954 | 813583 | 812954 |
| 763 | 813587 | 815023 | 813587 |
| 764 | 815420 | 815746 | 815420 |
| 765 | 816036 | 817010 | 816036 |
| 766 | 817111 | 817356 | 817111 |
| 767 | 817791 | 818609 | 817797 |
| 768 | 818609 | 819094 | 818609 |
| 769 | 819104 | 819823 | 819104 |
| 770 | 820722 | 819826 | 820722 |
| 771 | 822313 | 821000 | 822313 |
| 772 | 823503 | 822238 | 823503 |
| 773 | 823678 | 825612 | 823678 |
| 774 | 825461 | 826312 | 825461 |
| 775 | 827280 | 826645 | 827280 |
| 776 | 828604 | 827171 | 828604 |
| 777 | 830026 | 828713 | 830026 |
| 778 | 831047 | 830085 | 831047 |
| 779 | 831725 | 831051 | 831725 |
| 780 | 832220 | 833098 | 832220 |
| 781 | 833851 | 833396 | 833851 |
| 782 | 834068 | 835039 | 834068 |
| 783 | 835792 | 835127 | 835792 |
| 784 | 837624 | 836116 | 837624 |
| 785 | 838951 | 840882 | 838951 |
| 786 | 840869 | 842185 | 840869 |
| 787 | 841989 | 843455 | 841989 |
| 788 | 843242 | 844021 | 843242 |
| 789 | 845018 | 843987 | 844997 |

TABLE 2-continued

| ORF Nos | begin | end | potential start |
|---|---|---|---|
| 790 | 846174 | 844990 | 846174 |
| 791 | 848509 | 846311 | 848509 |
| 792 | 848568 | 849014 | 848568 |
| 793 | 849082 | 850488 | 849088 |
| 794 | 851512 | 850574 | 851512 |
| 795 | 852064 | 852447 | 852064 |
| 796 | 852398 | 853690 | 852398 |
| 797 | 855118 | 854243 | 855118 |
| 798 | 855751 | 855128 | 855751 |
| 799 | 856551 | 855829 | 856551 |
| 800 | 856730 | 858556 | 856730 |
| 801 | 858717 | 859601 | 858717 |
| 802 | 859591 | 860205 | 859591 |
| 803 | 861132 | 860284 | 861132 |
| 804 | 861426 | 861163 | 861426 |
| 805 | 861701 | 862921 | 861701 |
| 806 | 863026 | 864798 | 863026 |
| 807 | 864831 | 865256 | 864831 |
| 808 | 865226 | 866581 | 865226 |
| 809 | 866562 | 867119 | 866562 |
| 810 | 867025 | 867816 | 867025 |
| 811 | 867820 | 868497 | 867820 |
| 812 | 869743 | 868661 | 869743 |
| 813 | 870633 | 870094 | 870633 |
| 814 | 871929 | 870646 | 871929 |
| 815 | 872538 | 872086 | 872538 |
| 816 | 873908 | 872517 | 873908 |
| 817 | 874281 | 874670 | 874281 |
| 818 | 874582 | 875286 | 874582 |
| 819 | 877857 | 875377 | 877857 |
| 820 | 878446 | 879255 | 878446 |
| 821 | 880635 | 879268 | 880635 |
| 822 | 882524 | 880593 | 882524 |
| 823 | 882612 | 883319 | 882612 |
| 824 | 884155 | 883538 | 884155 |
| 825 | 884340 | 885611 | 884343 |
| 826 | 885722 | 887302 | 885722 |
| 827 | 887587 | 888153 | 887587 |
| 828 | 888627 | 888220 | 888627 |
| 829 | 889330 | 888716 | 889330 |
| 830 | 889898 | 889323 | 889898 |
| 831 | 891190 | 889898 | 891190 |
| 832 | 891828 | 891247 | 891828 |
| 833 | 892421 | 892017 | 892421 |
| 834 | 893116 | 892421 | 893116 |
| 835 | 892521 | 892925 | 892521 |
| 836 | 893392 | 895419 | 893392 |
| 837 | 895745 | 896527 | 895745 |
| 838 | 896668 | 897558 | 896668 |
| 839 | 897565 | 899442 | 897565 |
| 840 | 899420 | 900229 | 899420 |
| 841 | 903230 | 900237 | 903230 |
| 842 | 905081 | 903234 | 905081 |
| 843 | 906931 | 905045 | 906931 |
| 844 | 907248 | 907832 | 907299 |
| 845 | 907784 | 908128 | 907784 |
| 846 | 908132 | 908677 | 908132 |
| 847 | 908589 | 909320 | 908589 |
| 848 | 909405 | 911465 | 909405 |
| 849 | 911677 | 912360 | 911725 |
| 850 | 912303 | 912821 | 912303 |
| 851 | 912937 | 913983 | 912937 |
| 852 | 915128 | 914067 | 915128 |
| 853 | 916658 | 915303 | 916658 |
| 854 | 915627 | 915376 | 915627 |
| 855 | 917707 | 916853 | 917707 |
| 856 | 918837 | 917722 | 918837 |
| 857 | 919868 | 918837 | 919868 |
| 858 | 920434 | 919880 | 920434 |
| 859 | 921187 | 920438 | 921187 |
| 860 | 921959 | 921195 | 921959 |
| 861 | 923773 | 921995 | 923773 |
| 862 | 922146 | 922415 | 922146 |
| 863 | 923943 | 923674 | 923943 |
| 864 | 924077 | 925006 | 924077 |
| 865 | 925436 | 925083 | 925436 |
| 866 | 926524 | 925349 | 926524 |
| 867 | 927920 | 926433 | 927920 |
| 868 | 928319 | 927951 | 928319 |
| 869 | 928963 | 928334 | 928963 |
| 870 | 929248 | 930987 | 929248 |
| 871 | 930995 | 932059 | 930995 |
| 872 | 932121 | 933515 | 932175 |
| 873 | 932881 | 932513 | 932881 |
| 874 | 933485 | 935746 | 933485 |
| 875 | 935724 | 937082 | 935724 |
| 876 | 937229 | 938410 | 937229 |
| 877 | 938281 | 938805 | 938281 |
| 878 | 938809 | 939255 | 938824 |
| 879 | 939165 | 939782 | 939165 |
| 880 | 939760 | 940791 | 939790 |
| 881 | 940822 | 941106 | 940822 |
| 882 | 940977 | 941351 | 940977 |
| 883 | 942537 | 941623 | 942429 |
| 884 | 942784 | 942500 | 942763 |
| 885 | 943149 | 942799 | 943149 |
| 886 | 943799 | 943029 | 943799 |
| 887 | 944055 | 943732 | 944055 |
| 888 | 944413 | 943994 | 944404 |
| 889 | 945395 | 944556 | 945395 |
| 890 | 945853 | 945389 | 945853 |
| 891 | 946392 | 945751 | 946392 |
| 892 | 947410 | 948081 | 947431 |
| 893 | 949871 | 948915 | 949871 |
| 894 | 951058 | 949868 | 951058 |
| 895 | 951249 | 950959 | 951249 |
| 896 | 951664 | 952134 | 951664 |
| 897 | 952674 | 952165 | 952674 |
| 898 | 953491 | 952589 | 953491 |
| 899 | 955324 | 953495 | 955324 |
| 900 | 955823 | 955281 | 955823 |
| 901 | 957082 | 955847 | 957082 |
| 902 | 957902 | 957270 | 957902 |
| 903 | 959231 | 957906 | 959231 |
| 904 | 959376 | 960284 | 959376 |
| 905 | 960266 | 961669 | 960347 |
| 906 | 961856 | 964765 | 961856 |
| 907 | 966855 | 965395 | 966855 |
| 908 | 968204 | 966975 | 968204 |
| 909 | 968791 | 968237 | 968791 |
| 910 | 969498 | 968731 | 969498 |
| 911 | 969858 | 969511 | 969858 |
| 912 | 970118 | 969762 | 970118 |
| 913 | 970593 | 970300 | 970593 |
| 914 | 971261 | 970542 | 971261 |
| 915 | 971680 | 971123 | 971680 |
| 916 | 971876 | 975100 | 971876 |
| 917 | 975419 | 976516 | 975419 |
| 918 | 976584 | 978320 | 976584 |
| 919 | 977680 | 977231 | 977680 |
| 920 | 978399 | 980738 | 978399 |
| 921 | 980756 | 981928 | 980756 |
| 922 | 982974 | 981931 | 982962 |
| 923 | 984120 | 983119 | 984120 |
| 924 | 985502 | 984120 | 985502 |
| 925 | 987180 | 985882 | 987180 |
| 926 | 987172 | 987444 | 987172 |
| 927 | 989846 | 989049 | 989846 |
| 928 | 991048 | 989846 | 991048 |
| 929 | 991638 | 990955 | 991638 |
| 930 | 991794 | 992498 | 991794 |
| 931 | 993619 | 993041 | 993619 |
| 932 | 993530 | 994792 | 993548 |
| 933 | 995970 | 994795 | 995970 |
| 934 | 996857 | 995739 | 996857 |
| 935 | 997603 | 996782 | 997603 |
| 936 | 998969 | 997572 | 998969 |
| 937 | 998896 | 1000023 | 998896 |
| 938 | 1000087 | 1001340 | 1000087 |
| 939 | 1001357 | 1001818 | 1001357 |
| 940 | 1003288 | 1001873 | 1003288 |
| 941 | 1003487 | 1004146 | 1003496 |
| 942 | 1004485 | 1005639 | 1004689 |
| 943 | 1005643 | 1005972 | 1005643 |

TABLE 2-continued

| ORF Nos | begin | end | potential start |
|---|---|---|---|
| 944 | 1006784 | 1006116 | 1006784 |
| 945 | 1007563 | 1006769 | 1007563 |
| 946 | 1009226 | 1007568 | 1009226 |
| 947 | 1009989 | 1009336 | 1009989 |
| 948 | 1015852 | 1016337 | 1015852 |
| 949 | 1016561 | 1016181 | 1016561 |
| 950 | 1016297 | 1017532 | 1016297 |
| 951 | 1016802 | 1016452 | 1016802 |
| 952 | 1018993 | 1017701 | 1018993 |
| 953 | 1019454 | 1019137 | 1019454 |
| 954 | 1020764 | 1019562 | 1020764 |
| 955 | 1021405 | 1021037 | 1021405 |
| 956 | 1021821 | 1024286 | 1021821 |
| 957 | 1024697 | 1024248 | 1024697 |
| 958 | 1025569 | 1024508 | 1025551 |
| 959 | 1026969 | 1025590 | 1026969 |
| 960 | 1027789 | 1026947 | 1027789 |
| 961 | 1031199 | 1027945 | 1031199 |
| 962 | 1031717 | 1031172 | 1031717 |
| 963 | 1033057 | 1031612 | 1033057 |
| 964 | 1033425 | 1033039 | 1033425 |
| 965 | 1033784 | 1033200 | 1033784 |
| 966 | 1033963 | 1036038 | 1033963 |
| 967 | 1036945 | 1036010 | 1036945 |
| 968 | 1037110 | 1037679 | 1037110 |
| 969 | 1037696 | 1037944 | 1037696 |
| 970 | 1038916 | 1037975 | 1038916 |
| 971 | 1040582 | 1039026 | 1040582 |
| 972 | 1040997 | 1042337 | 1040997 |
| 973 | 1042357 | 1043403 | 1042357 |
| 974 | 1043367 | 1044623 | 1043367 |
| 975 | 1044607 | 1045362 | 1044607 |
| 976 | 1045384 | 1046538 | 1045384 |
| 977 | 1046447 | 1047517 | 1046447 |
| 978 | 1047521 | 1049956 | 1047521 |
| 979 | 1050611 | 1050036 | 1050611 |
| 980 | 1050925 | 1050566 | 1050925 |
| 981 | 1051728 | 1051090 | 1051728 |
| 982 | 1051743 | 1052063 | 1051743 |
| 983 | 1052101 | 1053126 | 1052101 |
| 984 | 1054201 | 1053107 | 1054201 |
| 985 | 1054242 | 1055555 | 1054242 |
| 986 | 1055483 | 1055908 | 1055483 |
| 987 | 1056609 | 1056965 | 1056609 |
| 988 | 1056961 | 1058232 | 1056985 |
| 989 | 1058238 | 1058687 | 1058238 |
| 990 | 1059371 | 1058727 | 1059371 |
| 991 | 1059526 | 1060578 | 1059526 |
| 992 | 1061553 | 1060579 | 1061553 |
| 993 | 1061674 | 1062411 | 1061674 |
| 994 | 1062377 | 1064077 | 1062377 |
| 995 | 1064116 | 1065243 | 1064116 |
| 996 | 1067451 | 1065178 | 1067451 |
| 997 | 1068065 | 1067376 | 1068065 |
| 998 | 1068209 | 1068706 | 1068230 |
| 999 | 1069958 | 1068819 | 1069958 |
| 1000 | 1071163 | 1070033 | 1071163 |
| 1001 | 1072438 | 1071332 | 1072438 |
| 1002 | 1072997 | 1073476 | 1072997 |
| 1003 | 1074239 | 1075864 | 1074239 |
| 1004 | 1076790 | 1075867 | 1076790 |
| 1005 | 1077268 | 1076573 | 1077268 |
| 1006 | 1077999 | 1078724 | 1077999 |
| 1007 | 1079088 | 1078672 | 1079088 |
| 1008 | 1079642 | 1079944 | 1079642 |
| 1009 | 1080501 | 1079995 | 1080468 |
| 1010 | 1080775 | 1081341 | 1080775 |
| 1011 | 1083158 | 1081350 | 1083158 |
| 1012 | 1084677 | 1083235 | 1084677 |
| 1013 | 1085648 | 1084632 | 1085648 |
| 1014 | 1086117 | 1086737 | 1086117 |
| 1015 | 1086692 | 1087897 | 1086692 |
| 1016 | 1088646 | 1089005 | 1088646 |
| 1017 | 1089146 | 1089805 | 1089146 |
| 1018 | 1092931 | 1089890 | 1092931 |
| 1019 | 1093179 | 1092889 | 1093179 |
| 1020 | 1093584 | 1094204 | 1093584 |
| 1021 | 1095619 | 1094192 | 1095619 |
| 1022 | 1096074 | 1096628 | 1096074 |
| 1023 | 1096633 | 1097082 | 1096633 |
| 1024 | 1097266 | 1097601 | 1097266 |
| 1025 | 1097622 | 1097867 | 1097622 |
| 1026 | 1097886 | 1098392 | 1097886 |
| 1027 | 1099521 | 1099279 | 1099521 |
| 1028 | 1099689 | 1101053 | 1099704 |
| 1029 | 1102192 | 1101107 | 1102192 |
| 1030 | 1104950 | 1102116 | 1104950 |
| 1031 | 1106508 | 1104946 | 1106508 |
| 1032 | 1106722 | 1107249 | 1106722 |
| 1033 | 1107463 | 1108101 | 1107463 |
| 1034 | 1108041 | 1108421 | 1108041 |
| 1035 | 1108520 | 1113370 | 1108520 |
| 1036 | 1114958 | 1113447 | 1114958 |
| 1037 | 1116915 | 1115071 | 1116915 |
| 1038 | 1118183 | 1116894 | 1118183 |
| 1039 | 1118846 | 1120030 | 1118846 |
| 1040 | 1120040 | 1120522 | 1120040 |
| 1041 | 1120510 | 1121430 | 1120510 |
| 1042 | 1121321 | 1121866 | 1121321 |
| 1043 | 1122123 | 1122899 | 1122123 |
| 1044 | 1124842 | 1125564 | 1124842 |
| 1045 | 1126526 | 1125579 | 1126526 |
| 1046 | 1126519 | 1127676 | 1126519 |
| 1047 | 1127672 | 1128571 | 1127672 |
| 1048 | 1130230 | 1131336 | 1130230 |
| 1049 | 1131480 | 1132553 | 1131480 |
| 1050 | 1132830 | 1133843 | 1132830 |
| 1051 | 1134121 | 1134855 | 1134121 |
| 1052 | 1134642 | 1135592 | 1134642 |
| 1053 | 1135964 | 1135653 | 1135964 |
| 1054 | 1137132 | 1135954 | 1137132 |
| 1055 | 1137169 | 1140102 | 1137169 |
| 1056 | 1141365 | 1140112 | 1141344 |
| 1057 | 1142150 | 1141356 | 1142150 |
| 1058 | 1142520 | 1145660 | 1142520 |
| 1059 | 1145627 | 1146721 | 1145627 |
| 1060 | 1146862 | 1147545 | 1146862 |
| 1061 | 1147666 | 1148190 | 1147666 |
| 1062 | 1148514 | 1148224 | 1148514 |
| 1063 | 1149136 | 1148348 | 1149136 |
| 1064 | 1149702 | 1149166 | 1149702 |
| 1065 | 1150031 | 1150591 | 1150031 |
| 1066 | 1150785 | 1151147 | 1150785 |
| 1067 | 1151165 | 1152181 | 1151165 |
| 1068 | 1152522 | 1154591 | 1152522 |
| 1069 | 1155666 | 1154566 | 1155666 |
| 1070 | 1156743 | 1155670 | 1156740 |
| 1071 | 1156859 | 1157815 | 1156859 |
| 1072 | 1157982 | 1160735 | 1157982 |
| 1073 | 1162620 | 1160917 | 1162620 |
| 1074 | 1162970 | 1162590 | 1162970 |
| 1075 | 1163532 | 1164020 | 1163532 |
| 1076 | 1163995 | 1164294 | 1163995 |
| 1077 | 1165569 | 1165030 | 1165569 |
| 1078 | 1166108 | 1165566 | 1166108 |
| 1079 | 1166644 | 1166141 | 1166644 |
| 1080 | 1167055 | 1168374 | 1167055 |
| 1081 | 1169218 | 1168337 | 1169218 |
| 1082 | 1169823 | 1169218 | 1169823 |
| 1083 | 1171324 | 1170572 | 1171324 |
| 1084 | 1172085 | 1171177 | 1172085 |
| 1085 | 1172394 | 1173773 | 1172394 |
| 1086 | 1175209 | 1173881 | 1175209 |
| 1087 | 1175555 | 1175127 | 1175360 |
| 1088 | 1175778 | 1177043 | 1175778 |
| 1089 | 1177177 | 1179048 | 1177177 |
| 1090 | 1179156 | 1180085 | 1179156 |
| 1091 | 1180045 | 1180779 | 1180045 |
| 1092 | 1181942 | 1180788 | 1181942 |
| 1093 | 1182296 | 1181961 | 1182296 |
| 1094 | 1183844 | 1182300 | 1183844 |
| 1095 | 1184420 | 1183848 | 1184420 |
| 1096 | 1185382 | 1184366 | 1185382 |
| 1097 | 1185858 | 1185226 | 1185858 |

TABLE 2-continued

| ORF Nos | begin | end | potential start |
|---|---|---|---|
| 1098 | 1186164 | 1186481 | 1186185 |
| 1099 | 1187386 | 1186484 | 1187386 |
| 1100 | 1187370 | 1189028 | 1187370 |
| 1101 | 1189321 | 1190889 | 1189321 |
| 1102 | 1191142 | 1192146 | 1191142 |
| 1103 | 1191974 | 1191729 | 1191974 |
| 1104 | 1193815 | 1192991 | 1193815 |
| 1105 | 1195702 | 1194248 | 1195702 |
| 1106 | 1196303 | 1195716 | 1196303 |
| 1107 | 1196831 | 1196337 | 1196831 |
| 1108 | 1197807 | 1196746 | 1197651 |
| 1109 | 1198740 | 1197883 | 1198668 |
| 1110 | 1200232 | 1198721 | 1200232 |
| 1111 | 1201286 | 1200135 | 1201286 |
| 1112 | 1202386 | 1201259 | 1202350 |
| 1113 | 1202901 | 1202350 | 1202901 |
| 1114 | 1204162 | 1202816 | 1204162 |
| 1115 | 1203177 | 1203464 | 1203177 |
| 1116 | 1205028 | 1204180 | 1205028 |
| 1117 | 1206392 | 1204878 | 1206392 |
| 1118 | 1206742 | 1206086 | 1206742 |
| 1119 | 1207872 | 1206724 | 1207872 |
| 1120 | 1208852 | 1207851 | 1208852 |
| 1121 | 1210518 | 1209742 | 1210518 |
| 1122 | 1210703 | 1211494 | 1210703 |
| 1123 | 1211870 | 1212754 | 1211870 |
| 1124 | 1212742 | 1214064 | 1212742 |
| 1125 | 1214046 | 1214858 | 1214046 |
| 1126 | 1215551 | 1216318 | 1215551 |
| 1127 | 1216493 | 1216849 | 1216493 |
| 1128 | 1217183 | 1219612 | 1217183 |
| 1129 | 1220068 | 1219673 | 1220068 |
| 1130 | 1219710 | 1220669 | 1219710 |
| 1131 | 1220630 | 1221376 | 1220630 |
| 1132 | 1221645 | 1223681 | 1221645 |
| 1133 | 1223894 | 1224988 | 1223900 |
| 1134 | 1225000 | 1225830 | 1225000 |
| 1135 | 1227810 | 1225879 | 1227810 |
| 1136 | 1226528 | 1226908 | 1226528 |
| 1137 | 1229972 | 1228311 | 1229972 |
| 1138 | 47569 | 47018 | 47569 |
| 1139 | 49980 | 49117 | 49980 |
| 1140 | 53356 | 52898 | 53356 |
| 1141 | 54477 | 54884 | 54477 |
| 1142 | 63753 | 63998 | 63753 |
| 1143 | 77164 | 77487 | 77164 |
| 1144 | 79724 | 79302 | 79724 |
| 1145 | 88721 | 88951 | 88721 |
| 1146 | 94067 | 94429 | 94067 |
| 1147 | 122832 | 123341 | 122832 |
| 1148 | 147536 | 147234 | 147536 |
| 1149 | 158990 | 159346 | 158990 |
| 1150 | 168470 | 168979 | 168470 |
| 1151 | 169183 | 169452 | 169204 |
| 1152 | 171785 | 171504 | 171785 |
| 1153 | 172518 | 171775 | 172518 |
| 1154 | 193599 | 194045 | 193599 |
| 1155 | 195704 | 196075 | 195704 |
| 1156 | 210687 | 210145 | 210684 |
| 1157 | 211100 | 210708 | 211100 |
| 1158 | 215420 | 215088 | 215420 |
| 1159 | 217914 | 218246 | 217914 |
| 1160 | 218701 | 218925 | 218701 |
| 1161 | 223785 | 223525 | 223785 |
| 1162 | 224271 | 223999 | 224271 |
| 1163 | 228691 | 228407 | 228691 |
| 1164 | 235050 | 235334 | 235050 |
| 1165 | 252308 | 253021 | 252308 |
| 1166 | 258280 | 258912 | 258280 |
| 1167 | 261325 | 261567 | 261325 |
| 1168 | 268195 | 268878 | 268195 |
| 1169 | 269447 | 268881 | 269447 |
| 1170 | 271263 | 271538 | 271263 |
| 1171 | 271957 | 272346 | 271957 |
| 1172 | 274176 | 274550 | 274176 |
| 1173 | 275736 | 275314 | 275736 |
| 1174 | 276490 | 276927 | 276490 |
| 1175 | 277577 | 277861 | 277577 |
| 1176 | 288163 | 287909 | 288163 |
| 1177 | 290130 | 289789 | 290130 |
| 1178 | 290989 | 291225 | 290989 |
| 1179 | 291372 | 291860 | 291372 |
| 1180 | 311239 | 311622 | 311239 |
| 1181 | 328665 | 328384 | 328665 |
| 1182 | 337348 | 338289 | 337348 |
| 1183 | 364764 | 364369 | 364764 |
| 1184 | 389623 | 390135 | 389623 |
| 1185 | 393729 | 394343 | 393729 |
| 1186 | 407379 | 407621 | 407379 |
| 1187 | 410944 | 410708 | 410944 |
| 1188 | 427632 | 427988 | 427632 |
| 1189 | 428172 | 428486 | 428172 |
| 1190 | 436761 | 437246 | 436761 |
| 1191 | 460911 | 461159 | 460911 |
| 1192 | 477597 | 477313 | 477597 |
| 1193 | 487303 | 487001 | 487303 |
| 1194 | 487764 | 487534 | 487764 |
| 1195 | 498502 | 499017 | 498502 |
| 1196 | 499795 | 500466 | 499795 |
| 1197 | 571928 | 572344 | 571928 |
| 1198 | 572367 | 572131 | 572367 |
| 1199 | 588184 | 587915 | 588184 |
| 1200 | 600587 | 600907 | 600587 |
| 1201 | 609731 | 608895 | 609731 |
| 1202 | 614039 | 614755 | 614039 |
| 1203 | 614823 | 615152 | 614823 |
| 1204 | 638244 | 638831 | 638244 |
| 1205 | 638819 | 639094 | 638819 |
| 1206 | 639073 | 639636 | 639073 |
| 1207 | 647901 | 648236 | 647901 |
| 1208 | 678510 | 679469 | 678510 |
| 1209 | 688178 | 688732 | 688178 |
| 1210 | 696045 | 696563 | 696045 |
| 1211 | 708998 | 708588 | 708998 |
| 1212 | 709808 | 710089 | 709808 |
| 1213 | 718240 | 717737 | 718240 |
| 1214 | 737828 | 737565 | 737828 |
| 1215 | 779502 | 780257 | 779502 |
| 1216 | 806310 | 805864 | 806310 |
| 1217 | 820931 | 820707 | 820931 |
| 1218 | 837696 | 839096 | 837696 |
| 1219 | 883307 | 883549 | 883307 |
| 1220 | 892010 | 891726 | 892010 |
| 1221 | 893277 | 893564 | 893277 |
| 1222 | 936998 | 937225 | 936998 |
| 1223 | 946865 | 947419 | 946865 |
| 1225 | 985882 | 985517 | 985882 |
| 1224 | 975187 | 975411 | 975187 |
| 1226 | 987713 | 987180 | 987713 |
| 1227 | 988215 | 987733 | 988215 |
| 1228 | 988754 | 988530 | 988754 |
| 1229 | 992542 | 992841 | 992542 |
| 1230 | 992759 | 993067 | 992759 |
| 1231 | 1004247 | 1004528 | 1004268 |
| 1232 | 1015013 | 1014294 | 1015013 |
| 1233 | 1056147 | 1056545 | 1056147 |
| 1234 | 1077682 | 1078035 | 1077682 |
| 1235 | 1088121 | 1088381 | 1088121 |
| 1236 | 1098430 | 1098852 | 1098430 |
| 1237 | 1098798 | 1099319 | 1098798 |
| 1238 | 1123198 | 1123515 | 1123198 |
| 1239 | 1123606 | 1124256 | 1123606 |
| 1240 | 1124453 | 1124797 | 1124453 |
| 1241 | 1129253 | 1129567 | 1129253 |
| 1242 | 1164947 | 1164474 | 1164947 |
| 1243 | 1170457 | 1170053 | 1170457 |
| 1244 | 1172342 | 1171863 | 1172342 |
| 1245 | 1192155 | 1192835 | 1192155 |
| 1246 | 1192759 | 1192992 | 1192759 |
| 1247 | 1193861 | 1194142 | 1193861 |
| 1248 | 1194036 | 1193779 | 1194036 |
| 1249 | 1209748 | 1209053 | 1209748 |
| 1250 | 1215111 | 1215419 | 1215111 |
| 1251 | 1216302 | 1216538 | 1216302 |

TABLE 2-continued

| ORF Nos | begin | end | potential start |
|---|---|---|---|
| 1252 | 1228072 | 1227818 | 1228072 |
| 1253 | 1228304 | 1228080 | 1228304 |
| 1254 | 26599 | 26222 | 26599 |
| 1255 | 27609 | 27367 | 27609 |
| 1256 | 67206 | 66907 | 67197 |
| 1257 | 70612 | 70352 | 70588 |
| 1258 | 132703 | 132945 | 132703 |
| 1259 | 178073 | 178393 | 178073 |
| 1260 | 208576 | 208349 | 208576 |
| 1261 | 209156 | 208929 | 209156 |
| 1262 | 209263 | 209024 | 209263 |
| 1263 | 210304 | 210639 | 210304 |
| 1264 | 299009 | 299452 | 299030 |
| 1265 | 352106 | 351717 | 352061 |
| 1266 | 420182 | 419949 | 420170 |
| 1267 | 553602 | 553381 | 553602 |
| 1268 | 556538 | 556807 | 556538 |
| 1269 | 594348 | 593797 | 594342 |
| 1270 | 595169 | 594876 | 595160 |
| 1271 | 662148 | 662381 | 662160 |
| 1272 | 706528 | 706893 | 706528 |
| 1273 | 803315 | 803650 | 803339 |
| 1274 | 849551 | 849306 | 849551 |
| 1275 | 913676 | 913275 | 913676 |
| 1276 | 927087 | 926836 | 927087 |
| 1277 | 930587 | 930360 | 930587 |
| 1278 | 986531 | 986764 | 986531 |
| 1279 | 996229 | 996486 | 996229 |
| 1280 | 1000373 | 1000002 | 1000334 |
| 1281 | 1010291 | 1010037 | 1010273 |
| 1282 | 1011128 | 1010793 | 1011128 |
| 1283 | 1012924 | 1012694 | 1012924 |
| 1284 | 1028659 | 1028913 | 1028659 |
| 1285 | 1086481 | 1086762 | 1086481 |
| 1286 | 1118658 | 1118879 | 1118658 |
| 1287 | 1170098 | 1169835 | 1170098 |
| 1288 | 1180828 | 1181184 | 1180828 |
| 1289 | 1182658 | 1183035 | 1182658 |
| 1290 | 1195076 | 1194795 | 1195055 |
| 1291 | 1195890 | 1196183 | 1195890 |
| 1292 | 189042 | 188809 | 189030 |
| 1293 | 691250 | 691567 | 691250 |
| 1294 | 914544 | 914780 | 914556 |
| 1295 | 928525 | 928833 | 928579 |
| 1296 | 1040685 | 1040948 | 1040712 |
| 1297 | 377646 | 378068 | 377646 |

TABLE 4

| SEQ ID NO (ORF) | Fp | Fd | Bp | Bd |
|---|---|---|---|---|
| 2 | 1292 | 1293 | 3796 | 3797 |
| 3 | 1294 | 1295 | 3798 | 3799 |
| 4 | 1296 | 1297 | 3800 | 3801 |
| 5 | 1298 | 1299 | 3802 | 3803 |
| 6 | 1300 | 1301 | 3804 | 3805 |
| 7 | 1302 | 1303 | 3806 | 3807 |
| 8 | 1304 | 1305 | 3808 | 3809 |
| 9 | 1306 | 1307 | 3810 | 3811 |
| 10 | 1308 | 1309 | 3812 | 3813 |
| 11 | 1310 | 1311 | 3814 | 3815 |
| 12 | 1312 | 1313 | 3816 | 3817 |
| 13 | 1314 | 1315 | 3818 | 3819 |
| 14 | 1316 | 1317 | 3820 | 3821 |
| 15 | 1318 | 1319 | 3822 | 3823 |
| 16 | 1320 | 1321 | 3824 | 3825 |
| 17 | 1322 | 1323 | 3826 | 3827 |
| 18 | 1324 | 1325 | 3828 | 3829 |
| 19 | 1326 | 1327 | 3830 | 3831 |
| 20 | 1328 | 1329 | 3832 | 3833 |
| 21 | 1330 | 1331 | 3834 | 3835 |
| 22 | 1332 | 1333 | 3836 | 3837 |
| 23 | 1334 | 1335 | 3838 | 3839 |
| 24 | 1336 | 1337 | 3840 | 3841 |
| 25 | 1338 | 1339 | 3842 | 3843 |
| 26 | 1340 | 1341 | 3844 | 3845 |
| 27 | 1342 | 1343 | 3846 | 3847 |
| 28 | 1344 | 1345 | 3848 | 3849 |
| 29 | 1346 | 1347 | 3850 | 3851 |
| 30 | 1348 | 1349 | 3852 | 3853 |
| 31 | 1350 | 1351 | 3854 | 3855 |
| 32 | 1352 | 1353 | 3856 | 3857 |
| 33 | 1354 | 1355 | 3858 | 3859 |
| 34 | 1358 | 1359 | 3862 | 3863 |
| 35 | 1356 | 1357 | 3860 | 3861 |
| 36 | 1360 | 1361 | 3864 | 3865 |
| 37 | 1362 | 1363 | 3866 | 3867 |
| 38 | 1364 | 1365 | 3868 | 3869 |
| 39 | 1366 | 1367 | 3870 | 3871 |
| 40 | 1368 | 1369 | 3872 | 3873 |
| 41 | 1370 | 1371 | 3874 | 3875 |
| 42 | 1374 | 1375 | 3878 | 3879 |
| 43 | 1376 | 1377 | 3880 | 3881 |
| 44 | 1380 | 1381 | 3884 | 3885 |
| 45 | 1382 | 1383 | 3886 | 3887 |
| 46 | 1386 | 1387 | 3890 | 3891 |
| 47 | 1388 | 1389 | 3892 | 3893 |
| 48 | 1392 | 1393 | 3896 | 3897 |
| 49 | 1394 | 1395 | 3898 | 3899 |
| 50 | 1396 | 1397 | 3900 | 3901 |
| 51 | 1398 | 1399 | 3902 | 3903 |
| 52 | 1402 | 1403 | 3906 | 3907 |
| 53 | 1400 | 1401 | 3904 | 3905 |
| 54 | 1404 | 1405 | 3908 | 3909 |
| 55 | 1406 | 1407 | 3910 | 3911 |
| 56 | 1410 | 1411 | 3914 | 3915 |
| 57 | 1412 | 1413 | 3916 | 3917 |
| 58 | 1414 | 1415 | 3918 | 3919 |
| 59 | 1416 | 1417 | 3920 | 3921 |
| 60 | 1418 | 1419 | 3922 | 3923 |
| 61 | 1420 | 1421 | 3924 | 3925 |
| 62 | 1422 | 1423 | 3926 | 3927 |
| 63 | 1424 | 1425 | 3928 | 3929 |
| 64 | 1426 | 1427 | 3930 | 3931 |
| 65 | 1428 | 1429 | 3932 | 3933 |
| 66 | 1430 | 1431 | 3934 | 3935 |
| 67 | 1432 | 1433 | 3936 | 3937 |
| 68 | 1434 | 1435 | 3938 | 3939 |
| 69 | 1438 | 1439 | 3942 | 3943 |
| 70 | 1440 | 1441 | 3944 | 3945 |
| 71 | 1444 | 1445 | 3948 | 3949 |
| 72 | 1446 | 1447 | 3950 | 3951 |
| 73 | 1448 | 1449 | 3952 | 3953 |
| 74 | 1450 | 1451 | 3954 | 3955 |
| 75 | 1452 | 1453 | 3956 | 3957 |
| 76 | 1454 | 1455 | 3958 | 3959 |
| 77 | 1456 | 1457 | 3960 | 3961 |
| 78 | 1458 | 1459 | 3962 | 3963 |
| 79 | 1460 | 1461 | 3964 | 3965 |
| 80 | 1462 | 1463 | 3966 | 3967 |
| 81 | 1464 | 1465 | 3968 | 3969 |
| 82 | 1468 | 1469 | 3972 | 3973 |
| 83 | 1470 | 1471 | 3974 | 3975 |
| 84 | 1472 | 1473 | 3976 | 3977 |
| 85 | 1476 | 1477 | 3980 | 3981 |
| 86 | 1478 | 1479 | 3982 | 3983 |
| 87 | 1480 | 1481 | 3984 | 3985 |
| 88 | 1482 | 1483 | 3986 | 3987 |
| 89 | 1484 | 1485 | 3988 | 3989 |
| 90 | 1486 | 1487 | 3990 | 3991 |
| 91 | 1488 | 1489 | 3992 | 3993 |
| 92 | 1490 | 1491 | 3994 | 3995 |
| 93 | 1492 | 1493 | 3996 | 3997 |
| 94 | 1494 | 1495 | 3998 | 3999 |
| 95 | 1496 | 1497 | 4000 | 4001 |
| 96 | 1498 | 1499 | 4002 | 4003 |
| 97 | 1500 | 1501 | 4004 | 4005 |
| 98 | 1502 | 1503 | 4006 | 4007 |
| 99 | 1504 | 1505 | 4008 | 4009 |
| 100 | 1506 | 1507 | 4010 | 4011 |
| 101 | 1508 | 1509 | 4012 | 4013 |

TABLE 4-continued

| SEQ ID NO (ORF) | Fp | Fd | Bp | Bd |
|---|---|---|---|---|
| 102 | 1510 | 1511 | 4014 | 4015 |
| 103 | 1512 | 1513 | 4016 | 4017 |
| 104 | 1514 | 1515 | 4018 | 4019 |
| 105 | 1516 | 1517 | 4020 | 4021 |
| 106 | 1518 | 1519 | 4022 | 4023 |
| 107 | 1520 | 1521 | 4024 | 4025 |
| 108 | 1522 | 1523 | 4026 | 4027 |
| 109 | 1524 | 1525 | 4028 | 4029 |
| 110 | 1526 | 1527 | 4030 | 4031 |
| 111 | 1530 | 1531 | 4034 | 4035 |
| 112 | 1532 | 1533 | 4036 | 4037 |
| 113 | 1534 | 1535 | 4038 | 4039 |
| 114 | 1536 | 1537 | 4040 | 4041 |
| 115 | 1538 | 1539 | 4042 | 4043 |
| 116 | 1540 | 1541 | 4044 | 4045 |
| 117 | 1542 | 1543 | 4046 | 4047 |
| 118 | 1544 | 1545 | 4048 | 4049 |
| 119 | 1546 | 1547 | 4050 | 4051 |
| 120 | 1548 | 1549 | 4052 | 4053 |
| 121 | 1550 | 1551 | 4054 | 4055 |
| 122 | 1552 | 1553 | 4056 | 4057 |
| 123 | 1554 | 1555 | 4058 | 4059 |
| 124 | 1556 | 1557 | 4060 | 4061 |
| 125 | 1558 | 1559 | 4062 | 4063 |
| 126 | 1562 | 1563 | 4066 | 4067 |
| 127 | 1564 | 1565 | 4068 | 4069 |
| 128 | 1566 | 1567 | 4070 | 4071 |
| 129 | 1568 | 1569 | 4072 | 4073 |
| 130 | 1570 | 1571 | 4074 | 4075 |
| 131 | 1572 | 1573 | 4076 | 4077 |
| 132 | 1574 | 1575 | 4078 | 4079 |
| 133 | 1576 | 1577 | 4080 | 4081 |
| 134 | 1580 | 1581 | 4084 | 4085 |
| 135 | 1582 | 1583 | 4086 | 4087 |
| 136 | 1584 | 1585 | 4088 | 4089 |
| 137 | 1586 | 1587 | 4090 | 4091 |
| 138 | 1588 | 1589 | 4092 | 4093 |
| 139 | 1590 | 1591 | 4094 | 4095 |
| 140 | 1592 | 1593 | 4096 | 4097 |
| 141 | 1594 | 1595 | 4098 | 4099 |
| 142 | 1596 | 1597 | 4100 | 4101 |
| 143 | 1598 | 1599 | 4102 | 4103 |
| 144 | 1604 | 1605 | 4108 | 4109 |
| 145 | 1606 | 1607 | 4110 | 4111 |
| 146 | 1612 | 1613 | 4116 | 4117 |
| 147 | 1614 | 1615 | 4118 | 4119 |
| 148 | 1616 | 1617 | 4120 | 4121 |
| 149 | 1618 | 1619 | 4122 | 4123 |
| 150 | 1620 | 1621 | 4124 | 4125 |
| 151 | 1624 | 1625 | 4128 | 4129 |
| 152 | 1622 | 1623 | 4126 | 4127 |
| 153 | 1626 | 1627 | 4130 | 4131 |
| 154 | 1628 | 1629 | 4132 | 4133 |
| 155 | 1630 | 1631 | 4134 | 4135 |
| 156 | 1632 | 1633 | 4136 | 4137 |
| 157 | 1634 | 1635 | 4138 | 4139 |
| 158 | 1636 | 1637 | 4140 | 4141 |
| 159 | 1638 | 1639 | 4142 | 4143 |
| 160 | 1640 | 1641 | 4144 | 4145 |
| 161 | 1642 | 1643 | 4146 | 4147 |
| 162 | 1644 | 1645 | 4148 | 4149 |
| 163 | 1646 | 1647 | 4150 | 4151 |
| 164 | 1648 | 1649 | 4152 | 4153 |
| 165 | 1650 | 1651 | 4154 | 4155 |
| 166 | 1652 | 1653 | 4156 | 4157 |
| 167 | 1656 | 1657 | 4160 | 4161 |
| 168 | 1658 | 1659 | 4162 | 4163 |
| 169 | 1662 | 1663 | 4166 | 4167 |
| 170 | 1664 | 1665 | 4168 | 4169 |
| 171 | 1666 | 1667 | 4170 | 4171 |
| 172 | 1668 | 1669 | 4172 | 4173 |
| 173 | 1670 | 1671 | 4174 | 4175 |
| 174 | 1672 | 1673 | 4176 | 4177 |
| 175 | 1674 | 1675 | 4178 | 4179 |
| 176 | 1676 | 1677 | 4180 | 4181 |
| 177 | 1678 | 1679 | 4182 | 4183 |
| 178 | 1684 | 1685 | 4188 | 4189 |
| 179 | 1686 | 1687 | 4190 | 4191 |
| 180 | 1688 | 1689 | 4192 | 4193 |
| 181 | 1690 | 1691 | 4194 | 4195 |
| 182 | 1694 | 1695 | 4198 | 4199 |
| 183 | 1696 | 1697 | 4200 | 4201 |
| 184 | 1698 | 1699 | 4202 | 4203 |
| 185 | 1700 | 1701 | 4204 | 4205 |
| 186 | 1704 | 1705 | 4208 | 4209 |
| 187 | 1708 | 1709 | 4212 | 4213 |
| 188 | 1710 | 1711 | 4214 | 4215 |
| 189 | 1712 | 1713 | 4216 | 4217 |
| 190 | 1714 | 1715 | 4218 | 4219 |
| 191 | 1720 | 1721 | 4224 | 4225 |
| 192 | 1722 | 1723 | 4226 | 4227 |
| 193 | 1724 | 1725 | 4228 | 4229 |
| 194 | 1726 | 1727 | 4230 | 4231 |
| 195 | 1728 | 1729 | 4232 | 4233 |
| 196 | 1732 | 1733 | 4236 | 4237 |
| 197 | 1734 | 1735 | 4238 | 4239 |
| 198 | 1736 | 1737 | 4240 | 4241 |
| 199 | 1738 | 1739 | 4242 | 4243 |
| 200 | 1740 | 1741 | 4244 | 4245 |
| 201 | 1742 | 1743 | 4246 | 4247 |
| 202 | 1744 | 1745 | 4248 | 4249 |
| 203 | 1746 | 1747 | 4250 | 4251 |
| 204 | 1750 | 1751 | 4254 | 4255 |
| 205 | 1752 | 1753 | 4256 | 4257 |
| 206 | 1754 | 1755 | 4258 | 4259 |
| 207 | 1756 | 1757 | 4260 | 4261 |
| 208 | 1758 | 1759 | 4262 | 4263 |
| 209 | 1760 | 1761 | 4264 | 4265 |
| 210 | 1762 | 1763 | 4266 | 4267 |
| 211 | 1764 | 1765 | 4268 | 4269 |
| 212 | 1766 | 1767 | 4270 | 4271 |
| 213 | 1768 | 1769 | 4272 | 4273 |
| 214 | 1770 | 1771 | 4274 | 4275 |
| 215 | 1772 | 1773 | 4276 | 4277 |
| 216 | 1774 | 1775 | 4278 | 4279 |
| 217 | 1776 | 1777 | 4280 | 4281 |
| 218 | 1778 | 1779 | 4282 | 4283 |
| 219 | 1782 | 1783 | 4286 | 4287 |
| 220 | 1784 | 1785 | 4288 | 4289 |
| 221 | 1786 | 1787 | 4290 | 4291 |
| 222 | 1788 | 1789 | 4292 | 4293 |
| 223 | 1790 | 1791 | 4294 | 4295 |
| 224 | 1792 | 1793 | 4296 | 4297 |
| 225 | 1796 | 1797 | 4300 | 4301 |
| 226 | 1800 | 1801 | 4304 | 4305 |
| 227 | 1802 | 1803 | 4306 | 4307 |
| 228 | 1804 | 1805 | 4308 | 4309 |
| 229 | 1806 | 1807 | 4310 | 4311 |
| 230 | 1808 | 1809 | 4312 | 4313 |
| 231 | 1810 | 1811 | 4314 | 4315 |
| 232 | 1812 | 1813 | 4316 | 4317 |
| 233 | 1818 | 1819 | 4322 | 4323 |
| 234 | 1824 | 1825 | 4328 | 4329 |
| 235 | 1826 | 1827 | 4330 | 4331 |
| 236 | 1828 | 1829 | 4332 | 4333 |
| 237 | 1834 | 1835 | 4338 | 4339 |
| 238 | 1836 | 1837 | 4340 | 4341 |
| 239 | 1840 | 1841 | 4344 | 4345 |
| 240 | 1842 | 1843 | 4346 | 4347 |
| 241 | 1846 | 1847 | 4350 | 4351 |
| 242 | 1848 | 1849 | 4352 | 4353 |
| 243 | 1850 | 1851 | 4354 | 4355 |
| 244 | 1852 | 1853 | 4356 | 4357 |
| 245 | 1854 | 1855 | 4358 | 4359 |
| 246 | 1856 | 1857 | 4360 | 4361 |
| 247 | 1858 | 1859 | 4362 | 4363 |
| 248 | 1860 | 1861 | 4364 | 4365 |
| 249 | 1862 | 1863 | 4366 | 4367 |
| 250 | 1864 | 1865 | 4368 | 4369 |
| 251 | 1866 | 1867 | 4370 | 4371 |
| 252 | 1868 | 1869 | 4372 | 4373 |
| 253 | 1872 | 1873 | 4376 | 4377 |
| 254 | 1876 | 1877 | 4380 | 4381 |
| 255 | 1874 | 1875 | 4378 | 4379 |

TABLE 4-continued

| SEQ ID NO (ORF) | Fp | Fd | Bp | Bd |
|---|---|---|---|---|
| 256 | 1878 | 1879 | 4382 | 4383 |
| 257 | 1886 | 1887 | 4390 | 4391 |
| 258 | 1888 | 1889 | 4392 | 4393 |
| 259 | 1890 | 1891 | 4394 | 4395 |
| 260 | 1892 | 1893 | 4396 | 4397 |
| 261 | 1896 | 1897 | 4400 | 4401 |
| 262 | 1894 | 1895 | 4398 | 4399 |
| 263 | 1898 | 1899 | 4402 | 4403 |
| 264 | 1900 | 1901 | 4404 | 4405 |
| 265 | 1902 | 1903 | 4406 | 4407 |
| 266 | 1904 | 1905 | 4408 | 4409 |
| 267 | 1906 | 1907 | 4410 | 4411 |
| 268 | 1908 | 1909 | 4412 | 4413 |
| 269 | 1910 | 1911 | 4414 | 4415 |
| 270 | 1912 | 1913 | 4416 | 4417 |
| 271 | 1914 | 1915 | 4418 | 4419 |
| 272 | 1916 | 1917 | 4420 | 4421 |
| 273 | 1918 | 1919 | 4422 | 4423 |
| 274 | 1920 | 1921 | 4424 | 4425 |
| 275 | 1922 | 1923 | 4426 | 4427 |
| 276 | 1924 | 1925 | 4428 | 4429 |
| 277 | 1926 | 1927 | 4430 | 4431 |
| 278 | 1928 | 1929 | 4432 | 4433 |
| 279 | 1930 | 1931 | 4434 | 4435 |
| 280 | 1934 | 1935 | 4438 | 4439 |
| 281 | 1936 | 1937 | 4440 | 4441 |
| 282 | 1938 | 1939 | 4442 | 4443 |
| 283 | 1940 | 1941 | 4444 | 4445 |
| 284 | 1942 | 1943 | 4446 | 4447 |
| 285 | 1944 | 1945 | 4448 | 4449 |
| 286 | 1946 | 1947 | 4450 | 4451 |
| 287 | 1948 | 1949 | 4452 | 4453 |
| 288 | 1950 | 1951 | 4454 | 4455 |
| 289 | 1952 | 1953 | 4456 | 4457 |
| 290 | 1954 | 1955 | 4458 | 4459 |
| 291 | 1956 | 1957 | 4460 | 4461 |
| 292 | 1958 | 1959 | 4462 | 4463 |
| 293 | 1960 | 1961 | 4464 | 4465 |
| 294 | 1962 | 1963 | 4466 | 4467 |
| 295 | 1964 | 1965 | 4468 | 4469 |
| 296 | 1966 | 1967 | 4470 | 4471 |
| 297 | 1970 | 1971 | 4474 | 4475 |
| 298 | 1972 | 1973 | 4476 | 4477 |
| 299 | 1974 | 1975 | 4478 | 4479 |
| 300 | 1976 | 1977 | 4480 | 4481 |
| 301 | 1978 | 1979 | 4482 | 4483 |
| 302 | 1980 | 1981 | 4484 | 4485 |
| 303 | 1984 | 1985 | 4488 | 4489 |
| 304 | 1986 | 1987 | 4490 | 4491 |
| 305 | 1988 | 1989 | 4492 | 4493 |
| 306 | 1990 | 1991 | 4494 | 4495 |
| 307 | 1992 | 1993 | 4496 | 4497 |
| 308 | 1994 | 1995 | 4498 | 4499 |
| 309 | 1996 | 1997 | 4500 | 4501 |
| 310 | 1998 | 1999 | 4502 | 4503 |
| 311 | 2000 | 2001 | 4504 | 4505 |
| 312 | 2002 | 2003 | 4506 | 4507 |
| 313 | 2004 | 2005 | 4508 | 4509 |
| 314 | 2006 | 2007 | 4510 | 4511 |
| 315 | 2008 | 2009 | 4512 | 4513 |
| 316 | 2010 | 2011 | 4514 | 4515 |
| 317 | 2012 | 2013 | 4516 | 4517 |
| 318 | 2014 | 2015 | 4518 | 4519 |
| 319 | 2016 | 2017 | 4520 | 4521 |
| 320 | 2018 | 2019 | 4522 | 4523 |
| 321 | 2020 | 2021 | 4524 | 4525 |
| 322 | 2022 | 2023 | 4526 | 4527 |
| 323 | 2026 | 2027 | 4530 | 4531 |
| 324 | 2024 | 2025 | 4528 | 4529 |
| 325 | 2028 | 2029 | 4532 | 4533 |
| 326 | 2030 | 2031 | 4534 | 4535 |
| 327 | 2032 | 2033 | 4536 | 4537 |
| 328 | 2034 | 2035 | 4538 | 4539 |
| 329 | 2038 | 2039 | 4542 | 4543 |
| 330 | 2040 | 2041 | 4544 | 4545 |
| 331 | 2042 | 2043 | 4546 | 4547 |
| 332 | 2044 | 2045 | 4548 | 4549 |
| 333 | 2046 | 2047 | 4550 | 4551 |
| 334 | 2048 | 2049 | 4552 | 4553 |
| 335 | 2050 | 2051 | 4554 | 4555 |
| 336 | 2052 | 2053 | 4556 | 4557 |
| 337 | 2054 | 2055 | 4558 | 4559 |
| 338 | 2056 | 2057 | 4560 | 4561 |
| 339 | 2058 | 2059 | 4562 | 4563 |
| 340 | 2060 | 2061 | 4564 | 4565 |
| 341 | 2062 | 2063 | 4566 | 4567 |
| 342 | 2064 | 2065 | 4568 | 4569 |
| 343 | 2066 | 2067 | 4570 | 4571 |
| 344 | 2068 | 2069 | 4572 | 4573 |
| 345 | 2070 | 2071 | 4574 | 4575 |
| 346 | 2072 | 2073 | 4576 | 4577 |
| 347 | 2074 | 2075 | 4578 | 4579 |
| 348 | 2076 | 2077 | 4580 | 4581 |
| 349 | 2078 | 2079 | 4582 | 4583 |
| 350 | 2080 | 2081 | 4584 | 4585 |
| 351 | 2082 | 2083 | 4586 | 4587 |
| 352 | 2084 | 2085 | 4588 | 4589 |
| 353 | 2088 | 2089 | 4592 | 4593 |
| 354 | 2090 | 2091 | 4594 | 4595 |
| 355 | 2092 | 2093 | 4596 | 4597 |
| 356 | 2094 | 2095 | 4598 | 4599 |
| 357 | 2096 | 2097 | 4600 | 4601 |
| 358 | 2100 | 2101 | 4604 | 4605 |
| 359 | 2102 | 2103 | 4606 | 4607 |
| 360 | 2104 | 2105 | 4608 | 4609 |
| 361 | 2106 | 2107 | 4610 | 4611 |
| 362 | 2108 | 2109 | 4612 | 4613 |
| 363 | 2110 | 2111 | 4614 | 4615 |
| 364 | 2112 | 2113 | 4616 | 4617 |
| 365 | 2114 | 2115 | 4618 | 4619 |
| 366 | 2116 | 2117 | 4620 | 4621 |
| 367 | 2118 | 2119 | 4622 | 4623 |
| 368 | 2120 | 2121 | 4624 | 4625 |
| 369 | 2122 | 2123 | 4626 | 4627 |
| 370 | 2124 | 2125 | 4628 | 4629 |
| 371 | 2128 | 2129 | 4632 | 4633 |
| 372 | 2130 | 2131 | 4634 | 4635 |
| 373 | 2134 | 2135 | 4638 | 4639 |
| 374 | 2136 | 2137 | 4640 | 4641 |
| 375 | 2138 | 2139 | 4642 | 4643 |
| 376 | 2140 | 2141 | 4644 | 4645 |
| 377 | 2142 | 2143 | 4646 | 4647 |
| 378 | 2144 | 2145 | 4648 | 4649 |
| 379 | 2146 | 2147 | 4650 | 4651 |
| 380 | 2148 | 2149 | 4652 | 4653 |
| 381 | 2150 | 2151 | 4654 | 4655 |
| 382 | 2152 | 2153 | 4656 | 4657 |
| 383 | 2154 | 2155 | 4658 | 4659 |
| 384 | 2156 | 2157 | 4660 | 4661 |
| 385 | 2158 | 2159 | 4662 | 4663 |
| 386 | 2160 | 2161 | 4664 | 4665 |
| 387 | 2162 | 2163 | 4666 | 4667 |
| 388 | 2164 | 2165 | 4668 | 4669 |
| 389 | 2170 | 2171 | 4674 | 4675 |
| 390 | 2172 | 2173 | 4676 | 4677 |
| 391 | 2174 | 2175 | 4678 | 4679 |
| 392 | 2176 | 2177 | 4680 | 4681 |
| 393 | 2178 | 2179 | 4682 | 4683 |
| 394 | 2180 | 2181 | 4684 | 4685 |
| 395 | 2182 | 2183 | 4686 | 4687 |
| 396 | 2186 | 2187 | 4690 | 4691 |
| 397 | 2190 | 2191 | 4694 | 4695 |
| 398 | 2188 | 2189 | 4692 | 4693 |
| 399 | 2194 | 2195 | 4698 | 4699 |
| 400 | 2192 | 2193 | 4696 | 4697 |
| 401 | 2196 | 2197 | 4700 | 4701 |
| 402 | 2200 | 2201 | 4704 | 4705 |
| 403 | 2198 | 2199 | 4702 | 4703 |
| 404 | 2202 | 2203 | 4706 | 4707 |
| 405 | 2204 | 2205 | 4708 | 4709 |
| 406 | 2206 | 2207 | 4710 | 4711 |
| 407 | 2208 | 2209 | 4712 | 4713 |
| 408 | 2210 | 2211 | 4714 | 4715 |
| 409 | 2212 | 2213 | 4716 | 4717 |

TABLE 4-continued

| SEQ ID NO (ORF) | Fp | Fd | Bp | Bd |
|---|---|---|---|---|
| 410 | 2214 | 2215 | 4718 | 4719 |
| 411 | 2216 | 2217 | 4720 | 4721 |
| 412 | 2218 | 2219 | 4722 | 4723 |
| 413 | 2220 | 2221 | 4724 | 4725 |
| 414 | 2222 | 2223 | 4726 | 4727 |
| 415 | 2224 | 2225 | 4728 | 4729 |
| 416 | 2226 | 2227 | 4730 | 4731 |
| 417 | 2228 | 2229 | 4732 | 4733 |
| 418 | 2230 | 2231 | 4734 | 4735 |
| 419 | 2232 | 2233 | 4736 | 4737 |
| 420 | 2234 | 2235 | 4738 | 4739 |
| 421 | 2236 | 2237 | 4740 | 4741 |
| 422 | 2238 | 2239 | 4742 | 4743 |
| 423 | 2242 | 2243 | 4746 | 4747 |
| 424 | 2244 | 2245 | 4748 | 4749 |
| 425 | 2246 | 2247 | 4750 | 4751 |
| 426 | 2248 | 2249 | 4752 | 4753 |
| 427 | 2250 | 2251 | 4754 | 4755 |
| 428 | 2252 | 2253 | 4756 | 4757 |
| 429 | 2254 | 2255 | 4758 | 4759 |
| 430 | 2256 | 2257 | 4760 | 4761 |
| 431 | 2258 | 2259 | 4762 | 4763 |
| 432 | 2260 | 2261 | 4764 | 4765 |
| 433 | 2262 | 2263 | 4766 | 4767 |
| 434 | 2266 | 2267 | 4770 | 4771 |
| 435 | 2264 | 2265 | 4768 | 4769 |
| 436 | 2268 | 2269 | 4772 | 4773 |
| 437 | 2270 | 2271 | 4774 | 4775 |
| 438 | 2272 | 2273 | 4776 | 4777 |
| 439 | 2274 | 2275 | 4778 | 4779 |
| 440 | 2278 | 2279 | 4782 | 4783 |
| 441 | 2280 | 2281 | 4784 | 4785 |
| 442 | 2282 | 2283 | 4786 | 4787 |
| 443 | 2284 | 2285 | 4788 | 4789 |
| 444 | 2286 | 2287 | 4790 | 4791 |
| 445 | 2288 | 2289 | 4792 | 4793 |
| 446 | 2290 | 2291 | 4794 | 4795 |
| 447 | 2292 | 2293 | 4796 | 4797 |
| 448 | 2294 | 2295 | 4798 | 4799 |
| 449 | 2296 | 2297 | 4800 | 4801 |
| 450 | 2298 | 2299 | 4802 | 4803 |
| 451 | 2304 | 2305 | 4808 | 4809 |
| 452 | 2306 | 2307 | 4810 | 4811 |
| 453 | 2308 | 2309 | 4812 | 4813 |
| 454 | 2310 | 2311 | 4814 | 4815 |
| 455 | 2312 | 2313 | 4816 | 4817 |
| 456 | 2314 | 2315 | 4818 | 4819 |
| 457 | 2316 | 2317 | 4820 | 4821 |
| 458 | 2318 | 2319 | 4822 | 4823 |
| 459 | 2320 | 2321 | 4824 | 4825 |
| 460 | 2322 | 2323 | 4826 | 4827 |
| 461 | 2324 | 2325 | 4828 | 4829 |
| 462 | 2326 | 2327 | 4830 | 4831 |
| 463 | 2328 | 2329 | 4832 | 4833 |
| 464 | 2332 | 2333 | 4836 | 4837 |
| 465 | 2334 | 2335 | 4838 | 4839 |
| 466 | 2338 | 2339 | 4842 | 4843 |
| 467 | 2340 | 2341 | 4844 | 4845 |
| 468 | 2342 | 2343 | 4846 | 4847 |
| 469 | 2344 | 2345 | 4848 | 4849 |
| 470 | 2346 | 2347 | 4850 | 4851 |
| 471 | 2348 | 2349 | 4852 | 4853 |
| 472 | 2350 | 2351 | 4854 | 4855 |
| 473 | 2352 | 2353 | 4856 | 4857 |
| 474 | 2356 | 2357 | 4860 | 4861 |
| 475 | 2354 | 2355 | 4858 | 4859 |
| 476 | 2358 | 2359 | 4862 | 4863 |
| 477 | 2360 | 2361 | 4864 | 4865 |
| 478 | 2362 | 2363 | 4866 | 4867 |
| 479 | 2364 | 2365 | 4868 | 4869 |
| 480 | 2366 | 2367 | 4870 | 4871 |
| 481 | 2368 | 2369 | 4872 | 4873 |
| 482 | 2370 | 2371 | 4874 | 4875 |
| 483 | 2372 | 2373 | 4876 | 4877 |
| 484 | 2374 | 2375 | 4878 | 4879 |
| 485 | 2376 | 2377 | 4880 | 4881 |
| 486 | 2378 | 2379 | 4882 | 4883 |

TABLE 4-continued

| SEQ ID NO (ORF) | Fp | Fd | Bp | Bd |
|---|---|---|---|---|
| 487 | 2380 | 2381 | 4884 | 4885 |
| 488 | 2382 | 2383 | 4886 | 4887 |
| 489 | 2384 | 2385 | 4888 | 4889 |
| 490 | 2386 | 2387 | 4890 | 4891 |
| 491 | 2388 | 2389 | 4892 | 4893 |
| 492 | 2390 | 2391 | 4894 | 4895 |
| 493 | 2392 | 2393 | 4896 | 4897 |
| 494 | 2394 | 2395 | 4898 | 4899 |
| 495 | 2396 | 2397 | 4900 | 4901 |
| 496 | 2398 | 2399 | 4902 | 4903 |
| 497 | 2400 | 2401 | 4904 | 4905 |
| 498 | 2402 | 2403 | 4906 | 4907 |
| 499 | 2404 | 2405 | 4908 | 4909 |
| 500 | 2406 | 2407 | 4910 | 4911 |
| 501 | 2408 | 2409 | 4912 | 4913 |
| 502 | 2410 | 2411 | 4914 | 4915 |
| 503 | 2412 | 2413 | 4916 | 4917 |
| 504 | 2414 | 2415 | 4918 | 4919 |
| 505 | 2416 | 2417 | 4920 | 4921 |
| 506 | 2418 | 2419 | 4922 | 4923 |
| 507 | 2420 | 2421 | 4924 | 4925 |
| 508 | 2422 | 2423 | 4926 | 4927 |
| 509 | 2426 | 2427 | 4930 | 4931 |
| 510 | 2424 | 2425 | 4928 | 4929 |
| 511 | 2430 | 2431 | 4934 | 4935 |
| 512 | 2428 | 2429 | 4932 | 4933 |
| 513 | 2432 | 2433 | 4936 | 4937 |
| 514 | 2434 | 2435 | 4938 | 4939 |
| 515 | 2436 | 2437 | 4940 | 4941 |
| 516 | 2438 | 2439 | 4942 | 4943 |
| 517 | 2440 | 2441 | 4944 | 4945 |
| 518 | 2442 | 2443 | 4946 | 4947 |
| 519 | 2444 | 2445 | 4948 | 4949 |
| 520 | 2446 | 2447 | 4950 | 4951 |
| 521 | 2450 | 2451 | 4954 | 4955 |
| 522 | 2454 | 2455 | 4958 | 4959 |
| 523 | 2456 | 2457 | 4960 | 4961 |
| 524 | 2458 | 2459 | 4962 | 4963 |
| 525 | 2460 | 2461 | 4964 | 4965 |
| 526 | 2462 | 2463 | 4966 | 4967 |
| 527 | 2466 | 2467 | 4970 | 4971 |
| 528 | 2464 | 2465 | 4968 | 4969 |
| 529 | 2468 | 2469 | 4972 | 4973 |
| 530 | 2470 | 2471 | 4974 | 4975 |
| 531 | 2472 | 2473 | 4976 | 4977 |
| 532 | 2474 | 2475 | 4978 | 4979 |
| 533 | 2476 | 2477 | 4980 | 4981 |
| 534 | 2478 | 2479 | 4982 | 4983 |
| 535 | 2480 | 2481 | 4984 | 4985 |
| 536 | 2482 | 2483 | 4986 | 4987 |
| 537 | 2486 | 2487 | 4990 | 4991 |
| 538 | 2488 | 2489 | 4992 | 4993 |
| 539 | 2490 | 2491 | 4994 | 4995 |
| 540 | 2492 | 2493 | 4996 | 4997 |
| 541 | 2494 | 2495 | 4998 | 4999 |
| 542 | 2496 | 2497 | 5000 | 5001 |
| 543 | 2498 | 2499 | 5002 | 5003 |
| 544 | 2500 | 2501 | 5004 | 5005 |
| 545 | 2502 | 2503 | 5006 | 5007 |
| 546 | 2504 | 2505 | 5008 | 5009 |
| 547 | 2506 | 2507 | 5010 | 5011 |
| 548 | 2508 | 2509 | 5012 | 5013 |
| 549 | 2510 | 2511 | 5014 | 5015 |
| 550 | 2514 | 2515 | 5018 | 5019 |
| 551 | 2516 | 2517 | 5020 | 5021 |
| 552 | 2518 | 2519 | 5022 | 5023 |
| 553 | 2520 | 2521 | 5024 | 5025 |
| 554 | 2522 | 2523 | 5026 | 5027 |
| 555 | 2524 | 2525 | 5028 | 5029 |
| 556 | 2526 | 2527 | 5030 | 5031 |
| 557 | 2528 | 2529 | 5032 | 5033 |
| 558 | 2532 | 2533 | 5036 | 5037 |
| 559 | 2534 | 2535 | 5038 | 5039 |
| 560 | 2536 | 2537 | 5040 | 5041 |
| 561 | 2538 | 2539 | 5042 | 5043 |
| 562 | 2544 | 2545 | 5048 | 5049 |
| 563 | 2546 | 2547 | 5050 | 5051 |

TABLE 4-continued

| SEQ ID NO (ORF) | Fp | Fd | Bp | Bd |
|---|---|---|---|---|
| 564 | 2548 | 2549 | 5052 | 5053 |
| 565 | 2552 | 2553 | 5056 | 5057 |
| 566 | 2550 | 2551 | 5054 | 5055 |
| 567 | 2554 | 2555 | 5058 | 5059 |
| 568 | 2556 | 2557 | 5060 | 5061 |
| 569 | 2558 | 2559 | 5062 | 5063 |
| 570 | 2560 | 2561 | 5064 | 5065 |
| 571 | 2562 | 2563 | 5066 | 5067 |
| 572 | 2564 | 2565 | 5068 | 5069 |
| 573 | 2566 | 2567 | 5070 | 5071 |
| 574 | 2568 | 2569 | 5072 | 5073 |
| 575 | 2570 | 2571 | 5074 | 5075 |
| 576 | 2572 | 2573 | 5076 | 5077 |
| 577 | 2574 | 2575 | 5078 | 5079 |
| 578 | 2576 | 2577 | 5080 | 5081 |
| 579 | 2578 | 2579 | 5082 | 5083 |
| 580 | 2580 | 2581 | 5084 | 5085 |
| 581 | 2582 | 2583 | 5086 | 5087 |
| 582 | 2590 | 2591 | 5094 | 5095 |
| 583 | 2592 | 2593 | 5096 | 5097 |
| 584 | 2594 | 2595 | 5098 | 5099 |
| 585 | 2596 | 2597 | 5100 | 5101 |
| 586 | 2598 | 2599 | 5102 | 5103 |
| 587 | 2600 | 2601 | 5104 | 5105 |
| 588 | 2602 | 2603 | 5106 | 5107 |
| 589 | 2604 | 2605 | 5108 | 5109 |
| 590 | 2606 | 2607 | 5110 | 5111 |
| 591 | 2608 | 2609 | 5112 | 5113 |
| 592 | 2610 | 2611 | 5114 | 5115 |
| 593 | 2612 | 2613 | 5116 | 5117 |
| 594 | 2616 | 2617 | 5120 | 5121 |
| 595 | 2618 | 2619 | 5122 | 5123 |
| 596 | 2620 | 2621 | 5124 | 5125 |
| 597 | 2622 | 2623 | 5126 | 5127 |
| 598 | 2624 | 2625 | 5128 | 5129 |
| 599 | 2626 | 2627 | 5130 | 5131 |
| 600 | 2628 | 2629 | 5132 | 5133 |
| 601 | 2630 | 2631 | 5134 | 5135 |
| 602 | 2632 | 2633 | 5136 | 5137 |
| 603 | 2634 | 2635 | 5138 | 5139 |
| 604 | 2636 | 2637 | 5140 | 5141 |
| 605 | 2638 | 2639 | 5142 | 5143 |
| 606 | 2640 | 2641 | 5144 | 5145 |
| 607 | 2642 | 2643 | 5146 | 5147 |
| 608 | 2644 | 2645 | 5148 | 5149 |
| 609 | 2646 | 2647 | 5150 | 5151 |
| 610 | 2650 | 2651 | 5154 | 5155 |
| 611 | 2648 | 2649 | 5152 | 5153 |
| 612 | 2652 | 2653 | 5156 | 5157 |
| 613 | 2654 | 2655 | 5158 | 5159 |
| 614 | 2656 | 2657 | 5160 | 5161 |
| 615 | 2658 | 2659 | 5162 | 5163 |
| 616 | 2660 | 2661 | 5164 | 5165 |
| 617 | 2662 | 2663 | 5166 | 5167 |
| 618 | 2664 | 2665 | 5168 | 5169 |
| 619 | 2666 | 2667 | 5170 | 5171 |
| 620 | 2668 | 2669 | 5172 | 5173 |
| 621 | 2672 | 2673 | 5176 | 5177 |
| 622 | 2674 | 2675 | 5178 | 5179 |
| 623 | 2678 | 2679 | 5182 | 5183 |
| 624 | 2676 | 2677 | 5180 | 5181 |
| 625 | 2680 | 2681 | 5184 | 5185 |
| 626 | 2682 | 2683 | 5186 | 5187 |
| 627 | 2684 | 2685 | 5188 | 5189 |
| 628 | 2686 | 2687 | 5190 | 5191 |
| 629 | 2688 | 2689 | 5192 | 5193 |
| 630 | 2690 | 2691 | 5194 | 5195 |
| 631 | 2692 | 2693 | 5196 | 5197 |
| 632 | 2696 | 2697 | 5200 | 5201 |
| 633 | 2698 | 2699 | 5202 | 5203 |
| 634 | 2700 | 2701 | 5204 | 5205 |
| 635 | 2702 | 2703 | 5206 | 5207 |
| 636 | 2704 | 2705 | 5208 | 5209 |
| 637 | 2706 | 2707 | 5210 | 5211 |
| 638 | 2710 | 2711 | 5214 | 5215 |
| 639 | 2712 | 2713 | 5216 | 5217 |
| 640 | 2714 | 2715 | 5218 | 5219 |
| 641 | 2716 | 2117 | 5220 | 5221 |
| 642 | 2718 | 2719 | 5222 | 5223 |
| 643 | 2720 | 2721 | 5224 | 5225 |
| 644 | 2722 | 2723 | 5226 | 5227 |
| 645 | 2724 | 2725 | 5228 | 5229 |
| 646 | 2726 | 2727 | 5230 | 5231 |
| 647 | 2728 | 2729 | 5232 | 5233 |
| 648 | 2732 | 2733 | 5236 | 5237 |
| 649 | 2736 | 2737 | 5240 | 5241 |
| 650 | 2738 | 2739 | 5242 | 5243 |
| 651 | 2740 | 2741 | 5244 | 5245 |
| 652 | 2742 | 2743 | 5246 | 5247 |
| 653 | 2744 | 2745 | 5248 | 5249 |
| 654 | 2748 | 2749 | 5252 | 5253 |
| 655 | 2750 | 2751 | 5254 | 5255 |
| 656 | 2752 | 2753 | 5256 | 5257 |
| 657 | 2754 | 2755 | 5258 | 5259 |
| 658 | 2756 | 2757 | 5260 | 5261 |
| 659 | 2758 | 2759 | 5262 | 5263 |
| 660 | 2760 | 2761 | 5264 | 5265 |
| 661 | 2762 | 2763 | 5266 | 5267 |
| 662 | 2764 | 2765 | 5268 | 5269 |
| 663 | 2766 | 2767 | 5270 | 5271 |
| 664 | 2768 | 2769 | 5272 | 5273 |
| 665 | 2770 | 2771 | 5274 | 5275 |
| 666 | 2772 | 2773 | 5276 | 5277 |
| 667 | 2774 | 2775 | 5278 | 5279 |
| 668 | 2776 | 2777 | 5280 | 5281 |
| 669 | 2778 | 2779 | 5282 | 5283 |
| 670 | 2780 | 2781 | 5284 | 5285 |
| 671 | 2782 | 2783 | 5286 | 5287 |
| 672 | 2784 | 2785 | 5288 | 5289 |
| 673 | 2786 | 2787 | 5290 | 5291 |
| 674 | 2788 | 2789 | 5292 | 5293 |
| 675 | 2790 | 2791 | 5294 | 5295 |
| 676 | 2792 | 2793 | 5296 | 5297 |
| 677 | 2794 | 2795 | 5298 | 5299 |
| 678 | 2796 | 2797 | 5300 | 5301 |
| 679 | 2798 | 2799 | 5302 | 5303 |
| 680 | 2800 | 2801 | 5304 | 5305 |
| 681 | 2804 | 2805 | 5308 | 5309 |
| 682 | 2806 | 2807 | 5310 | 5311 |
| 683 | 2808 | 2809 | 5312 | 5313 |
| 684 | 2810 | 2811 | 5314 | 5315 |
| 685 | 2812 | 2813 | 5316 | 5317 |
| 686 | 2814 | 2815 | 5318 | 5319 |
| 687 | 2816 | 2817 | 5320 | 5321 |
| 688 | 2818 | 2819 | 5322 | 5323 |
| 689 | 2820 | 2821 | 5324 | 5325 |
| 690 | 2822 | 2823 | 5326 | 5327 |
| 691 | 2824 | 2825 | 5328 | 5329 |
| 692 | 2826 | 2827 | 5330 | 5331 |
| 693 | 2828 | 2829 | 5332 | 5333 |
| 694 | 2830 | 2831 | 5334 | 5335 |
| 695 | 2832 | 2833 | 5336 | 5337 |
| 696 | 2834 | 2835 | 5338 | 5339 |
| 697 | 2836 | 2837 | 5340 | 5341 |
| 698 | 2838 | 2839 | 5342 | 5343 |
| 699 | 2840 | 2841 | 5344 | 5345 |
| 700 | 2842 | 2843 | 5346 | 5347 |
| 701 | 2844 | 2845 | 5348 | 5349 |
| 702 | 2846 | 2847 | 5350 | 5351 |
| 703 | 2848 | 2849 | 5352 | 5353 |
| 704 | 2850 | 2851 | 5354 | 5355 |
| 705 | 2852 | 2853 | 5356 | 5357 |
| 706 | 2854 | 2855 | 5358 | 5359 |
| 707 | 2856 | 2857 | 5360 | 5361 |
| 708 | 2858 | 2859 | 5362 | 5363 |
| 709 | 2860 | 2861 | 5364 | 5365 |
| 710 | 2862 | 2863 | 5366 | 5367 |
| 711 | 2864 | 2865 | 5368 | 5369 |
| 712 | 2866 | 2867 | 5370 | 5371 |
| 713 | 2868 | 2869 | 5372 | 5373 |
| 714 | 2870 | 2871 | 5374 | 5375 |
| 715 | 2872 | 2873 | 5376 | 5377 |
| 716 | 2874 | 2875 | 5378 | 5379 |
| 717 | 2876 | 2877 | 5380 | 5381 |

TABLE 4-continued

| SEQ ID NO (ORF) | Fp | Fd | Bp | Bd |
|---|---|---|---|---|
| 718 | 2878 | 2879 | 5382 | 5383 |
| 719 | 2880 | 2881 | 5384 | 5385 |
| 720 | 2882 | 2883 | 5386 | 5387 |
| 721 | 2886 | 2887 | 5390 | 5391 |
| 722 | 2888 | 2889 | 5392 | 5393 |
| 723 | 2884 | 2885 | 5388 | 5389 |
| 724 | 2890 | 2891 | 5394 | 5395 |
| 725 | 2892 | 2893 | 5396 | 5397 |
| 726 | 2894 | 2895 | 5398 | 5399 |
| 727 | 2896 | 2897 | 5400 | 5401 |
| 728 | 2900 | 2901 | 5404 | 5405 |
| 729 | 2902 | 2903 | 5406 | 5407 |
| 730 | 2904 | 2905 | 5408 | 5409 |
| 731 | 2906 | 2907 | 5410 | 5411 |
| 732 | 2908 | 2909 | 5412 | 5413 |
| 733 | 2910 | 2911 | 5414 | 5415 |
| 734 | 2912 | 2913 | 5416 | 5417 |
| 735 | 2914 | 2915 | 5418 | 5419 |
| 736 | 2916 | 2917 | 5420 | 5421 |
| 737 | 2918 | 2919 | 5422 | 5423 |
| 738 | 2920 | 2921 | 5424 | 5425 |
| 739 | 2922 | 2923 | 5426 | 5427 |
| 740 | 2924 | 2925 | 5428 | 5429 |
| 741 | 2926 | 2927 | 5430 | 5431 |
| 742 | 2928 | 2929 | 5432 | 5433 |
| 743 | 2930 | 2931 | 5434 | 5435 |
| 744 | 2932 | 2933 | 5436 | 5437 |
| 745 | 2934 | 2935 | 5438 | 5439 |
| 746 | 2936 | 2937 | 5440 | 5441 |
| 747 | 2938 | 2939 | 5442 | 5443 |
| 748 | 2940 | 2941 | 5444 | 5445 |
| 749 | 2942 | 2943 | 5446 | 5447 |
| 750 | 2944 | 2945 | 5448 | 5449 |
| 751 | 2946 | 2947 | 5450 | 5451 |
| 752 | 2948 | 2949 | 5452 | 5453 |
| 753 | 2952 | 2953 | 5456 | 5457 |
| 754 | 2954 | 2955 | 5458 | 5459 |
| 755 | 2956 | 2957 | 5460 | 5461 |
| 756 | 2958 | 2959 | 5462 | 5463 |
| 757 | 2960 | 2961 | 5464 | 5465 |
| 758 | 2962 | 2963 | 5466 | 5467 |
| 759 | 2964 | 2965 | 5468 | 5469 |
| 760 | 2966 | 2967 | 5470 | 5471 |
| 761 | 2968 | 2969 | 5472 | 5473 |
| 762 | 2970 | 2971 | 5474 | 5475 |
| 763 | 2972 | 2973 | 5476 | 5477 |
| 764 | 2974 | 2975 | 5478 | 5479 |
| 765 | 2976 | 2977 | 5480 | 5481 |
| 766 | 2978 | 2979 | 5482 | 5483 |
| 767 | 2980 | 2981 | 5484 | 5485 |
| 768 | 2982 | 2983 | 5486 | 5487 |
| 769 | 2984 | 2985 | 5488 | 5489 |
| 770 | 2986 | 2987 | 5490 | 5491 |
| 771 | 2990 | 2991 | 5494 | 5495 |
| 772 | 2992 | 2993 | 5496 | 5497 |
| 773 | 2994 | 2995 | 5498 | 5499 |
| 774 | 2996 | 2997 | 5500 | 5501 |
| 775 | 2998 | 2999 | 5502 | 5503 |
| 776 | 3000 | 3001 | 5504 | 5505 |
| 777 | 3002 | 3003 | 5506 | 5507 |
| 778 | 3004 | 3005 | 5508 | 5509 |
| 779 | 3006 | 3007 | 5510 | 5511 |
| 780 | 3008 | 3009 | 5512 | 5513 |
| 781 | 3010 | 3011 | 5514 | 5515 |
| 782 | 3012 | 3013 | 5516 | 5517 |
| 783 | 3014 | 3015 | 5518 | 5519 |
| 784 | 3016 | 3017 | 5520 | 5521 |
| 785 | 3020 | 3021 | 5524 | 5525 |
| 786 | 3022 | 3023 | 5526 | 5527 |
| 787 | 3024 | 3025 | 5528 | 5529 |
| 788 | 3026 | 3027 | 5530 | 5531 |
| 789 | 3028 | 3029 | 5532 | 5533 |
| 790 | 3030 | 3031 | 5534 | 5535 |
| 791 | 3032 | 3033 | 5536 | 5537 |
| 792 | 3034 | 3035 | 5538 | 5539 |
| 793 | 3036 | 3037 | 5540 | 5541 |
| 794 | 3038 | 3039 | 5542 | 5543 |
| 795 | 3040 | 3041 | 5544 | 5545 |
| 796 | 3042 | 3043 | 5546 | 5547 |
| 797 | 3044 | 3045 | 5548 | 5549 |
| 798 | 3046 | 3047 | 5550 | 5551 |
| 799 | 3048 | 3049 | 5552 | 5553 |
| 800 | 3050 | 3051 | 5554 | 5555 |
| 801 | 3052 | 3053 | 5556 | 5557 |
| 802 | 3054 | 3055 | 5558 | 5559 |
| 803 | 3056 | 3057 | 5560 | 5561 |
| 804 | 3058 | 3059 | 5562 | 5563 |
| 805 | 3060 | 3061 | 5564 | 5565 |
| 806 | 3062 | 3063 | 5566 | 5567 |
| 807 | 3064 | 3065 | 5568 | 5569 |
| 808 | 3066 | 3067 | 5570 | 5571 |
| 809 | 3068 | 3069 | 5572 | 5573 |
| 810 | 3070 | 3071 | 5574 | 5575 |
| 811 | 3072 | 3073 | 5576 | 5577 |
| 812 | 3074 | 3075 | 5578 | 5579 |
| 813 | 3076 | 3077 | 5580 | 5581 |
| 814 | 3078 | 3079 | 5582 | 5583 |
| 815 | 3080 | 3081 | 5584 | 5585 |
| 816 | 3082 | 3083 | 5586 | 5587 |
| 817 | 3084 | 3085 | 5588 | 5589 |
| 818 | 3086 | 3087 | 5590 | 5591 |
| 819 | 3088 | 3089 | 5592 | 5593 |
| 820 | 3090 | 3091 | 5594 | 5595 |
| 821 | 3092 | 3093 | 5596 | 5597 |
| 822 | 3094 | 3095 | 5598 | 5599 |
| 823 | 3096 | 3097 | 5600 | 5601 |
| 824 | 3100 | 3101 | 5604 | 5605 |
| 825 | 3102 | 3103 | 5606 | 5607 |
| 826 | 3104 | 3105 | 5608 | 5609 |
| 827 | 3106 | 3107 | 5610 | 5611 |
| 828 | 3108 | 3109 | 5612 | 5613 |
| 829 | 3110 | 3111 | 5614 | 5615 |
| 830 | 3112 | 3113 | 5616 | 5617 |
| 831 | 3114 | 3115 | 5618 | 5619 |
| 832 | 3116 | 3117 | 5620 | 5621 |
| 833 | 3120 | 3121 | 5624 | 5625 |
| 834 | 3124 | 3125 | 5628 | 5629 |
| 835 | 3122 | 3123 | 5626 | 5627 |
| 836 | 3128 | 3129 | 5632 | 5633 |
| 837 | 3130 | 3131 | 5634 | 5635 |
| 838 | 3132 | 3133 | 5636 | 5637 |
| 839 | 3134 | 3135 | 5638 | 5639 |
| 840 | 3136 | 3137 | 5640 | 5641 |
| 841 | 3138 | 3139 | 5642 | 5643 |
| 842 | 3140 | 3141 | 5644 | 5645 |
| 843 | 3142 | 3143 | 5646 | 5647 |
| 844 | 3144 | 3145 | 5648 | 5649 |
| 845 | 3146 | 3147 | 5650 | 5651 |
| 846 | 3148 | 3149 | 5652 | 5653 |
| 847 | 3150 | 3151 | 5654 | 5655 |
| 848 | 3152 | 3153 | 5656 | 5657 |
| 849 | 3154 | 3155 | 5658 | 5659 |
| 850 | 3156 | 3157 | 5660 | 5661 |
| 851 | 3158 | 3159 | 5662 | 5663 |
| 852 | 3160 | 3161 | 5664 | 5665 |
| 853 | 3164 | 3165 | 5668 | 5669 |
| 854 | 3162 | 3163 | 5666 | 5667 |
| 855 | 3166 | 3167 | 5670 | 5671 |
| 856 | 3168 | 3169 | 5672 | 5673 |
| 857 | 3170 | 3171 | 5674 | 5675 |
| 858 | 3172 | 3173 | 5676 | 5677 |
| 859 | 3174 | 3175 | 5678 | 5679 |
| 860 | 3176 | 3177 | 5680 | 5681 |
| 861 | 3180 | 3181 | 5684 | 5685 |
| 862 | 3178 | 3179 | 5682 | 5683 |
| 863 | 3182 | 3183 | 5686 | 5687 |
| 864 | 3184 | 3185 | 5688 | 5689 |
| 865 | 3186 | 3187 | 5690 | 5691 |
| 866 | 3188 | 3189 | 5692 | 5693 |
| 867 | 3190 | 3191 | 5694 | 5695 |
| 868 | 3192 | 3193 | 5696 | 5697 |
| 869 | 3194 | 3195 | 5698 | 5699 |
| 870 | 3196 | 3197 | 5700 | 5701 |
| 871 | 3198 | 3199 | 5702 | 5703 |

TABLE 4-continued

| SEQ ID NO (ORF) | Fp | Fd | Bp | Bd |
|---|---|---|---|---|
| 872 | 3200 | 3201 | 5704 | 5705 |
| 873 | 3202 | 3203 | 5706 | 5707 |
| 874 | 3204 | 3205 | 5708 | 5709 |
| 875 | 3206 | 3207 | 5710 | 5711 |
| 876 | 3210 | 3211 | 5714 | 5715 |
| 877 | 3212 | 3213 | 5716 | 5717 |
| 878 | 3214 | 3215 | 5718 | 5719 |
| 879 | 3216 | 3217 | 5720 | 5721 |
| 880 | 3218 | 3219 | 5722 | 5723 |
| 881 | 3220 | 3221 | 5724 | 5725 |
| 882 | 3222 | 3223 | 5726 | 5727 |
| 883 | 3224 | 3225 | 5728 | 5729 |
| 884 | 3226 | 3227 | 5730 | 5731 |
| 885 | 3228 | 3229 | 5732 | 5733 |
| 886 | 3230 | 3231 | 5734 | 5735 |
| 887 | 3232 | 3233 | 5736 | 5737 |
| 888 | 3234 | 3235 | 5738 | 5739 |
| 889 | 3236 | 3237 | 5740 | 5741 |
| 890 | 3238 | 3239 | 5742 | 5743 |
| 891 | 3240 | 3241 | 5744 | 5745 |
| 892 | 3244 | 3245 | 5748 | 5749 |
| 893 | 3246 | 3247 | 5750 | 5751 |
| 894 | 3248 | 3249 | 5752 | 5753 |
| 895 | 3250 | 3251 | 5754 | 5755 |
| 896 | 3252 | 3253 | 5756 | 5757 |
| 897 | 3254 | 3255 | 5758 | 5759 |
| 898 | 3256 | 3257 | 5760 | 5761 |
| 899 | 3258 | 3259 | 5762 | 5763 |
| 900 | 3260 | 3261 | 5764 | 5765 |
| 901 | 3262 | 3263 | 5766 | 5767 |
| 902 | 3264 | 3265 | 5768 | 5769 |
| 903 | 3266 | 3267 | 5770 | 5771 |
| 904 | 3268 | 3269 | 5772 | 5773 |
| 905 | 3270 | 3271 | 5774 | 5775 |
| 906 | 3272 | 3273 | 5776 | 5777 |
| 907 | 3274 | 3275 | 5778 | 5779 |
| 908 | 3276 | 3277 | 5780 | 5781 |
| 909 | 3278 | 3279 | 5782 | 5783 |
| 910 | 3280 | 3281 | 5784 | 5785 |
| 911 | 3282 | 3283 | 5786 | 5787 |
| 912 | 3284 | 3285 | 5788 | 5789 |
| 913 | 3286 | 3287 | 5790 | 5791 |
| 914 | 3288 | 3289 | 5792 | 5793 |
| 915 | 3290 | 3291 | 5794 | 5795 |
| 916 | 3292 | 3293 | 5796 | 5797 |
| 917 | 3296 | 3297 | 5800 | 5801 |
| 918 | 3298 | 3299 | 5802 | 5803 |
| 919 | 3300 | 3301 | 5804 | 5805 |
| 920 | 3302 | 3303 | 5806 | 5807 |
| 921 | 3304 | 3305 | 5808 | 5809 |
| 922 | 3306 | 3307 | 5810 | 5811 |
| 923 | 3308 | 3309 | 5812 | 5813 |
| 924 | 3310 | 3311 | 5814 | 5815 |
| 925 | 3316 | 3317 | 5820 | 5821 |
| 926 | 3314 | 3315 | 5818 | 5819 |
| 927 | 3324 | 3325 | 5828 | 5829 |
| 928 | 3326 | 3327 | 5830 | 5831 |
| 929 | 3328 | 3329 | 5832 | 5833 |
| 930 | 3330 | 3331 | 5834 | 5835 |
| 931 | 3338 | 3339 | 5842 | 5843 |
| 932 | 3336 | 3337 | 5840 | 5841 |
| 933 | 3340 | 3341 | 5844 | 5845 |
| 934 | 3342 | 3343 | 5846 | 5847 |
| 935 | 3344 | 3345 | 5848 | 5849 |
| 936 | 3346 | 3347 | 5850 | 5851 |
| 937 | 3348 | 3349 | 5852 | 5853 |
| 938 | 3350 | 3351 | 5854 | 5855 |
| 939 | 3352 | 3353 | 5856 | 5857 |
| 940 | 3354 | 3355 | 5858 | 5859 |
| 941 | 3356 | 3357 | 5860 | 5861 |
| 942 | 3360 | 3361 | 5864 | 5865 |
| 943 | 3362 | 3363 | 5866 | 5867 |
| 944 | 3364 | 3365 | 5868 | 5869 |
| 945 | 3366 | 3367 | 5870 | 5871 |
| 946 | 3368 | 3369 | 5872 | 5873 |
| 947 | 3370 | 3371 | 5874 | 5875 |
| 948 | 3374 | 3375 | 5878 | 5879 |
| 949 | 3378 | 3379 | 5882 | 5883 |
| 950 | 3376 | 3377 | 5880 | 5881 |
| 951 | 3380 | 3381 | 5884 | 5885 |
| 952 | 3382 | 3383 | 5886 | 5887 |
| 953 | 3384 | 3385 | 5888 | 5889 |
| 954 | 3386 | 3387 | 5890 | 5891 |
| 955 | 3388 | 3389 | 5892 | 5893 |
| 956 | 3390 | 3391 | 5894 | 5895 |
| 957 | 3392 | 3393 | 5896 | 5897 |
| 958 | 3394 | 3395 | 5898 | 5899 |
| 959 | 3396 | 3397 | 5900 | 5901 |
| 960 | 3398 | 3399 | 5902 | 5903 |
| 961 | 3400 | 3401 | 5904 | 5905 |
| 962 | 3402 | 3403 | 5906 | 5907 |
| 963 | 3404 | 3405 | 5908 | 5909 |
| 964 | 3406 | 3407 | 5910 | 5911 |
| 965 | 3408 | 3409 | 5912 | 5913 |
| 966 | 3410 | 3411 | 5914 | 5915 |
| 967 | 3412 | 3413 | 5916 | 5917 |
| 968 | 3414 | 3415 | 5918 | 5919 |
| 969 | 3416 | 3417 | 5920 | 5921 |
| 970 | 3418 | 3419 | 5922 | 5923 |
| 971 | 3420 | 3421 | 5924 | 5925 |
| 972 | 3422 | 3423 | 5926 | 5927 |
| 973 | 3424 | 3425 | 5928 | 5929 |
| 974 | 3426 | 3427 | 5930 | 5931 |
| 975 | 3428 | 3429 | 5932 | 5933 |
| 976 | 3430 | 3431 | 5934 | 5935 |
| 977 | 3432 | 3433 | 5936 | 5937 |
| 978 | 3434 | 3435 | 5938 | 5939 |
| 979 | 3436 | 3437 | 5940 | 5941 |
| 980 | 3438 | 3439 | 5942 | 5943 |
| 981 | 3440 | 3441 | 5944 | 5945 |
| 982 | 3442 | 3443 | 5946 | 5947 |
| 983 | 3444 | 3445 | 5948 | 5949 |
| 984 | 3446 | 3447 | 5950 | 5951 |
| 985 | 3448 | 3449 | 5952 | 5953 |
| 986 | 3450 | 3451 | 5954 | 5955 |
| 987 | 3454 | 3455 | 5958 | 5959 |
| 988 | 3456 | 3457 | 5960 | 5961 |
| 989 | 3458 | 3459 | 5962 | 5963 |
| 990 | 3460 | 3461 | 5964 | 5965 |
| 991 | 3462 | 3463 | 5966 | 5967 |
| 992 | 3464 | 3465 | 5968 | 5969 |
| 993 | 3466 | 3467 | 5970 | 5971 |
| 994 | 3468 | 3469 | 5972 | 5973 |
| 995 | 3470 | 3471 | 5974 | 5975 |
| 996 | 3472 | 3473 | 5976 | 5977 |
| 997 | 3474 | 3475 | 5978 | 5979 |
| 998 | 3476 | 3477 | 5980 | 5981 |
| 999 | 3478 | 3479 | 5982 | 5983 |
| 1000 | 3480 | 3481 | 5984 | 5985 |
| 1001 | 3482 | 3483 | 5986 | 5987 |
| 1002 | 3484 | 3485 | 5988 | 5989 |
| 1003 | 3486 | 3487 | 5990 | 5991 |
| 1004 | 3488 | 3489 | 5992 | 5993 |
| 1005 | 3490 | 3491 | 5994 | 5995 |
| 1006 | 3494 | 3495 | 5998 | 5999 |
| 1007 | 3496 | 3497 | 6000 | 6001 |
| 1008 | 3498 | 3499 | 6002 | 6003 |
| 1009 | 3500 | 3501 | 6004 | 6005 |
| 1010 | 3502 | 3503 | 6006 | 6007 |
| 1011 | 3504 | 3505 | 6008 | 6009 |
| 1012 | 3506 | 3507 | 6010 | 6011 |
| 1013 | 3508 | 3509 | 6012 | 6013 |
| 1014 | 3510 | 3511 | 6014 | 6015 |
| 1015 | 3512 | 3513 | 6016 | 6017 |
| 1016 | 3516 | 3517 | 6020 | 6021 |
| 1017 | 3518 | 3519 | 6022 | 6023 |
| 1018 | 3520 | 3521 | 6024 | 6025 |
| 1019 | 3522 | 3523 | 6026 | 6027 |
| 1020 | 3524 | 3525 | 6028 | 6029 |
| 1021 | 3526 | 3527 | 6030 | 6031 |
| 1022 | 3528 | 3529 | 6032 | 6033 |
| 1023 | 3530 | 3531 | 6034 | 6035 |
| 1024 | 3532 | 3533 | 6036 | 6037 |
| 1025 | 3534 | 3535 | 6038 | 6039 |

TABLE 4-continued

| SEQ ID NO (ORF) | Fp | Fd | Bp | Bd |
|---|---|---|---|---|
| 1026 | 3536 | 3537 | 6040 | 6041 |
| 1027 | 3542 | 3543 | 6046 | 6047 |
| 1028 | 3544 | 3545 | 6048 | 6049 |
| 1029 | 3546 | 3547 | 6050 | 6051 |
| 1030 | 3548 | 3549 | 6052 | 6053 |
| 1031 | 3550 | 3551 | 6054 | 6055 |
| 1032 | 3552 | 3553 | 6056 | 6057 |
| 1033 | 3554 | 3555 | 6058 | 6059 |
| 1034 | 3556 | 3557 | 6060 | 6061 |
| 1035 | 3558 | 3559 | 6062 | 6063 |
| 1036 | 3560 | 3561 | 6064 | 6065 |
| 1037 | 3562 | 3563 | 6066 | 6067 |
| 1038 | 3564 | 3565 | 6068 | 6069 |
| 1039 | 3566 | 3567 | 6070 | 6071 |
| 1040 | 3568 | 3569 | 6072 | 6073 |
| 1041 | 3570 | 3571 | 6074 | 6075 |
| 1042 | 3572 | 3573 | 6076 | 6077 |
| 1043 | 3574 | 3575 | 6078 | 6079 |
| 1044 | 3582 | 3583 | 6086 | 6087 |
| 1045 | 3584 | 3585 | 6088 | 6089 |
| 1046 | 3586 | 3587 | 6090 | 6091 |
| 1047 | 3588 | 3589 | 6092 | 6093 |
| 1048 | 3592 | 3593 | 6096 | 6097 |
| 1049 | 3594 | 3595 | 6098 | 6099 |
| 1050 | 3596 | 3597 | 6100 | 6101 |
| 1051 | 3598 | 3599 | 6102 | 6103 |
| 1052 | 3600 | 3601 | 6104 | 6105 |
| 1053 | 3602 | 3603 | 6106 | 6107 |
| 1054 | 3604 | 3605 | 6108 | 6109 |
| 1055 | 3606 | 3607 | 6110 | 6111 |
| 1056 | 3608 | 3609 | 6112 | 6113 |
| 1057 | 3610 | 3611 | 6114 | 6115 |
| 1058 | 3612 | 3613 | 6116 | 6117 |
| 1059 | 3614 | 3615 | 6118 | 6119 |
| 1060 | 3616 | 3617 | 6120 | 6121 |
| 1061 | 3618 | 3619 | 6122 | 6123 |
| 1062 | 3620 | 3621 | 6124 | 6125 |
| 1063 | 3622 | 3623 | 6126 | 6127 |
| 1064 | 3624 | 3625 | 6128 | 6129 |
| 1065 | 3626 | 3627 | 6130 | 6131 |
| 1066 | 3628 | 3629 | 6132 | 6133 |
| 1067 | 3630 | 3631 | 6134 | 6135 |
| 1068 | 3632 | 3633 | 6136 | 6137 |
| 1069 | 3634 | 3635 | 6138 | 6139 |
| 1070 | 3636 | 3637 | 6140 | 6141 |
| 1071 | 3638 | 3639 | 6142 | 6143 |
| 1072 | 3640 | 3641 | 6144 | 6145 |
| 1073 | 3642 | 3643 | 6146 | 6147 |
| 1074 | 3644 | 3645 | 6148 | 6149 |
| 1075 | 3646 | 3647 | 6150 | 6151 |
| 1076 | 3648 | 3649 | 6152 | 6153 |
| 1077 | 3652 | 3653 | 6156 | 6157 |
| 1078 | 3654 | 3655 | 6158 | 6159 |
| 1079 | 3656 | 3657 | 6160 | 6161 |
| 1080 | 3658 | 3659 | 6162 | 6163 |
| 1081 | 3660 | 3661 | 6164 | 6165 |
| 1082 | 3662 | 3663 | 6166 | 6167 |
| 1083 | 3666 | 3667 | 6170 | 6171 |
| 1084 | 3668 | 3669 | 6172 | 6173 |
| 1085 | 3672 | 3673 | 6176 | 6177 |
| 1086 | 3674 | 3675 | 6178 | 6179 |
| 1087 | 3676 | 3677 | 6180 | 6181 |
| 1088 | 3678 | 3679 | 6182 | 6183 |
| 1089 | 3680 | 3681 | 6184 | 6185 |
| 1090 | 3682 | 3683 | 6186 | 6187 |
| 1091 | 3684 | 3685 | 6188 | 6189 |
| 1092 | 3686 | 3687 | 6190 | 6191 |
| 1093 | 3688 | 3689 | 6192 | 6193 |
| 1094 | 3690 | 3691 | 6194 | 6195 |
| 1095 | 3692 | 3693 | 6196 | 6197 |
| 1096 | 3694 | 3695 | 6198 | 6199 |
| 1097 | 3696 | 3697 | 6200 | 6201 |
| 1098 | 3698 | 3699 | 6202 | 6203 |
| 1099 | 3702 | 3703 | 6206 | 6207 |
| 1100 | 3700 | 3701 | 6204 | 6205 |
| 1101 | 3704 | 3705 | 6208 | 6209 |
| 1102 | 3706 | 3707 | 6210 | 6211 |
| 1103 | 3708 | 3709 | 6212 | 6213 |
| 1104 | 3714 | 3715 | 6218 | 6219 |
| 1105 | 3720 | 3721 | 6224 | 6225 |
| 1106 | 3722 | 3723 | 6226 | 6227 |
| 1107 | 3724 | 3725 | 6228 | 6229 |
| 1108 | 3726 | 3727 | 6230 | 6231 |
| 1109 | 3728 | 3729 | 6232 | 6233 |
| 1110 | 3730 | 3731 | 6234 | 6235 |
| 1111 | 3732 | 3733 | 6236 | 6237 |
| 1112 | 3734 | 3735 | 6238 | 6239 |
| 1113 | 3736 | 3737 | 6240 | 6241 |
| 1114 | 3740 | 3741 | 6244 | 6245 |
| 1115 | 3738 | 3739 | 6242 | 6243 |
| 1116 | 3742 | 3743 | 6246 | 6247 |
| 1117 | 3744 | 3745 | 6248 | 6249 |
| 1118 | 3746 | 3747 | 6250 | 6251 |
| 1119 | 3748 | 3749 | 6252 | 6253 |
| 1120 | 3750 | 3751 | 6254 | 6255 |
| 1121 | 3754 | 3755 | 6258 | 6259 |
| 1122 | 3756 | 3757 | 6260 | 6261 |
| 1123 | 3758 | 3759 | 6262 | 6263 |
| 1124 | 3760 | 3761 | 6264 | 6265 |
| 1125 | 3762 | 3763 | 6266 | 6267 |
| 1126 | 3766 | 3767 | 6270 | 6271 |
| 1127 | 3770 | 3771 | 6274 | 6275 |
| 1128 | 3772 | 3773 | 6276 | 6277 |
| 1129 | 3776 | 3777 | 6280 | 6281 |
| 1130 | 3774 | 3775 | 6278 | 6279 |
| 1131 | 3778 | 3779 | 6282 | 6283 |
| 1132 | 3780 | 3781 | 6284 | 6285 |
| 1133 | 3782 | 3783 | 6286 | 6287 |
| 1134 | 3784 | 3785 | 6288 | 6289 |
| 1135 | 3788 | 3789 | 6292 | 6293 |
| 1136 | 3786 | 3787 | 6290 | 6291 |
| 1137 | 3794 | 3795 | 6298 | 6299 |
| 1138 | 1372 | 1373 | 3876 | 3877 |
| 1139 | 1378 | 1379 | 3882 | 3883 |
| 1140 | 1384 | 1385 | 3888 | 3889 |
| 1141 | 1390 | 1391 | 3894 | 3895 |
| 1142 | 1408 | 1409 | 3912 | 3913 |
| 1143 | 1436 | 1437 | 3940 | 3941 |
| 1144 | 1442 | 1443 | 3946 | 3947 |
| 1145 | 1466 | 1467 | 3970 | 3971 |
| 1146 | 1474 | 1475 | 3978 | 3979 |
| 1147 | 1528 | 1529 | 4032 | 4033 |
| 1148 | 1560 | 1561 | 4064 | 4065 |
| 1149 | 1578 | 1579 | 4082 | 4083 |
| 1150 | 1600 | 1601 | 4104 | 4105 |
| 1151 | 1602 | 1603 | 4106 | 4107 |
| 1152 | 1608 | 1609 | 4112 | 4113 |
| 1153 | 1610 | 1611 | 4114 | 4115 |
| 1154 | 1654 | 1655 | 4158 | 4159 |
| 1155 | 1660 | 1661 | 4164 | 4165 |
| 1156 | 1680 | 1681 | 4184 | 4185 |
| 1157 | 1682 | 1683 | 4186 | 4187 |
| 1158 | 1692 | 1693 | 4196 | 4197 |
| 1159 | 1702 | 1703 | 4206 | 4207 |
| 1160 | 1706 | 1707 | 4210 | 4211 |
| 1161 | 1716 | 1717 | 4220 | 4221 |
| 1162 | 1718 | 1719 | 4222 | 4223 |
| 1163 | 1730 | 1731 | 4234 | 4235 |
| 1164 | 1748 | 1749 | 4252 | 4253 |
| 1165 | 1780 | 1781 | 4284 | 4285 |
| 1166 | 1794 | 1795 | 4298 | 4299 |
| 1167 | 1798 | 1799 | 4302 | 4303 |
| 1168 | 1814 | 1815 | 4318 | 4319 |
| 1169 | 1816 | 1817 | 4320 | 4321 |
| 1170 | 1820 | 1821 | 4324 | 4325 |
| 1171 | 1822 | 1823 | 4326 | 4327 |
| 1172 | 1830 | 1831 | 4334 | 4335 |
| 1173 | 1832 | 1833 | 4336 | 4337 |
| 1174 | 1838 | 1839 | 4342 | 4343 |
| 1175 | 1844 | 1845 | 4348 | 4349 |
| 1176 | 1870 | 1871 | 4374 | 4375 |
| 1177 | 1880 | 1881 | 4384 | 4385 |
| 1178 | 1882 | 1883 | 4386 | 4387 |
| 1179 | 1884 | 1885 | 4388 | 4389 |

TABLE 4-continued

| SEQ ID NO (ORF) | Fp | Fd | Bp | Bd |
|---|---|---|---|---|
| 1180 | 1932 | 1933 | 4436 | 4437 |
| 1181 | 1968 | 1969 | 4472 | 4473 |
| 1182 | 1982 | 1983 | 4486 | 4487 |
| 1183 | 2036 | 2037 | 4540 | 4541 |
| 1184 | 2086 | 2087 | 4590 | 4591 |
| 1185 | 2098 | 2099 | 4602 | 4603 |
| 1186 | 2126 | 2127 | 4630 | 4631 |
| 1187 | 2132 | 2133 | 4636 | 4637 |
| 1188 | 2166 | 2167 | 4670 | 4671 |
| 1189 | 2168 | 2169 | 4672 | 4673 |
| 1190 | 2184 | 2185 | 4688 | 4689 |
| 1191 | 2240 | 2241 | 4744 | 4745 |
| 1192 | 2276 | 2277 | 4780 | 4781 |
| 1193 | 2300 | 2301 | 4804 | 4805 |
| 1194 | 2302 | 2303 | 4806 | 4807 |
| 1195 | 2330 | 2331 | 4834 | 4835 |
| 1196 | 2336 | 2337 | 4840 | 4841 |
| 1197 | 2448 | 2449 | 4952 | 4953 |
| 1198 | 2452 | 2453 | 4956 | 4957 |
| 1199 | 2484 | 2485 | 4988 | 4989 |
| 1200 | 2512 | 2513 | 5016 | 5017 |
| 1201 | 2530 | 2531 | 5034 | 5035 |
| 1202 | 2540 | 2541 | 5044 | 5045 |
| 1203 | 2542 | 2543 | 5046 | 5047 |
| 1204 | 2584 | 2585 | 5088 | 5089 |
| 1205 | 2586 | 2587 | 5090 | 5091 |
| 1206 | 2588 | 2589 | 5092 | 5093 |
| 1207 | 2614 | 2615 | 5118 | 5119 |
| 1208 | 2670 | 2671 | 5174 | 5175 |
| 1209 | 2694 | 2695 | 5198 | 5199 |
| 1210 | 2708 | 2709 | 5212 | 5213 |
| 1211 | 2730 | 2731 | 5234 | 5235 |
| 1212 | 2734 | 2735 | 5238 | 5239 |
| 1213 | 2746 | 2747 | 5250 | 5251 |
| 1214 | 2802 | 2803 | 5306 | 5307 |
| 1215 | 2898 | 2899 | 5402 | 5403 |
| 1216 | 2950 | 2951 | 5454 | 5455 |
| 1217 | 2988 | 2989 | 5492 | 5493 |
| 1218 | 3018 | 3019 | 5522 | 5523 |
| 1219 | 3098 | 3099 | 5602 | 5603 |
| 1220 | 3118 | 3119 | 5622 | 5623 |
| 1221 | 3126 | 3127 | 5630 | 5631 |
| 1222 | 3208 | 3209 | 5712 | 5713 |
| 1223 | 3242 | 3243 | 5746 | 5747 |
| 1224 | 3294 | 3295 | 5798 | 5799 |
| 1225 | 3312 | 3313 | 5816 | 5817 |
| 1226 | 3318 | 3319 | 5822 | 5823 |
| 1227 | 3320 | 3321 | 5824 | 5825 |
| 1228 | 3322 | 3323 | 5826 | 5827 |
| 1229 | 3332 | 3333 | 5836 | 5837 |
| 1230 | 3334 | 3335 | 5838 | 5839 |
| 1231 | 3358 | 3359 | 5862 | 5863 |
| 1232 | 3372 | 3373 | 5876 | 5877 |
| 1233 | 3452 | 3453 | 5956 | 5957 |
| 1234 | 3492 | 3493 | 5996 | 5997 |
| 1235 | 3514 | 3515 | 6018 | 6019 |
| 1236 | 3538 | 3539 | 6042 | 6043 |
| 1237 | 3540 | 3541 | 6044 | 6045 |
| 1238 | 3576 | 3577 | 6080 | 6081 |
| 1239 | 3578 | 3579 | 6082 | 6083 |
| 1240 | 3580 | 3581 | 6084 | 6085 |
| 1241 | 3590 | 3591 | 6094 | 6095 |
| 1242 | 3650 | 3651 | 6154 | 6155 |
| 1243 | 3664 | 3665 | 6168 | 6169 |
| 1244 | 3670 | 3671 | 6174 | 6175 |
| 1245 | 3710 | 3711 | 6214 | 6215 |
| 1246 | 3712 | 3713 | 6216 | 6217 |
| 1247 | 3716 | 3717 | 6220 | 6221 |
| 1248 | 3718 | 3719 | 6222 | 6223 |
| 1249 | 3752 | 3753 | 6256 | 6257 |
| 1250 | 3764 | 3765 | 6268 | 6269 |
| 1251 | 3768 | 3769 | 6272 | 6273 |
| 1252 | 3790 | 3791 | 6294 | 6295 |
| 1253 | 3792 | 3793 | 6296 | 6297 |
| 1254 | 6300 | 6301 | 6376 | 6377 |
| 1255 | 6302 | 6303 | 6378 | 6379 |
| 1256 | 6304 | 6305 | 6380 | 6381 |

TABLE 4-continued

| SEQ ID NO (ORF) | Fp | Fd | Bp | Bd |
|---|---|---|---|---|
| 1257 | 6306 | 6307 | 6382 | 6383 |
| 1258 | 6308 | 6309 | 6384 | 6385 |
| 1259 | 6310 | 6311 | 6386 | 6387 |
| 1260 | 6312 | 6313 | 6388 | 6389 |
| 1261 | 6314 | 6315 | 6390 | 6391 |
| 1262 | 6316 | 6317 | 6392 | 6393 |
| 1263 | 6318 | 6319 | 6394 | 6395 |
| 1264 | 6320 | 6321 | 6396 | 6397 |
| 1265 | 6322 | 6323 | 6398 | 6399 |
| 1266 | 6324 | 6325 | 6400 | 6401 |
| 1267 | 6326 | 6327 | 6402 | 6403 |
| 1268 | 6328 | 6329 | 6404 | 6405 |
| 1269 | 6330 | 6331 | 6406 | 6407 |
| 1270 | 6332 | 6333 | 6408 | 6409 |
| 1271 | 6334 | 6335 | 6410 | 6411 |
| 1272 | 6336 | 6337 | 6412 | 6413 |
| 1273 | 6338 | 6339 | 6414 | 6415 |
| 1274 | 6340 | 6341 | 6416 | 6417 |
| 1275 | 6342 | 6343 | 6418 | 6419 |
| 1276 | 6344 | 6345 | 6420 | 6421 |
| 1277 | 6346 | 6347 | 6422 | 6423 |
| 1278 | 6348 | 6349 | 6424 | 6425 |
| 1279 | 6350 | 6351 | 6426 | 6427 |
| 1280 | 6352 | 6353 | 6428 | 6429 |
| 1281 | 6354 | 6355 | 6430 | 6431 |
| 1282 | 6356 | 6357 | 6432 | 6433 |
| 1283 | 6358 | 6359 | 6434 | 6435 |
| 1284 | 6360 | 6361 | 6436 | 6437 |
| 1285 | 6362 | 6363 | 6438 | 6439 |
| 1286 | 6364 | 6365 | 6440 | 6441 |
| 1287 | 6366 | 6367 | 6442 | 6443 |
| 1288 | 6368 | 6369 | 6444 | 6445 |
| 1289 | 6370 | 6371 | 6446 | 6447 |
| 1290 | 6372 | 6373 | 6448 | 6449 |
| 1291 | 6374 | 6375 | 6450 | 6451 |

TABLE 5

| SEQ ID | or. | 5' position |
|---|---|---|
| 1292 | F | 1229848 |
| 1293 | F | 1227874 |
| 1294 | F | 1018 |
| 1295 | F | 1229162 |
| 1296 | F | 1588 |
| 1297 | F | 1229711 |
| 1298 | F | 2253 |
| 1299 | F | 369 |
| 1300 | F | 3381 |
| 1301 | F | 1508 |
| 1302 | F | 4042 |
| 1303 | F | 2126 |
| 1304 | F | 5735 |
| 1305 | F | 3843 |
| 1306 | F | 7832 |
| 1307 | F | 5909 |
| 1308 | F | 8887 |
| 1309 | F | 7010 |
| 1310 | F | 10139 |
| 1311 | F | 8175 |
| 1312 | F | 10640 |
| 1313 | F | 8799 |
| 1314 | F | 10997 |
| 1315 | F | 9037 |
| 1316 | F | 12458 |
| 1317 | F | 10572 |
| 1318 | F | 14187 |
| 1319 | F | 12365 |
| 1320 | F | 15529 |
| 1321 | F | 13629 |
| 1322 | F | 17626 |
| 1323 | F | 15699 |
| 1324 | F | 20909 |
| 1325 | F | 19006 |

TABLE 5-continued

| SEQ ID | or. | 5' position |
|---|---|---|
| 1326 | F | 21800 |
| 1327 | F | 19927 |
| 1328 | F | 23462 |
| 1329 | F | 21557 |
| 1330 | F | 25637 |
| 1331 | F | 23729 |
| 1332 | F | 25997 |
| 1333 | F | 24071 |
| 1334 | F | 26727 |
| 1335 | F | 24828 |
| 1336 | F | 27528 |
| 1337 | F | 25628 |
| 1338 | F | 28643 |
| 1339 | F | 26765 |
| 1340 | F | 29202 |
| 1341 | F | 27313 |
| 1342 | F | 29793 |
| 1343 | F | 27835 |
| 1344 | F | 31488 |
| 1345 | F | 29639 |
| 1346 | F | 31957 |
| 1347 | F | 30050 |
| 1348 | F | 33570 |
| 1349 | F | 31666 |
| 1350 | F | 34564 |
| 1351 | F | 32664 |
| 1352 | F | 35783 |
| 1353 | F | 33875 |
| 1354 | F | 37597 |
| 1355 | F | 35741 |
| 1356 | F | 39135 |
| 1357 | F | 37236 |
| 1358 | F | 38939 |
| 1359 | F | 37038 |
| 1360 | F | 40872 |
| 1361 | F | 38972 |
| 1362 | F | 42825 |
| 1363 | F | 40923 |
| 1364 | F | 43563 |
| 1365 | F | 41652 |
| 1366 | F | 44531 |
| 1367 | F | 42623 |
| 1368 | F | 45150 |
| 1369 | F | 43250 |
| 1370 | F | 45478 |
| 1371 | F | 43579 |
| 1372 | F | 46755 |
| 1373 | F | 44874 |
| 1374 | F | 47347 |
| 1375 | F | 45386 |
| 1376 | F | 47818 |
| 1377 | F | 45897 |
| 1378 | F | 48893 |
| 1379 | F | 46995 |
| 1380 | F | 49907 |
| 1381 | F | 48000 |
| 1382 | F | 51088 |
| 1383 | F | 49169 |
| 1384 | F | 52651 |
| 1385 | F | 50721 |
| 1386 | F | 53065 |
| 1387 | F | 51176 |
| 1388 | F | 53516 |
| 1389 | F | 51611 |
| 1390 | F | 54242 |
| 1391 | F | 52351 |
| 1392 | F | 55058 |
| 1393 | F | 53159 |
| 1394 | F | 56274 |
| 1395 | F | 54348 |
| 1396 | F | 57078 |
| 1397 | F | 55156 |
| 1398 | F | 58343 |
| 1399 | F | 56392 |
| 1400 | F | 61103 |
| 1401 | F | 59177 |
| 1402 | F | 59701 |
| 1403 | F | 57802 |
| 1404 | F | 61887 |
| 1405 | F | 59971 |
| 1406 | F | 62255 |
| 1407 | F | 60348 |
| 1408 | F | 63515 |
| 1409 | F | 61557 |
| 1410 | F | 63657 |
| 1411 | F | 61761 |
| 1412 | F | 64088 |
| 1413 | F | 62196 |
| 1414 | F | 64422 |
| 1415 | F | 62537 |
| 1416 | F | 65072 |
| 1417 | F | 63140 |
| 1418 | F | 65978 |
| 1419 | F | 64088 |
| 1420 | F | 67046 |
| 1421 | F | 65146 |
| 1422 | F | 67466 |
| 1423 | F | 65580 |
| 1424 | F | 68569 |
| 1425 | F | 66686 |
| 1426 | F | 68609 |
| 1427 | F | 66688 |
| 1428 | F | 70423 |
| 1429 | F | 68479 |
| 1430 | F | 71099 |
| 1431 | F | 69206 |
| 1432 | F | 71829 |
| 1433 | F | 69935 |
| 1434 | F | 73745 |
| 1435 | F | 71931 |
| 1436 | F | 76942 |
| 1437 | F | 75022 |
| 1438 | F | 77404 |
| 1439 | F | 75556 |
| 1440 | F | 78133 |
| 1441 | F | 76192 |
| 1442 | F | 79079 |
| 1443 | F | 77122 |
| 1444 | F | 79471 |
| 1445 | F | 77481 |
| 1446 | F | 79670 |
| 1447 | F | 77816 |
| 1448 | F | 80236 |
| 1449 | F | 78356 |
| 1450 | F | 81108 |
| 1451 | F | 79182 |
| 1452 | F | 83024 |
| 1453 | F | 81158 |
| 1454 | F | 83786 |
| 1455 | F | 81886 |
| 1456 | F | 84739 |
| 1457 | F | 82821 |
| 1458 | F | 84866 |
| 1459 | F | 82967 |
| 1460 | F | 85175 |
| 1461 | F | 83240 |
| 1462 | F | 85690 |
| 1463 | F | 83790 |
| 1464 | F | 86397 |
| 1465 | F | 84507 |
| 1466 | F | 88470 |
| 1467 | F | 86563 |
| 1468 | F | 89038 |
| 1469 | F | 87121 |
| 1470 | F | 91017 |
| 1471 | F | 89146 |
| 1472 | F | 93075 |
| 1473 | F | 91147 |
| 1474 | F | 93846 |
| 1475 | F | 91948 |
| 1476 | F | 94410 |
| 1477 | F | 92561 |
| 1478 | F | 95447 |
| 1479 | F | 93541 |

TABLE 5-continued

| SEQ ID | or. | 5' position |
|---|---|---|
| 1480 | F | 96074 |
| 1481 | F | 94197 |
| 1482 | F | 97706 |
| 1483 | F | 95841 |
| 1484 | F | 98142 |
| 1485 | F | 96292 |
| 1486 | F | 99925 |
| 1487 | F | 98011 |
| 1488 | F | 101229 |
| 1489 | F | 99338 |
| 1490 | F | 101429 |
| 1491 | F | 99552 |
| 1492 | F | 102137 |
| 1493 | F | 100237 |
| 1494 | F | 102600 |
| 1495 | F | 100657 |
| 1496 | F | 103330 |
| 1497 | F | 101429 |
| 1498 | F | 103877 |
| 1499 | F | 101966 |
| 1500 | F | 104336 |
| 1501 | F | 102469 |
| 1502 | F | 108182 |
| 1503 | F | 106280 |
| 1504 | F | 111814 |
| 1505 | F | 109911 |
| 1506 | F | 112412 |
| 1507 | F | 110553 |
| 1508 | F | 113442 |
| 1509 | F | 111571 |
| 1510 | F | 113891 |
| 1511 | F | 112010 |
| 1512 | F | 114990 |
| 1513 | F | 113112 |
| 1514 | F | 115684 |
| 1515 | F | 113776 |
| 1516 | F | 116526 |
| 1517 | F | 114656 |
| 1518 | F | 117731 |
| 1519 | F | 115825 |
| 1520 | F | 118292 |
| 1521 | F | 116389 |
| 1522 | F | 119593 |
| 1523 | F | 117685 |
| 1524 | F | 120231 |
| 1525 | F | 118292 |
| 1526 | F | 122278 |
| 1527 | F | 120382 |
| 1528 | F | 122610 |
| 1529 | F | 120682 |
| 1530 | F | 123309 |
| 1531 | F | 121390 |
| 1532 | F | 126113 |
| 1533 | F | 124213 |
| 1534 | F | 128975 |
| 1535 | F | 127091 |
| 1536 | F | 134603 |
| 1537 | F | 132806 |
| 1538 | F | 136249 |
| 1539 | F | 134352 |
| 1540 | F | 137680 |
| 1541 | F | 135756 |
| 1542 | F | 137680 |
| 1543 | F | 135799 |
| 1544 | F | 138035 |
| 1545 | F | 136135 |
| 1546 | F | 139266 |
| 1547 | F | 137363 |
| 1548 | F | 140208 |
| 1549 | F | 138351 |
| 1550 | F | 141636 |
| 1551 | F | 139735 |
| 1552 | F | 142808 |
| 1553 | F | 140900 |
| 1554 | F | 144272 |
| 1555 | F | 142372 |
| 1556 | F | 145217 |
| 1557 | F | 143335 |
| 1558 | F | 146527 |
| 1559 | F | 144645 |
| 1560 | F | 146965 |
| 1561 | F | 145086 |
| 1562 | F | 147455 |
| 1563 | F | 145501 |
| 1564 | F | 148810 |
| 1565 | F | 146904 |
| 1566 | F | 151964 |
| 1567 | F | 150062 |
| 1568 | F | 154064 |
| 1569 | F | 152113 |
| 1570 | F | 154888 |
| 1571 | F | 152963 |
| 1572 | F | 155418 |
| 1573 | F | 153558 |
| 1574 | F | 156528 |
| 1575 | F | 154606 |
| 1576 | F | 157433 |
| 1577 | F | 155516 |
| 1578 | F | 158771 |
| 1579 | F | 156842 |
| 1580 | F | 159105 |
| 1581 | F | 157219 |
| 1582 | F | 159657 |
| 1583 | F | 157761 |
| 1584 | F | 160240 |
| 1585 | F | 158316 |
| 1586 | F | 160675 |
| 1587 | F | 158778 |
| 1588 | F | 161289 |
| 1589 | F | 159402 |
| 1590 | F | 161918 |
| 1591 | F | 159979 |
| 1592 | F | 162214 |
| 1593 | F | 160297 |
| 1594 | F | 163996 |
| 1595 | F | 162045 |
| 1596 | F | 165189 |
| 1597 | F | 163288 |
| 1598 | F | 166730 |
| 1599 | F | 164828 |
| 1600 | F | 168243 |
| 1601 | F | 166327 |
| 1602 | F | 168907 |
| 1603 | F | 167064 |
| 1604 | F | 169129 |
| 1605 | F | 167294 |
| 1606 | F | 170632 |
| 1607 | F | 168692 |
| 1608 | F | 171229 |
| 1609 | F | 169381 |
| 1610 | F | 171553 |
| 1611 | F | 169614 |
| 1612 | F | 172433 |
| 1613 | F | 170533 |
| 1614 | F | 173217 |
| 1615 | F | 171316 |
| 1616 | F | 174567 |
| 1617 | F | 172680 |
| 1618 | F | 175342 |
| 1619 | F | 173479 |
| 1620 | F | 175709 |
| 1621 | F | 173752 |
| 1622 | F | 176909 |
| 1623 | F | 175009 |
| 1624 | F | 176704 |
| 1625 | F | 174761 |
| 1626 | F | 177608 |
| 1627 | F | 175709 |
| 1628 | F | 179259 |
| 1629 | F | 177384 |
| 1630 | F | 179719 |
| 1631 | F | 177800 |
| 1632 | F | 181629 |
| 1633 | F | 179743 |

TABLE 5-continued

| SEQ ID | or. | 5' position |
|---|---|---|
| 1634 | F | 182851 |
| 1635 | F | 180952 |
| 1636 | F | 184230 |
| 1637 | F | 182335 |
| 1638 | F | 184870 |
| 1639 | F | 182962 |
| 1640 | F | 185241 |
| 1641 | F | 183348 |
| 1642 | F | 185611 |
| 1643 | F | 183685 |
| 1644 | F | 186336 |
| 1645 | F | 184445 |
| 1646 | F | 188059 |
| 1647 | F | 186171 |
| 1648 | F | 190828 |
| 1649 | F | 188956 |
| 1650 | F | 191294 |
| 1651 | F | 189428 |
| 1652 | F | 192686 |
| 1653 | F | 190788 |
| 1654 | F | 193380 |
| 1655 | F | 191474 |
| 1656 | F | 193388 |
| 1657 | F | 191474 |
| 1658 | F | 193977 |
| 1659 | F | 192059 |
| 1660 | F | 195480 |
| 1661 | F | 193585 |
| 1662 | F | 195868 |
| 1663 | F | 193969 |
| 1664 | F | 197913 |
| 1665 | F | 196013 |
| 1666 | F | 199088 |
| 1667 | F | 197213 |
| 1668 | F | 202776 |
| 1669 | F | 200876 |
| 1670 | F | 204467 |
| 1671 | F | 202497 |
| 1672 | F | 205584 |
| 1673 | F | 203664 |
| 1674 | F | 206940 |
| 1675 | F | 205063 |
| 1676 | F | 207560 |
| 1677 | F | 205587 |
| 1678 | F | 208048 |
| 1679 | F | 206139 |
| 1680 | F | 209923 |
| 1681 | F | 208023 |
| 1682 | F | 210455 |
| 1683 | F | 208569 |
| 1684 | F | 211049 |
| 1685 | F | 209147 |
| 1686 | F | 211596 |
| 1687 | F | 209705 |
| 1688 | F | 212226 |
| 1689 | F | 210311 |
| 1690 | F | 213832 |
| 1691 | F | 211960 |
| 1692 | F | 214866 |
| 1693 | F | 212921 |
| 1694 | F | 215173 |
| 1695 | F | 213307 |
| 1696 | F | 215800 |
| 1697 | F | 213957 |
| 1698 | F | 216489 |
| 1699 | F | 214549 |
| 1700 | F | 216980 |
| 1701 | F | 215100 |
| 1702 | F | 217665 |
| 1703 | F | 215793 |
| 1704 | F | 218039 |
| 1705 | F | 216071 |
| 1706 | F | 218476 |
| 1707 | F | 216560 |
| 1708 | F | 218769 |
| 1709 | F | 216809 |
| 1710 | F | 220020 |
| 1711 | F | 218128 |
| 1712 | F | 221210 |
| 1713 | F | 219275 |
| 1714 | F | 222497 |
| 1715 | F | 220601 |
| 1716 | F | 223292 |
| 1717 | F | 221403 |
| 1718 | F | 223775 |
| 1719 | F | 221877 |
| 1720 | F | 224250 |
| 1721 | F | 222377 |
| 1722 | F | 224906 |
| 1723 | F | 223008 |
| 1724 | F | 225283 |
| 1725 | F | 223418 |
| 1726 | F | 226670 |
| 1727 | F | 224770 |
| 1728 | F | 227849 |
| 1729 | F | 225937 |
| 1730 | F | 228185 |
| 1731 | F | 226269 |
| 1732 | F | 228393 |
| 1733 | F | 226512 |
| 1734 | F | 229334 |
| 1735 | F | 227499 |
| 1736 | F | 230761 |
| 1737 | F | 228846 |
| 1738 | F | 231287 |
| 1739 | F | 229334 |
| 1740 | F | 231731 |
| 1741 | F | 229927 |
| 1742 | F | 232865 |
| 1743 | F | 231027 |
| 1744 | F | 232865 |
| 1745 | F | 231027 |
| 1746 | F | 234315 |
| 1747 | F | 232394 |
| 1748 | F | 234823 |
| 1749 | F | 232865 |
| 1750 | F | 235154 |
| 1751 | F | 233245 |
| 1752 | F | 236429 |
| 1753 | F | 234520 |
| 1754 | F | 237268 |
| 1755 | F | 235271 |
| 1756 | F | 238047 |
| 1757 | F | 236162 |
| 1758 | F | 238636 |
| 1759 | F | 236736 |
| 1760 | F | 239957 |
| 1761 | F | 238047 |
| 1762 | F | 241373 |
| 1763 | F | 239482 |
| 1764 | F | 242017 |
| 1765 | F | 240072 |
| 1766 | F | 242740 |
| 1767 | F | 240829 |
| 1768 | F | 243281 |
| 1769 | F | 241373 |
| 1770 | F | 244244 |
| 1771 | F | 242345 |
| 1772 | F | 246052 |
| 1773 | F | 244179 |
| 1774 | F | 247581 |
| 1775 | F | 245697 |
| 1776 | F | 249216 |
| 1777 | F | 247244 |
| 1778 | F | 251003 |
| 1779 | F | 249137 |
| 1780 | F | 252064 |
| 1781 | F | 250189 |
| 1782 | F | 252900 |
| 1783 | F | 251000 |
| 1784 | F | 253718 |
| 1785 | F | 251855 |
| 1786 | F | 254993 |
| 1787 | F | 253138 |

TABLE 5-continued

| SEQ ID | or. | 5' position |
|---|---|---|
| 1788 | F | 256414 |
| 1789 | F | 254509 |
| 1790 | F | 257283 |
| 1791 | F | 255383 |
| 1792 | F | 257279 |
| 1793 | F | 255379 |
| 1794 | F | 258061 |
| 1795 | F | 256107 |
| 1796 | F | 259005 |
| 1797 | F | 257128 |
| 1798 | F | 261075 |
| 1799 | F | 259195 |
| 1800 | F | 261551 |
| 1801 | F | 259650 |
| 1802 | F | 262535 |
| 1803 | F | 260611 |
| 1804 | F | 262960 |
| 1805 | F | 261060 |
| 1806 | F | 264509 |
| 1807 | F | 262614 |
| 1808 | F | 265837 |
| 1809 | F | 263925 |
| 1810 | F | 266239 |
| 1811 | F | 264367 |
| 1812 | F | 267185 |
| 1813 | F | 265286 |
| 1814 | F | 267909 |
| 1815 | F | 266037 |
| 1816 | F | 268594 |
| 1817 | F | 266756 |
| 1818 | F | 269299 |
| 1819 | F | 267505 |
| 1820 | F | 271044 |
| 1821 | F | 269121 |
| 1822 | F | 271737 |
| 1823 | F | 269838 |
| 1824 | F | 272558 |
| 1825 | F | 270645 |
| 1826 | F | 273007 |
| 1827 | F | 271098 |
| 1828 | F | 273463 |
| 1829 | F | 271500 |
| 1830 | F | 273922 |
| 1831 | F | 272057 |
| 1832 | F | 275083 |
| 1833 | F | 273094 |
| 1834 | F | 275495 |
| 1835 | F | 273554 |
| 1836 | F | 275739 |
| 1837 | F | 273878 |
| 1838 | F | 276229 |
| 1839 | F | 274371 |
| 1840 | F | 276548 |
| 1841 | F | 274638 |
| 1842 | F | 277098 |
| 1843 | F | 275178 |
| 1844 | F | 277358 |
| 1845 | F | 275448 |
| 1846 | F | 277609 |
| 1847 | F | 275739 |
| 1848 | F | 278314 |
| 1849 | F | 276386 |
| 1850 | F | 279310 |
| 1851 | F | 277385 |
| 1852 | F | 280627 |
| 1853 | F | 278702 |
| 1854 | F | 281471 |
| 1855 | F | 279559 |
| 1856 | F | 282239 |
| 1857 | F | 280288 |
| 1858 | F | 283832 |
| 1859 | F | 281933 |
| 1860 | F | 284384 |
| 1861 | F | 282486 |
| 1862 | F | 285373 |
| 1863 | F | 283473 |
| 1864 | F | 285919 |
| 1865 | F | 284059 |
| 1866 | F | 286742 |
| 1867 | F | 284879 |
| 1868 | F | 287216 |
| 1869 | F | 285329 |
| 1870 | F | 287671 |
| 1871 | F | 285751 |
| 1872 | F | 288273 |
| 1873 | F | 286323 |
| 1874 | F | 288618 |
| 1875 | F | 286685 |
| 1876 | F | 288273 |
| 1877 | F | 286323 |
| 1878 | F | 289723 |
| 1879 | F | 287836 |
| 1880 | F | 289508 |
| 1881 | F | 287667 |
| 1882 | F | 290750 |
| 1883 | F | 288858 |
| 1884 | F | 291142 |
| 1885 | F | 289253 |
| 1886 | F | 291702 |
| 1887 | F | 289812 |
| 1888 | F | 292522 |
| 1889 | F | 290633 |
| 1890 | F | 293035 |
| 1891 | F | 291142 |
| 1892 | F | 293731 |
| 1893 | F | 291786 |
| 1894 | F | 294530 |
| 1895 | F | 292670 |
| 1896 | F | 294367 |
| 1897 | F | 292513 |
| 1898 | F | 296092 |
| 1899 | F | 294209 |
| 1900 | F | 297611 |
| 1901 | F | 295757 |
| 1902 | F | 298027 |
| 1903 | F | 296092 |
| 1904 | F | 298555 |
| 1905 | F | 296582 |
| 1906 | F | 299403 |
| 1907 | F | 297511 |
| 1908 | F | 300409 |
| 1909 | F | 298579 |
| 1910 | F | 301332 |
| 1911 | F | 299433 |
| 1912 | F | 302215 |
| 1913 | F | 300282 |
| 1914 | F | 302492 |
| 1915 | F | 300618 |
| 1916 | F | 303627 |
| 1917 | F | 301730 |
| 1918 | F | 304350 |
| 1919 | F | 302487 |
| 1920 | F | 305173 |
| 1921 | F | 303226 |
| 1922 | F | 306244 |
| 1923 | F | 304350 |
| 1924 | F | 307232 |
| 1925 | F | 305310 |
| 1926 | F | 307799 |
| 1927 | F | 305877 |
| 1928 | F | 309173 |
| 1929 | F | 307301 |
| 1930 | F | 310158 |
| 1931 | F | 308306 |
| 1932 | F | 311020 |
| 1933 | F | 309118 |
| 1934 | F | 311031 |
| 1935 | F | 309126 |
| 1936 | F | 311552 |
| 1937 | F | 309658 |
| 1938 | F | 312510 |
| 1939 | F | 310614 |
| 1940 | F | 313134 |
| 1941 | F | 311255 |

TABLE 5-continued

| SEQ ID | or. | 5' position |
|---|---|---|
| 1942 | F | 313674 |
| 1943 | F | 311717 |
| 1944 | F | 314490 |
| 1945 | F | 312633 |
| 1946 | F | 315306 |
| 1947 | F | 313355 |
| 1948 | F | 315932 |
| 1949 | F | 314033 |
| 1950 | F | 318434 |
| 1951 | F | 316516 |
| 1952 | F | 320876 |
| 1953 | F | 318949 |
| 1954 | F | 321403 |
| 1955 | F | 319547 |
| 1956 | F | 322084 |
| 1957 | F | 320217 |
| 1958 | F | 322911 |
| 1959 | F | 321049 |
| 1960 | F | 323634 |
| 1961 | F | 321726 |
| 1962 | F | 325117 |
| 1963 | F | 323211 |
| 1964 | F | 326213 |
| 1965 | F | 324254 |
| 1966 | F | 327607 |
| 1967 | F | 325695 |
| 1968 | F | 328162 |
| 1969 | F | 326262 |
| 1970 | F | 328630 |
| 1971 | F | 326723 |
| 1972 | F | 329134 |
| 1973 | F | 327178 |
| 1974 | F | 330734 |
| 1975 | F | 328810 |
| 1976 | F | 332123 |
| 1977 | F | 330252 |
| 1978 | F | 334575 |
| 1979 | F | 332660 |
| 1980 | F | 335884 |
| 1981 | F | 333980 |
| 1982 | F | 337129 |
| 1983 | F | 335202 |
| 1984 | F | 337910 |
| 1985 | F | 335955 |
| 1986 | F | 338746 |
| 1987 | F | 336795 |
| 1988 | F | 339217 |
| 1989 | F | 337362 |
| 1990 | F | 339999 |
| 1991 | F | 338083 |
| 1992 | F | 343144 |
| 1993 | F | 341266 |
| 1994 | F | 343699 |
| 1995 | F | 341813 |
| 1996 | F | 344108 |
| 1997 | F | 342204 |
| 1998 | F | 344851 |
| 1999 | F | 342933 |
| 2000 | F | 346148 |
| 2001 | F | 344219 |
| 2002 | F | 346493 |
| 2003 | F | 344590 |
| 2004 | F | 346815 |
| 2005 | F | 344907 |
| 2006 | F | 347836 |
| 2007 | F | 345956 |
| 2008 | F | 350379 |
| 2009 | F | 348432 |
| 2010 | F | 350856 |
| 2011 | F | 348951 |
| 2012 | F | 352008 |
| 2013 | F | 350106 |
| 2014 | F | 353209 |
| 2015 | F | 351305 |
| 2016 | F | 354224 |
| 2017 | F | 352312 |
| 2018 | F | 354781 |
| 2019 | F | 352871 |
| 2020 | F | 355223 |
| 2021 | F | 353261 |
| 2022 | F | 355393 |
| 2023 | F | 353519 |
| 2024 | F | 358901 |
| 2025 | F | 357001 |
| 2026 | F | 356594 |
| 2027 | F | 354692 |
| 2028 | F | 359240 |
| 2029 | F | 357374 |
| 2030 | F | 359721 |
| 2031 | F | 357763 |
| 2032 | F | 361071 |
| 2033 | F | 359240 |
| 2034 | F | 363605 |
| 2035 | F | 361731 |
| 2036 | F | 364142 |
| 2037 | F | 362246 |
| 2038 | F | 364567 |
| 2039 | F | 362708 |
| 2040 | F | 365039 |
| 2041 | F | 363184 |
| 2042 | F | 365445 |
| 2043 | F | 363517 |
| 2044 | F | 367040 |
| 2045 | F | 365144 |
| 2046 | F | 368825 |
| 2047 | F | 366993 |
| 2048 | F | 369698 |
| 2049 | F | 367760 |
| 2050 | F | 370141 |
| 2051 | F | 368239 |
| 2052 | F | 372329 |
| 2053 | F | 370375 |
| 2054 | F | 372779 |
| 2055 | F | 370881 |
| 2056 | F | 373223 |
| 2057 | F | 371342 |
| 2058 | F | 373939 |
| 2059 | F | 372017 |
| 2060 | F | 374849 |
| 2061 | F | 372953 |
| 2062 | F | 375351 |
| 2063 | F | 373487 |
| 2064 | F | 376316 |
| 2065 | F | 374416 |
| 2066 | F | 377737 |
| 2067 | F | 375828 |
| 2068 | F | 379537 |
| 2069 | F | 377660 |
| 2070 | F | 380033 |
| 2071 | F | 378160 |
| 2072 | F | 380789 |
| 2073 | F | 378889 |
| 2074 | F | 381238 |
| 2075 | F | 379279 |
| 2076 | F | 382969 |
| 2077 | F | 381124 |
| 2078 | F | 383293 |
| 2079 | F | 381425 |
| 2080 | F | 385178 |
| 2081 | F | 383278 |
| 2082 | F | 386271 |
| 2083 | F | 384392 |
| 2084 | F | 386780 |
| 2085 | F | 384891 |
| 2086 | F | 389383 |
| 2087 | F | 387504 |
| 2088 | F | 389901 |
| 2089 | F | 388001 |
| 2090 | F | 390700 |
| 2091 | F | 388732 |
| 2092 | F | 391612 |
| 2093 | F | 389763 |
| 2094 | F | 392346 |
| 2095 | F | 390463 |

TABLE 5-continued

| SEQ ID | or. | 5' position |
|---|---|---|
| 2096 | F | 392540 |
| 2097 | F | 390639 |
| 2098 | F | 393487 |
| 2099 | F | 391609 |
| 2100 | F | 393904 |
| 2101 | F | 392025 |
| 2102 | F | 394703 |
| 2103 | F | 392782 |
| 2104 | F | 395024 |
| 2105 | F | 393098 |
| 2106 | F | 395705 |
| 2107 | F | 393791 |
| 2108 | F | 397607 |
| 2109 | F | 395705 |
| 2110 | F | 398807 |
| 2111 | F | 396957 |
| 2112 | F | 399848 |
| 2113 | F | 397886 |
| 2114 | F | 400914 |
| 2115 | F | 399008 |
| 2116 | F | 401183 |
| 2117 | F | 399301 |
| 2118 | F | 401964 |
| 2119 | F | 400060 |
| 2120 | F | 403450 |
| 2121 | F | 401527 |
| 2122 | F | 404124 |
| 2123 | F | 402206 |
| 2124 | F | 405765 |
| 2125 | F | 403865 |
| 2126 | F | 407131 |
| 2127 | F | 405243 |
| 2128 | F | 407456 |
| 2129 | F | 405563 |
| 2130 | F | 408841 |
| 2131 | F | 406901 |
| 2132 | F | 410478 |
| 2133 | F | 408573 |
| 2134 | F | 410725 |
| 2135 | F | 408832 |
| 2136 | F | 412263 |
| 2137 | F | 410363 |
| 2138 | F | 414168 |
| 2139 | F | 412268 |
| 2140 | F | 415013 |
| 2141 | F | 413111 |
| 2142 | F | 415636 |
| 2143 | F | 413743 |
| 2144 | F | 417033 |
| 2145 | F | 415114 |
| 2146 | F | 417163 |
| 2147 | F | 415332 |
| 2148 | F | 418186 |
| 2149 | F | 416265 |
| 2150 | F | 420186 |
| 2151 | F | 418259 |
| 2152 | F | 420697 |
| 2153 | F | 418861 |
| 2154 | F | 421313 |
| 2155 | F | 419437 |
| 2156 | F | 422172 |
| 2157 | F | 420342 |
| 2158 | F | 423342 |
| 2159 | F | 421412 |
| 2160 | F | 424008 |
| 2161 | F | 422073 |
| 2162 | F | 424585 |
| 2163 | F | 422711 |
| 2164 | F | 426021 |
| 2165 | F | 424107 |
| 2166 | F | 427407 |
| 2167 | F | 425513 |
| 2168 | F | 427936 |
| 2169 | F | 426053 |
| 2170 | F | 428592 |
| 2171 | F | 426717 |
| 2172 | F | 430475 |
| 2173 | F | 428558 |
| 2174 | F | 431378 |
| 2175 | F | 429417 |
| 2176 | F | 431927 |
| 2177 | F | 430046 |
| 2178 | F | 432609 |
| 2179 | F | 430710 |
| 2180 | F | 433005 |
| 2181 | F | 431082 |
| 2182 | F | 433712 |
| 2183 | F | 431812 |
| 2184 | F | 436521 |
| 2185 | F | 434640 |
| 2186 | F | 436897 |
| 2187 | F | 435057 |
| 2188 | F | 439741 |
| 2189 | F | 437882 |
| 2190 | F | 438296 |
| 2191 | F | 436377 |
| 2192 | F | 440475 |
| 2193 | F | 438538 |
| 2194 | F | 440281 |
| 2195 | F | 438394 |
| 2196 | F | 440989 |
| 2197 | F | 439080 |
| 2198 | F | 442121 |
| 2199 | F | 440252 |
| 2200 | F | 442121 |
| 2201 | F | 440221 |
| 2202 | F | 442780 |
| 2203 | F | 440879 |
| 2204 | F | 443285 |
| 2205 | F | 441384 |
| 2206 | F | 444276 |
| 2207 | F | 442406 |
| 2208 | F | 444472 |
| 2209 | F | 442568 |
| 2210 | F | 444960 |
| 2211 | F | 443040 |
| 2212 | F | 445556 |
| 2213 | F | 443681 |
| 2214 | F | 447565 |
| 2215 | F | 445676 |
| 2216 | F | 448396 |
| 2217 | F | 446496 |
| 2218 | F | 450057 |
| 2219 | F | 448133 |
| 2220 | F | 450444 |
| 2221 | F | 448555 |
| 2222 | F | 450988 |
| 2223 | F | 449054 |
| 2224 | F | 452212 |
| 2225 | F | 450329 |
| 2226 | F | 453450 |
| 2227 | F | 451581 |
| 2228 | F | 454643 |
| 2229 | F | 452718 |
| 2230 | F | 456004 |
| 2231 | F | 454124 |
| 2232 | F | 456785 |
| 2233 | F | 454897 |
| 2234 | F | 457749 |
| 2235 | F | 455856 |
| 2236 | F | 458132 |
| 2237 | F | 456205 |
| 2238 | F | 459216 |
| 2239 | F | 457348 |
| 2240 | F | 460692 |
| 2241 | F | 458792 |
| 2242 | F | 460133 |
| 2243 | F | 458230 |
| 2244 | F | 461228 |
| 2245 | F | 459327 |
| 2246 | F | 462183 |
| 2247 | F | 460269 |
| 2248 | F | 463120 |
| 2249 | F | 461220 |

TABLE 5-continued

| SEQ ID | or. | 5' position |
|---|---|---|
| 2250 | F | 464355 |
| 2251 | F | 462444 |
| 2252 | F | 464842 |
| 2253 | F | 463010 |
| 2254 | F | 465346 |
| 2255 | F | 463451 |
| 2256 | F | 466061 |
| 2257 | F | 464143 |
| 2258 | F | 466780 |
| 2259 | F | 464842 |
| 2260 | F | 467462 |
| 2261 | F | 465578 |
| 2262 | F | 469419 |
| 2263 | F | 467538 |
| 2264 | F | 471324 |
| 2265 | F | 469419 |
| 2266 | F | 470463 |
| 2267 | F | 468587 |
| 2268 | F | 471822 |
| 2269 | F | 469897 |
| 2270 | F | 472471 |
| 2271 | F | 470610 |
| 2272 | F | 473208 |
| 2273 | F | 471319 |
| 2274 | F | 475143 |
| 2275 | F | 473243 |
| 2276 | F | 477091 |
| 2277 | F | 475181 |
| 2278 | F | 477375 |
| 2279 | F | 475475 |
| 2280 | F | 478473 |
| 2281 | F | 476586 |
| 2282 | F | 479058 |
| 2283 | F | 477158 |
| 2284 | F | 479829 |
| 2285 | F | 477916 |
| 2286 | F | 481237 |
| 2287 | F | 479312 |
| 2288 | F | 481769 |
| 2289 | F | 479903 |
| 2290 | F | 482435 |
| 2291 | F | 480535 |
| 2292 | F | 483976 |
| 2293 | F | 482075 |
| 2294 | F | 484899 |
| 2295 | F | 483029 |
| 2296 | F | 485593 |
| 2297 | F | 483674 |
| 2298 | F | 486401 |
| 2299 | F | 484498 |
| 2300 | F | 486762 |
| 2301 | F | 484859 |
| 2302 | F | 487287 |
| 2303 | F | 485366 |
| 2304 | F | 487487 |
| 2305 | F | 485642 |
| 2306 | F | 488811 |
| 2307 | F | 486942 |
| 2308 | F | 488918 |
| 2309 | F | 487001 |
| 2310 | F | 489740 |
| 2311 | F | 487772 |
| 2312 | F | 490300 |
| 2313 | F | 488400 |
| 2314 | F | 490880 |
| 2315 | F | 488969 |
| 2316 | F | 491167 |
| 2317 | F | 489268 |
| 2318 | F | 492066 |
| 2319 | F | 490096 |
| 2320 | F | 494600 |
| 2321 | F | 492697 |
| 2322 | F | 495778 |
| 2323 | F | 493845 |
| 2324 | F | 496350 |
| 2325 | F | 494396 |
| 2326 | F | 497139 |
| 2327 | F | 495210 |
| 2328 | F | 497504 |
| 2329 | F | 495651 |
| 2330 | F | 498216 |
| 2331 | F | 496381 |
| 2332 | F | 498990 |
| 2333 | F | 497076 |
| 2334 | F | 499284 |
| 2335 | F | 497401 |
| 2336 | F | 499563 |
| 2337 | F | 497644 |
| 2338 | F | 500555 |
| 2339 | F | 498645 |
| 2340 | F | 503868 |
| 2341 | F | 502008 |
| 2342 | F | 504574 |
| 2343 | F | 502741 |
| 2344 | F | 506571 |
| 2345 | F | 504671 |
| 2346 | F | 507498 |
| 2347 | F | 505565 |
| 2348 | F | 507615 |
| 2349 | F | 505777 |
| 2350 | F | 510441 |
| 2351 | F | 508522 |
| 2352 | F | 513523 |
| 2353 | F | 511660 |
| 2354 | F | 516834 |
| 2355 | F | 514938 |
| 2356 | F | 515101 |
| 2357 | F | 513277 |
| 2358 | F | 517031 |
| 2359 | F | 515093 |
| 2360 | F | 517620 |
| 2361 | F | 515698 |
| 2362 | F | 518070 |
| 2363 | F | 516181 |
| 2364 | F | 521162 |
| 2365 | F | 519241 |
| 2366 | F | 523023 |
| 2367 | F | 521123 |
| 2368 | F | 523865 |
| 2369 | F | 522003 |
| 2370 | F | 524373 |
| 2371 | F | 522530 |
| 2372 | F | 526029 |
| 2373 | F | 524115 |
| 2374 | F | 526479 |
| 2375 | F | 524580 |
| 2376 | F | 526756 |
| 2377 | F | 524823 |
| 2378 | F | 528167 |
| 2379 | F | 526263 |
| 2380 | F | 529315 |
| 2381 | F | 527408 |
| 2382 | F | 530372 |
| 2383 | F | 528484 |
| 2384 | F | 531842 |
| 2385 | F | 529945 |
| 2386 | F | 534077 |
| 2387 | F | 532190 |
| 2388 | F | 536335 |
| 2389 | F | 534585 |
| 2390 | F | 536858 |
| 2391 | F | 534931 |
| 2392 | F | 537710 |
| 2393 | F | 535810 |
| 2394 | F | 538105 |
| 2395 | F | 536211 |
| 2396 | F | 538901 |
| 2397 | F | 536979 |
| 2398 | F | 539360 |
| 2399 | F | 537421 |
| 2400 | F | 541059 |
| 2401 | F | 539160 |
| 2402 | F | 542198 |
| 2403 | F | 540335 |

TABLE 5-continued

| SEQ ID | or. | 5' position |
|---|---|---|
| 2404 | F | 542650 |
| 2405 | F | 540840 |
| 2406 | F | 543589 |
| 2407 | F | 541677 |
| 2408 | F | 546376 |
| 2409 | F | 544486 |
| 2410 | F | 546731 |
| 2411 | F | 544872 |
| 2412 | F | 549480 |
| 2413 | F | 547547 |
| 2414 | F | 550245 |
| 2415 | F | 548328 |
| 2416 | F | 551224 |
| 2417 | F | 549328 |
| 2418 | F | 552433 |
| 2419 | F | 550520 |
| 2420 | F | 554767 |
| 2421 | F | 552882 |
| 2422 | F | 555444 |
| 2423 | F | 553541 |
| 2424 | F | 557979 |
| 2425 | F | 556089 |
| 2426 | F | 557923 |
| 2427 | F | 555988 |
| 2428 | F | 561193 |
| 2429 | F | 559292 |
| 2430 | F | 559671 |
| 2431 | F | 557777 |
| 2432 | F | 561555 |
| 2433 | F | 559655 |
| 2434 | F | 563727 |
| 2435 | F | 561828 |
| 2436 | F | 564714 |
| 2437 | F | 562803 |
| 2438 | F | 566079 |
| 2439 | F | 564180 |
| 2440 | F | 567470 |
| 2441 | F | 565569 |
| 2442 | F | 568454 |
| 2443 | F | 566609 |
| 2444 | F | 569194 |
| 2445 | F | 567291 |
| 2446 | F | 570873 |
| 2447 | F | 568996 |
| 2448 | F | 571678 |
| 2449 | F | 569809 |
| 2450 | F | 571983 |
| 2451 | F | 570083 |
| 2452 | F | 571837 |
| 2453 | F | 569998 |
| 2454 | F | 572927 |
| 2455 | F | 571022 |
| 2456 | F | 574804 |
| 2457 | F | 572868 |
| 2458 | F | 576267 |
| 2459 | F | 574354 |
| 2460 | F | 577925 |
| 2461 | F | 576082 |
| 2462 | F | 578598 |
| 2463 | F | 576721 |
| 2464 | F | 579758 |
| 2465 | F | 577878 |
| 2466 | F | 579620 |
| 2467 | F | 577731 |
| 2468 | F | 579950 |
| 2469 | F | 578022 |
| 2470 | F | 581080 |
| 2471 | F | 579248 |
| 2472 | F | 581459 |
| 2473 | F | 579555 |
| 2474 | F | 582128 |
| 2475 | F | 580221 |
| 2476 | F | 583209 |
| 2477 | F | 581305 |
| 2478 | F | 584650 |
| 2479 | F | 582828 |
| 2480 | F | 585407 |
| 2481 | F | 583467 |
| 2482 | F | 586579 |
| 2483 | F | 584650 |
| 2484 | F | 587655 |
| 2485 | F | 585772 |
| 2486 | F | 587899 |
| 2487 | F | 586058 |
| 2488 | F | 589079 |
| 2489 | F | 587173 |
| 2490 | F | 590446 |
| 2491 | F | 588616 |
| 2492 | F | 592279 |
| 2493 | F | 590407 |
| 2494 | F | 592585 |
| 2495 | F | 590716 |
| 2496 | F | 593527 |
| 2497 | F | 591593 |
| 2498 | F | 594047 |
| 2499 | F | 592210 |
| 2500 | F | 595658 |
| 2501 | F | 593758 |
| 2502 | F | 596225 |
| 2503 | F | 594387 |
| 2504 | F | 596964 |
| 2505 | F | 595006 |
| 2506 | F | 597536 |
| 2507 | F | 595635 |
| 2508 | F | 598383 |
| 2509 | F | 596448 |
| 2510 | F | 599154 |
| 2511 | F | 597254 |
| 2512 | F | 600368 |
| 2513 | F | 598433 |
| 2514 | F | 600665 |
| 2515 | F | 598769 |
| 2516 | F | 602011 |
| 2517 | F | 600087 |
| 2518 | F | 602418 |
| 2519 | F | 600513 |
| 2520 | F | 602921 |
| 2521 | F | 601009 |
| 2522 | F | 604391 |
| 2523 | F | 602468 |
| 2524 | F | 605571 |
| 2525 | F | 603671 |
| 2526 | F | 606334 |
| 2527 | F | 604452 |
| 2528 | F | 607133 |
| 2529 | F | 605167 |
| 2530 | F | 608673 |
| 2531 | F | 606773 |
| 2532 | F | 609710 |
| 2533 | F | 607794 |
| 2534 | F | 610711 |
| 2535 | F | 608882 |
| 2536 | F | 611524 |
| 2537 | F | 609623 |
| 2538 | F | 612119 |
| 2539 | F | 610213 |
| 2540 | F | 613820 |
| 2541 | F | 611861 |
| 2542 | F | 614604 |
| 2543 | F | 612704 |
| 2544 | F | 614960 |
| 2545 | F | 613056 |
| 2546 | F | 616387 |
| 2547 | F | 614471 |
| 2548 | F | 617574 |
| 2549 | F | 615586 |
| 2550 | F | 619430 |
| 2551 | F | 617510 |
| 2552 | F | 618561 |
| 2553 | F | 616679 |
| 2554 | F | 619799 |
| 2555 | F | 617886 |
| 2556 | F | 621043 |
| 2557 | F | 619133 |

TABLE 5-continued

| SEQ ID | or. | 5' position |
|---|---|---|
| 2558 | F | 622333 |
| 2559 | F | 620411 |
| 2560 | F | 623110 |
| 2561 | F | 621211 |
| 2562 | F | 623952 |
| 2563 | F | 622052 |
| 2564 | F | 624774 |
| 2565 | F | 622872 |
| 2566 | F | 625263 |
| 2567 | F | 623369 |
| 2568 | F | 625664 |
| 2569 | F | 623773 |
| 2570 | F | 626220 |
| 2571 | F | 624297 |
| 2572 | F | 627684 |
| 2573 | F | 625785 |
| 2574 | F | 628536 |
| 2575 | F | 626655 |
| 2576 | F | 629438 |
| 2577 | F | 627541 |
| 2578 | F | 631496 |
| 2579 | F | 629606 |
| 2580 | F | 633301 |
| 2581 | F | 631397 |
| 2582 | F | 637012 |
| 2583 | F | 635112 |
| 2584 | F | 638002 |
| 2585 | F | 636114 |
| 2586 | F | 638598 |
| 2587 | F | 636682 |
| 2588 | F | 638836 |
| 2589 | F | 636938 |
| 2590 | F | 639333 |
| 2591 | F | 637471 |
| 2592 | F | 640506 |
| 2593 | F | 638598 |
| 2594 | F | 640730 |
| 2595 | F | 638885 |
| 2596 | F | 641468 |
| 2597 | F | 639550 |
| 2598 | F | 642029 |
| 2599 | F | 640162 |
| 2600 | F | 642785 |
| 2601 | F | 640954 |
| 2602 | F | 643129 |
| 2603 | F | 641229 |
| 2604 | F | 643440 |
| 2605 | F | 641522 |
| 2606 | F | 645316 |
| 2607 | F | 643376 |
| 2608 | F | 645552 |
| 2609 | F | 643613 |
| 2610 | F | 646025 |
| 2611 | F | 644186 |
| 2612 | F | 646773 |
| 2613 | F | 644904 |
| 2614 | F | 647678 |
| 2615 | F | 645712 |
| 2616 | F | 648128 |
| 2617 | F | 646249 |
| 2618 | F | 650179 |
| 2619 | F | 648244 |
| 2620 | F | 651010 |
| 2621 | F | 649149 |
| 2622 | F | 652904 |
| 2623 | F | 651003 |
| 2624 | F | 653946 |
| 2625 | F | 652070 |
| 2626 | F | 655735 |
| 2627 | F | 653827 |
| 2628 | F | 656759 |
| 2629 | F | 654894 |
| 2630 | F | 658287 |
| 2631 | F | 656399 |
| 2632 | F | 659973 |
| 2633 | F | 658109 |
| 2634 | F | 662935 |
| 2635 | F | 661035 |
| 2636 | F | 664393 |
| 2637 | F | 662513 |
| 2638 | F | 665972 |
| 2639 | F | 664090 |
| 2640 | F | 666765 |
| 2641 | F | 664879 |
| 2642 | F | 667690 |
| 2643 | F | 665707 |
| 2644 | F | 668261 |
| 2645 | F | 666370 |
| 2646 | F | 668934 |
| 2647 | F | 667029 |
| 2648 | F | 670871 |
| 2649 | F | 668964 |
| 2650 | F | 670629 |
| 2651 | F | 668715 |
| 2652 | F | 672231 |
| 2653 | F | 670334 |
| 2654 | F | 672846 |
| 2655 | F | 670946 |
| 2656 | F | 674040 |
| 2657 | F | 672139 |
| 2658 | F | 674573 |
| 2659 | F | 672674 |
| 2660 | F | 675234 |
| 2661 | F | 673377 |
| 2662 | F | 675834 |
| 2663 | F | 673906 |
| 2664 | F | 676378 |
| 2665 | F | 674477 |
| 2666 | F | 676746 |
| 2667 | F | 674888 |
| 2668 | F | 677769 |
| 2669 | F | 675834 |
| 2670 | F | 678270 |
| 2671 | F | 676378 |
| 2672 | F | 679221 |
| 2673 | F | 677325 |
| 2674 | F | 679874 |
| 2675 | F | 677978 |
| 2676 | F | 681173 |
| 2677 | F | 679288 |
| 2678 | F | 680607 |
| 2679 | F | 678674 |
| 2680 | F | 682210 |
| 2681 | F | 680303 |
| 2682 | F | 682542 |
| 2683 | F | 680607 |
| 2684 | F | 683716 |
| 2685 | F | 681842 |
| 2686 | F | 684312 |
| 2687 | F | 682410 |
| 2688 | F | 684880 |
| 2689 | F | 682916 |
| 2690 | F | 685958 |
| 2691 | F | 684143 |
| 2692 | F | 687264 |
| 2693 | F | 685363 |
| 2694 | F | 687959 |
| 2695 | F | 685958 |
| 2696 | F | 688514 |
| 2697 | F | 686605 |
| 2698 | F | 689372 |
| 2699 | F | 687431 |
| 2700 | F | 690201 |
| 2701 | F | 688318 |
| 2702 | F | 691271 |
| 2703 | F | 689372 |
| 2704 | F | 692436 |
| 2705 | F | 690546 |
| 2706 | F | 694813 |
| 2707 | F | 692930 |
| 2708 | F | 695787 |
| 2709 | F | 693920 |
| 2710 | F | 696363 |
| 2711 | F | 694463 |

TABLE 5-continued

| SEQ ID | or. | 5' position |
|---|---|---|
| 2712 | F | 698029 |
| 2713 | F | 696133 |
| 2714 | F | 699556 |
| 2715 | F | 697631 |
| 2716 | F | 702303 |
| 2717 | F | 700432 |
| 2718 | F | 702964 |
| 2719 | F | 701079 |
| 2720 | F | 704018 |
| 2721 | F | 702120 |
| 2722 | F | 705018 |
| 2723 | F | 703172 |
| 2724 | F | 705992 |
| 2725 | F | 704105 |
| 2726 | F | 706535 |
| 2727 | F | 704685 |
| 2728 | F | 707455 |
| 2729 | F | 705553 |
| 2730 | F | 708360 |
| 2731 | F | 706385 |
| 2732 | F | 708897 |
| 2733 | F | 706997 |
| 2734 | F | 709589 |
| 2735 | F | 707689 |
| 2736 | F | 709907 |
| 2737 | F | 707963 |
| 2738 | F | 711269 |
| 2739 | F | 709396 |
| 2740 | F | 711864 |
| 2741 | F | 709985 |
| 2742 | F | 714531 |
| 2743 | F | 712594 |
| 2744 | F | 715653 |
| 2745 | F | 713725 |
| 2746 | F | 717511 |
| 2747 | F | 715615 |
| 2748 | F | 718865 |
| 2749 | F | 716993 |
| 2750 | F | 720365 |
| 2751 | F | 718471 |
| 2752 | F | 722155 |
| 2753 | F | 720253 |
| 2754 | F | 722897 |
| 2755 | F | 720989 |
| 2756 | F | 723385 |
| 2757 | F | 721493 |
| 2758 | F | 724029 |
| 2759 | F | 722081 |
| 2760 | F | 724678 |
| 2761 | F | 722749 |
| 2762 | F | 726048 |
| 2763 | F | 724143 |
| 2764 | F | 726897 |
| 2765 | F | 724997 |
| 2766 | F | 727969 |
| 2767 | F | 726086 |
| 2768 | F | 728380 |
| 2769 | F | 726446 |
| 2770 | F | 729281 |
| 2771 | F | 727410 |
| 2772 | F | 729510 |
| 2773 | F | 727579 |
| 2774 | F | 729949 |
| 2775 | F | 728036 |
| 2776 | F | 730367 |
| 2777 | F | 728455 |
| 2778 | F | 731760 |
| 2779 | F | 729866 |
| 2780 | F | 732172 |
| 2781 | F | 730275 |
| 2782 | F | 733018 |
| 2783 | F | 731197 |
| 2784 | F | 733252 |
| 2785 | F | 731354 |
| 2786 | F | 733674 |
| 2787 | F | 731760 |
| 2788 | F | 734054 |
| 2789 | F | 732172 |
| 2790 | F | 734632 |
| 2791 | F | 732736 |
| 2792 | F | 735071 |
| 2793 | F | 733219 |
| 2794 | F | 735381 |
| 2795 | F | 733445 |
| 2796 | F | 735852 |
| 2797 | F | 733957 |
| 2798 | F | 736244 |
| 2799 | F | 734401 |
| 2800 | F | 736982 |
| 2801 | F | 735071 |
| 2802 | F | 737321 |
| 2803 | F | 735397 |
| 2804 | F | 737566 |
| 2805 | F | 735696 |
| 2806 | F | 738491 |
| 2807 | F | 736564 |
| 2808 | F | 738797 |
| 2809 | F | 736935 |
| 2810 | F | 739513 |
| 2811 | F | 737626 |
| 2812 | F | 740420 |
| 2813 | F | 738526 |
| 2814 | F | 740457 |
| 2815 | F | 738599 |
| 2816 | F | 741553 |
| 2817 | F | 739676 |
| 2818 | F | 742518 |
| 2819 | F | 740565 |
| 2820 | F | 743344 |
| 2821 | F | 741509 |
| 2822 | F | 743875 |
| 2823 | F | 741984 |
| 2824 | F | 744240 |
| 2825 | F | 742365 |
| 2826 | F | 744725 |
| 2827 | F | 742858 |
| 2828 | F | 746380 |
| 2829 | F | 744493 |
| 2830 | F | 746957 |
| 2831 | F | 745071 |
| 2832 | F | 747868 |
| 2833 | F | 746023 |
| 2834 | F | 748351 |
| 2835 | F | 746451 |
| 2836 | F | 749395 |
| 2837 | F | 747505 |
| 2838 | F | 749745 |
| 2839 | F | 747857 |
| 2840 | F | 750165 |
| 2841 | F | 748278 |
| 2842 | F | 751013 |
| 2843 | F | 749169 |
| 2844 | F | 752798 |
| 2845 | F | 750889 |
| 2846 | F | 754878 |
| 2847 | F | 752967 |
| 2848 | F | 755856 |
| 2849 | F | 754001 |
| 2850 | F | 756262 |
| 2851 | F | 754372 |
| 2852 | F | 760075 |
| 2853 | F | 758175 |
| 2854 | F | 761069 |
| 2855 | F | 759172 |
| 2856 | F | 765419 |
| 2857 | F | 759660 |
| 2858 | F | 761988 |
| 2859 | F | 760141 |
| 2860 | F | 762611 |
| 2861 | F | 760747 |
| 2862 | F | 763097 |
| 2863 | F | 761136 |
| 2864 | F | 763622 |
| 2865 | F | 761742 |

TABLE 5-continued

| SEQ ID | or. | 5' position |
|---|---|---|
| 2866 | F | 765438 |
| 2867 | F | 763525 |
| 2868 | F | 766664 |
| 2869 | F | 764747 |
| 2870 | F | 768045 |
| 2871 | F | 766196 |
| 2872 | F | 768329 |
| 2873 | F | 766429 |
| 2874 | F | 769107 |
| 2875 | F | 767244 |
| 2876 | F | 770507 |
| 2877 | F | 768633 |
| 2878 | F | 771618 |
| 2879 | F | 769725 |
| 2880 | F | 772865 |
| 2881 | F | 770975 |
| 2882 | F | 772865 |
| 2883 | F | 770970 |
| 2884 | F | 774810 |
| 2885 | F | 772927 |
| 2886 | F | 774131 |
| 2887 | F | 772232 |
| 2888 | F | 774604 |
| 2889 | F | 772782 |
| 2890 | F | 775851 |
| 2891 | F | 773934 |
| 2892 | F | 777314 |
| 2893 | F | 775412 |
| 2894 | F | 777677 |
| 2895 | F | 775781 |
| 2896 | F | 778400 |
| 2897 | F | 776472 |
| 2898 | F | 779281 |
| 2899 | F | 777333 |
| 2900 | F | 780063 |
| 2901 | F | 778150 |
| 2902 | F | 780885 |
| 2903 | F | 778994 |
| 2904 | F | 781333 |
| 2905 | F | 779431 |
| 2906 | F | 782524 |
| 2907 | F | 780674 |
| 2908 | F | 783349 |
| 2909 | F | 781433 |
| 2910 | F | 785138 |
| 2911 | F | 783238 |
| 2912 | F | 786197 |
| 2913 | F | 784328 |
| 2914 | F | 788274 |
| 2915 | F | 786387 |
| 2916 | F | 788679 |
| 2917 | F | 786778 |
| 2918 | F | 790090 |
| 2919 | F | 788213 |
| 2920 | F | 791608 |
| 2921 | F | 789711 |
| 2922 | F | 792499 |
| 2923 | F | 790605 |
| 2924 | F | 793324 |
| 2925 | F | 791440 |
| 2926 | F | 794068 |
| 2927 | F | 792115 |
| 2928 | F | 794998 |
| 2929 | F | 793098 |
| 2930 | F | 795457 |
| 2931 | F | 793582 |
| 2932 | F | 796831 |
| 2933 | F | 794931 |
| 2934 | F | 798455 |
| 2935 | F | 796551 |
| 2936 | F | 799056 |
| 2937 | F | 797147 |
| 2938 | F | 799558 |
| 2939 | F | 797649 |
| 2940 | F | 801106 |
| 2941 | F | 799204 |
| 2942 | F | 802227 |
| 2943 | F | 800325 |
| 2944 | F | 803050 |
| 2945 | F | 801153 |
| 2946 | F | 803599 |
| 2947 | F | 801682 |
| 2948 | F | 804925 |
| 2949 | F | 803016 |
| 2950 | F | 805633 |
| 2951 | F | 803672 |
| 2952 | F | 806109 |
| 2953 | F | 804192 |
| 2954 | F | 806386 |
| 2955 | F | 804453 |
| 2956 | F | 806668 |
| 2957 | F | 804746 |
| 2958 | F | 807924 |
| 2959 | F | 806022 |
| 2960 | F | 808445 |
| 2961 | F | 806525 |
| 2962 | F | 809212 |
| 2963 | F | 807283 |
| 2964 | F | 809982 |
| 2965 | F | 808079 |
| 2966 | F | 811554 |
| 2967 | F | 809659 |
| 2968 | F | 812268 |
| 2969 | F | 810340 |
| 2970 | F | 812712 |
| 2971 | F | 810799 |
| 2972 | F | 813355 |
| 2973 | F | 811466 |
| 2974 | F | 815198 |
| 2975 | F | 813243 |
| 2976 | F | 815798 |
| 2977 | F | 813917 |
| 2978 | F | 816879 |
| 2979 | F | 814940 |
| 2980 | F | 817571 |
| 2981 | F | 815676 |
| 2982 | F | 818388 |
| 2983 | F | 816489 |
| 2984 | F | 818884 |
| 2985 | F | 816921 |
| 2986 | F | 819597 |
| 2987 | F | 817680 |
| 2988 | F | 820485 |
| 2989 | F | 818555 |
| 2990 | F | 820764 |
| 2991 | F | 818878 |
| 2992 | F | 821982 |
| 2993 | F | 820080 |
| 2994 | F | 823403 |
| 2995 | F | 821559 |
| 2996 | F | 825235 |
| 2997 | F | 823320 |
| 2998 | F | 826405 |
| 2999 | F | 824501 |
| 3000 | F | 826945 |
| 3001 | F | 825046 |
| 3002 | F | 828489 |
| 3003 | F | 826588 |
| 3004 | F | 829813 |
| 3005 | F | 827917 |
| 3006 | F | 830824 |
| 3007 | F | 828906 |
| 3008 | F | 831936 |
| 3009 | F | 830099 |
| 3010 | F | 833126 |
| 3011 | F | 831274 |
| 3012 | F | 833844 |
| 3013 | F | 831936 |
| 3014 | F | 834905 |
| 3015 | F | 832943 |
| 3016 | F | 835834 |
| 3017 | F | 833938 |
| 3018 | F | 837457 |
| 3019 | F | 835536 |

TABLE 5-continued

| SEQ ID | or. | 5' position |
|---|---|---|
| 3020 | F | 838723 |
| 3021 | F | 836826 |
| 3022 | F | 840649 |
| 3023 | F | 838723 |
| 3024 | F | 841751 |
| 3025 | F | 839825 |
| 3026 | F | 842960 |
| 3027 | F | 841123 |
| 3028 | F | 843765 |
| 3029 | F | 841844 |
| 3030 | F | 844768 |
| 3031 | F | 842852 |
| 3032 | F | 846089 |
| 3033 | F | 844175 |
| 3034 | F | 848293 |
| 3035 | F | 846449 |
| 3036 | F | 848867 |
| 3037 | F | 846964 |
| 3038 | F | 850351 |
| 3039 | F | 848426 |
| 3040 | F | 851788 |
| 3041 | F | 849899 |
| 3042 | F | 852166 |
| 3043 | F | 850278 |
| 3044 | F | 853976 |
| 3045 | F | 852069 |
| 3046 | F | 854899 |
| 3047 | F | 853006 |
| 3048 | F | 855595 |
| 3049 | F | 853679 |
| 3050 | F | 856479 |
| 3051 | F | 854582 |
| 3052 | F | 858498 |
| 3053 | F | 856492 |
| 3054 | F | 859372 |
| 3055 | F | 857424 |
| 3056 | F | 860050 |
| 3057 | F | 858116 |
| 3058 | F | 860941 |
| 3059 | F | 859023 |
| 3060 | F | 861464 |
| 3061 | F | 859572 |
| 3062 | F | 862749 |
| 3063 | F | 860895 |
| 3064 | F | 864599 |
| 3065 | F | 862683 |
| 3066 | F | 865003 |
| 3067 | F | 863040 |
| 3068 | F | 866331 |
| 3069 | F | 864443 |
| 3070 | F | 866799 |
| 3071 | F | 864889 |
| 3072 | F | 867574 |
| 3073 | F | 865664 |
| 3074 | F | 868402 |
| 3075 | F | 866513 |
| 3076 | F | 869823 |
| 3077 | F | 867898 |
| 3078 | F | 870414 |
| 3079 | F | 868478 |
| 3080 | F | 871862 |
| 3081 | F | 869956 |
| 3082 | F | 872261 |
| 3083 | F | 870367 |
| 3084 | F | 874062 |
| 3085 | F | 872141 |
| 3086 | F | 874363 |
| 3087 | F | 872439 |
| 3088 | F | 875155 |
| 3089 | F | 873244 |
| 3090 | F | 878156 |
| 3091 | F | 876291 |
| 3092 | F | 879046 |
| 3093 | F | 877133 |
| 3094 | F | 880361 |
| 3095 | F | 878450 |
| 3096 | F | 882361 |
| 3097 | F | 880493 |
| 3098 | F | 883067 |
| 3099 | F | 881185 |
| 3100 | F | 883310 |
| 3101 | F | 881416 |
| 3102 | F | 884035 |
| 3103 | F | 882152 |
| 3104 | F | 885495 |
| 3105 | F | 883599 |
| 3106 | F | 887340 |
| 3107 | F | 885448 |
| 3108 | F | 887996 |
| 3109 | F | 886093 |
| 3110 | F | 888494 |
| 3111 | F | 886570 |
| 3112 | F | 889100 |
| 3113 | F | 887201 |
| 3114 | F | 889655 |
| 3115 | F | 887776 |
| 3116 | F | 891025 |
| 3117 | F | 889105 |
| 3118 | F | 891504 |
| 3119 | F | 889593 |
| 3120 | F | 891795 |
| 3121 | F | 889841 |
| 3122 | F | 892279 |
| 3123 | F | 890400 |
| 3124 | F | 892182 |
| 3125 | F | 890288 |
| 3126 | F | 893010 |
| 3127 | F | 891139 |
| 3128 | F | 893101 |
| 3129 | F | 891211 |
| 3130 | F | 895494 |
| 3131 | F | 893599 |
| 3132 | F | 896448 |
| 3133 | F | 894511 |
| 3134 | F | 897341 |
| 3135 | F | 895442 |
| 3136 | F | 899197 |
| 3137 | F | 897279 |
| 3138 | F | 899999 |
| 3139 | F | 898075 |
| 3140 | F | 903008 |
| 3141 | F | 901103 |
| 3142 | F | 904798 |
| 3143 | F | 902923 |
| 3144 | F | 906993 |
| 3145 | F | 905129 |
| 3146 | F | 907564 |
| 3147 | F | 905665 |
| 3148 | F | 907913 |
| 3149 | F | 905998 |
| 3150 | F | 908349 |
| 3151 | F | 906425 |
| 3152 | F | 909186 |
| 3153 | F | 907286 |
| 3154 | F | 911413 |
| 3155 | F | 909481 |
| 3156 | F | 912084 |
| 3157 | F | 910176 |
| 3158 | F | 912718 |
| 3159 | F | 910814 |
| 3160 | F | 913813 |
| 3161 | F | 911941 |
| 3162 | F | 915106 |
| 3163 | F | 913211 |
| 3164 | F | 915053 |
| 3165 | F | 913141 |
| 3166 | F | 916630 |
| 3167 | F | 914731 |
| 3168 | F | 917500 |
| 3169 | F | 915594 |
| 3170 | F | 918615 |
| 3171 | F | 916715 |
| 3172 | F | 919639 |
| 3173 | F | 917732 |

TABLE 5-continued

| SEQ ID | or. | 5' position |
|---|---|---|
| 3174 | F | 920216 |
| 3175 | F | 918312 |
| 3176 | F | 920971 |
| 3177 | F | 919057 |
| 3178 | F | 921889 |
| 3179 | F | 920015 |
| 3180 | F | 921773 |
| 3181 | F | 919871 |
| 3182 | F | 923428 |
| 3183 | F | 921546 |
| 3184 | F | 923841 |
| 3185 | F | 921936 |
| 3186 | F | 924795 |
| 3187 | F | 922945 |
| 3188 | F | 925102 |
| 3189 | F | 923188 |
| 3190 | F | 926130 |
| 3191 | F | 924248 |
| 3192 | F | 927729 |
| 3193 | F | 925829 |
| 3194 | F | 928112 |
| 3195 | F | 926130 |
| 3196 | F | 929014 |
| 3197 | F | 927129 |
| 3198 | F | 930776 |
| 3199 | F | 928876 |
| 3200 | F | 931898 |
| 3201 | F | 929987 |
| 3202 | F | 932291 |
| 3203 | F | 930323 |
| 3204 | F | 933264 |
| 3205 | F | 931339 |
| 3206 | F | 935505 |
| 3207 | F | 933605 |
| 3208 | F | 936779 |
| 3209 | F | 934873 |
| 3210 | F | 937000 |
| 3211 | F | 935108 |
| 3212 | F | 938062 |
| 3213 | F | 936162 |
| 3214 | F | 938536 |
| 3215 | F | 936689 |
| 3216 | F | 938934 |
| 3217 | F | 937000 |
| 3218 | F | 939541 |
| 3219 | F | 937640 |
| 3220 | F | 940603 |
| 3221 | F | 938681 |
| 3222 | F | 940758 |
| 3223 | F | 938826 |
| 3224 | F | 941387 |
| 3225 | F | 939470 |
| 3226 | F | 942261 |
| 3227 | F | 940373 |
| 3228 | F | 942563 |
| 3229 | F | 940654 |
| 3230 | F | 942807 |
| 3231 | F | 940907 |
| 3232 | F | 943510 |
| 3233 | F | 941608 |
| 3234 | F | 943771 |
| 3235 | F | 941872 |
| 3236 | F | 944330 |
| 3237 | F | 942413 |
| 3238 | F | 945147 |
| 3239 | F | 943262 |
| 3240 | F | 945527 |
| 3241 | F | 943620 |
| 3242 | F | 946627 |
| 3243 | F | 944741 |
| 3244 | F | 947165 |
| 3245 | F | 945278 |
| 3246 | F | 948674 |
| 3247 | F | 946774 |
| 3248 | F | 949646 |
| 3249 | F | 947716 |
| 3250 | F | 950731 |

TABLE 5-continued

| SEQ ID | or. | 5' position |
|---|---|---|
| 3251 | F | 948837 |
| 3252 | F | 951418 |
| 3253 | F | 949545 |
| 3254 | F | 951940 |
| 3255 | F | 950034 |
| 3256 | F | 952365 |
| 3257 | F | 950461 |
| 3258 | F | 953230 |
| 3259 | F | 951316 |
| 3260 | F | 954978 |
| 3261 | F | 953125 |
| 3262 | F | 955613 |
| 3263 | F | 953697 |
| 3264 | F | 956989 |
| 3265 | F | 955136 |
| 3266 | F | 957684 |
| 3267 | F | 955778 |
| 3268 | F | 959156 |
| 3269 | F | 957187 |
| 3270 | F | 960035 |
| 3271 | F | 958117 |
| 3272 | F | 961584 |
| 3273 | F | 959727 |
| 3274 | F | 965172 |
| 3275 | F | 963269 |
| 3276 | F | 966747 |
| 3277 | F | 964843 |
| 3278 | F | 968015 |
| 3279 | F | 966111 |
| 3280 | F | 968508 |
| 3281 | F | 966609 |
| 3282 | F | 969289 |
| 3283 | F | 967389 |
| 3284 | F | 969537 |
| 3285 | F | 967640 |
| 3286 | F | 970078 |
| 3287 | F | 968137 |
| 3288 | F | 970317 |
| 3289 | F | 968394 |
| 3290 | F | 970857 |
| 3291 | F | 968969 |
| 3292 | F | 971657 |
| 3293 | F | 969757 |
| 3294 | F | 974954 |
| 3295 | F | 973067 |
| 3296 | F | 975200 |
| 3297 | F | 973300 |
| 3298 | F | 976362 |
| 3299 | F | 974418 |
| 3300 | F | 977009 |
| 3301 | F | 975050 |
| 3302 | F | 978153 |
| 3303 | F | 976255 |
| 3304 | F | 980532 |
| 3305 | F | 978632 |
| 3306 | F | 981701 |
| 3307 | F | 979785 |
| 3308 | F | 982885 |
| 3309 | F | 980983 |
| 3310 | F | 983878 |
| 3311 | F | 981973 |
| 3312 | F | 985264 |
| 3313 | F | 983395 |
| 3314 | F | 986953 |
| 3315 | F | 985049 |
| 3316 | F | 985623 |
| 3317 | F | 983760 |
| 3318 | F | 986956 |
| 3319 | F | 985049 |
| 3320 | F | 987506 |
| 3321 | F | 985592 |
| 3322 | F | 988307 |
| 3323 | F | 986404 |
| 3324 | F | 988783 |
| 3325 | F | 986927 |
| 3326 | F | 989593 |
| 3327 | F | 987694 |

TABLE 5-continued

| SEQ ID | or. | 5' position |
|---|---|---|
| 3328 | F | 990733 |
| 3329 | F | 988783 |
| 3330 | F | 991559 |
| 3331 | F | 989675 |
| 3332 | F | 992323 |
| 3333 | F | 990421 |
| 3334 | F | 992522 |
| 3335 | F | 990640 |
| 3336 | F | 993308 |
| 3337 | F | 991361 |
| 3338 | F | 992795 |
| 3339 | F | 990919 |
| 3340 | F | 994573 |
| 3341 | F | 992673 |
| 3342 | F | 995517 |
| 3343 | F | 993570 |
| 3344 | F | 996518 |
| 3345 | F | 994660 |
| 3346 | F | 997317 |
| 3347 | F | 995450 |
| 3348 | F | 998653 |
| 3349 | F | 996762 |
| 3350 | F | 999865 |
| 3351 | F | 997908 |
| 3352 | F | 1001112 |
| 3353 | F | 999238 |
| 3354 | F | 1001651 |
| 3355 | F | 999731 |
| 3356 | F | 1003237 |
| 3357 | F | 1001317 |
| 3358 | F | 1004049 |
| 3359 | F | 1002132 |
| 3360 | F | 1004252 |
| 3361 | F | 1002307 |
| 3362 | F | 1005400 |
| 3363 | F | 1003518 |
| 3364 | F | 1005892 |
| 3365 | F | 1003958 |
| 3366 | F | 1006516 |
| 3367 | F | 1004599 |
| 3368 | F | 1007332 |
| 3369 | F | 1005446 |
| 3370 | F | 1009066 |
| 3371 | F | 1007190 |
| 3372 | F | 1014072 |
| 3373 | F | 1012172 |
| 3374 | F | 1015614 |
| 3375 | F | 1013733 |
| 3376 | F | 1016078 |
| 3377 | F | 1014172 |
| 3378 | F | 1015924 |
| 3379 | F | 1014059 |
| 3380 | F | 1016230 |
| 3381 | F | 1014330 |
| 3382 | F | 1017479 |
| 3383 | F | 1015558 |
| 3384 | F | 1018915 |
| 3385 | F | 1017003 |
| 3386 | F | 1019328 |
| 3387 | F | 1017440 |
| 3388 | F | 1020813 |
| 3389 | F | 1018915 |
| 3390 | F | 1021621 |
| 3391 | F | 1019671 |
| 3322 | F | 1023996 |
| 3393 | F | 1022107 |
| 3394 | F | 1024277 |
| 3395 | F | 1022385 |
| 3396 | F | 1025368 |
| 3397 | F | 1023468 |
| 3398 | F | 1026671 |
| 3399 | F | 1024821 |
| 3400 | F | 1027688 |
| 3401 | F | 1025823 |
| 3402 | F | 1030916 |
| 3403 | F | 1029047 |
| 3404 | F | 1031342 |
| 3405 | F | 1029430 |
| 3406 | F | 1032795 |
| 3407 | F | 1030916 |
| 3408 | F | 1032978 |
| 3409 | F | 1031078 |
| 3410 | F | 1033730 |
| 3411 | F | 1031839 |
| 3412 | F | 1035774 |
| 3413 | F | 1033821 |
| 3414 | F | 1036884 |
| 3415 | F | 1034954 |
| 3416 | F | 1037476 |
| 3417 | F | 1035577 |
| 3418 | F | 1037714 |
| 3419 | F | 1035847 |
| 3420 | F | 1038782 |
| 3421 | F | 1036884 |
| 3422 | F | 1040777 |
| 3423 | F | 1038856 |
| 3424 | F | 1042132 |
| 3425 | F | 1040216 |
| 3426 | F | 1043148 |
| 3427 | F | 1041215 |
| 3428 | F | 1044388 |
| 3429 | F | 1042445 |
| 3430 | F | 1045164 |
| 3431 | F | 1043224 |
| 3432 | F | 1046223 |
| 3433 | F | 1044324 |
| 3434 | F | 1047299 |
| 3435 | F | 1045364 |
| 3436 | F | 1049803 |
| 3437 | F | 1047914 |
| 3438 | F | 1050341 |
| 3439 | F | 1048431 |
| 3440 | F | 1050862 |
| 3441 | F | 1048907 |
| 3442 | F | 1051515 |
| 3443 | F | 1049572 |
| 3444 | F | 1051828 |
| 3445 | F | 1049917 |
| 3446 | F | 1052885 |
| 3447 | F | 1050957 |
| 3448 | F | 1053963 |
| 3449 | F | 1052057 |
| 3450 | F | 1055238 |
| 3451 | F | 1053362 |
| 3452 | F | 1055849 |
| 3453 | F | 1053963 |
| 3454 | F | 1056332 |
| 3455 | F | 1054465 |
| 3456 | F | 1056738 |
| 3457 | F | 1054830 |
| 3458 | F | 1058019 |
| 3459 | F | 1056110 |
| 3460 | F | 1058504 |
| 3461 | F | 1056587 |
| 3462 | F | 1059300 |
| 3463 | F | 1057406 |
| 3464 | F | 1060356 |
| 3465 | F | 1058400 |
| 3466 | F | 1061455 |
| 3467 | F | 1059456 |
| 3468 | F | 1062092 |
| 3469 | F | 1060243 |
| 3470 | F | 1063884 |
| 3471 | F | 1061983 |
| 3472 | F | 1064928 |
| 3473 | F | 1063056 |
| 3474 | F | 1067125 |
| 3475 | F | 1065240 |
| 3476 | F | 1067963 |
| 3477 | F | 1066075 |
| 3478 | F | 1068596 |
| 3479 | F | 1066668 |
| 3480 | F | 1069752 |
| 3481 | F | 1067890 |

TABLE 5-continued

| SEQ ID | or. | 5' position |
|---|---|---|
| 3482 | F | 1071068 |
| 3483 | F | 1069210 |
| 3484 | F | 1072701 |
| 3485 | F | 1070806 |
| 3486 | F | 1073987 |
| 3487 | F | 1072090 |
| 3488 | F | 1075643 |
| 3489 | F | 1073742 |
| 3490 | F | 1076350 |
| 3491 | F | 1074450 |
| 3492 | F | 1077354 |
| 3493 | F | 1075555 |
| 3494 | F | 1077778 |
| 3495 | F | 1075880 |
| 3496 | F | 1078445 |
| 3497 | F | 1076529 |
| 3498 | F | 1079373 |
| 3499 | F | 1077523 |
| 3500 | F | 1079715 |
| 3501 | F | 1077850 |
| 3502 | F | 1080538 |
| 3503 | F | 1078655 |
| 3504 | F | 1081108 |
| 3505 | F | 1079228 |
| 3506 | F | 1083006 |
| 3507 | F | 1081108 |
| 3508 | F | 1084404 |
| 3509 | F | 1082465 |
| 3510 | F | 1085896 |
| 3511 | F | 1083990 |
| 3512 | F | 1086468 |
| 3513 | F | 1084563 |
| 3514 | F | 1087889 |
| 3515 | F | 1085985 |
| 3516 | F | 1088427 |
| 3517 | F | 1086527 |
| 3518 | F | 1088927 |
| 3519 | F | 1087027 |
| 3520 | F | 1089668 |
| 3521 | F | 1087768 |
| 3522 | F | 1092655 |
| 3523 | F | 1090767 |
| 3524 | F | 1093357 |
| 3525 | F | 1091465 |
| 3526 | F | 1093957 |
| 3527 | F | 1092070 |
| 3528 | F | 1095818 |
| 3529 | F | 1093955 |
| 3530 | F | 1096359 |
| 3531 | F | 1094509 |
| 3532 | F | 1097047 |
| 3533 | F | 1095114 |
| 3534 | F | 1097365 |
| 3535 | F | 1095498 |
| 3536 | F | 1097646 |
| 3537 | F | 1095767 |
| 3538 | F | 1098161 |
| 3539 | F | 1096242 |
| 3540 | F | 1098560 |
| 3541 | F | 1096663 |
| 3542 | F | 1099044 |
| 3543 | F | 1097150 |
| 3544 | F | 1099454 |
| 3545 | F | 1097547 |
| 3546 | F | 1100878 |
| 3547 | F | 1098942 |
| 3548 | F | 1101839 |
| 3549 | F | 1099956 |
| 3550 | F | 1104621 |
| 3551 | F | 1102789 |
| 3552 | F | 1106487 |
| 3553 | F | 1104562 |
| 3554 | F | 1107225 |
| 3555 | F | 1105318 |
| 3556 | F | 1107814 |
| 3557 | F | 1105922 |
| 3558 | F | 1108282 |
| 3559 | F | 1106374 |
| 3560 | F | 1113162 |
| 3561 | F | 1111308 |
| 3562 | F | 1114813 |
| 3563 | F | 1112949 |
| 3564 | F | 1116611 |
| 3565 | F | 1114766 |
| 3566 | F | 1118605 |
| 3567 | F | 1116725 |
| 3568 | F | 1119754 |
| 3569 | F | 1117874 |
| 3570 | F | 1120291 |
| 3571 | F | 1118385 |
| 3572 | F | 1121099 |
| 3573 | F | 1119202 |
| 3574 | F | 1121886 |
| 3575 | F | 1119982 |
| 3576 | F | 1122979 |
| 3577 | F | 1121038 |
| 3578 | F | 1123376 |
| 3579 | F | 1121486 |
| 3580 | F | 1124136 |
| 3581 | F | 1122333 |
| 3582 | F | 1124623 |
| 3583 | F | 1122723 |
| 3584 | F | 1125306 |
| 3585 | F | 1123423 |
| 3586 | F | 1126300 |
| 3587 | F | 1124399 |
| 3588 | F | 1127440 |
| 3589 | F | 1125545 |
| 3590 | F | 1128968 |
| 3591 | F | 1127134 |
| 3592 | F | 1129916 |
| 3593 | F | 1128111 |
| 3594 | F | 1131255 |
| 3595 | F | 1129330 |
| 3596 | F | 1132598 |
| 3597 | F | 1130684 |
| 3598 | F | 1133896 |
| 3599 | F | 1132002 |
| 3600 | F | 1134373 |
| 3601 | F | 1132510 |
| 3602 | F | 1135431 |
| 3603 | F | 1133531 |
| 3604 | F | 1135730 |
| 3605 | F | 1133823 |
| 3606 | F | 1136932 |
| 3607 | F | 1135040 |
| 3608 | F | 1139875 |
| 3609 | F | 1137942 |
| 3610 | F | 1141133 |
| 3611 | F | 1139231 |
| 3612 | F | 1142301 |
| 3613 | F | 1140366 |
| 3614 | F | 1145346 |
| 3615 | F | 1143505 |
| 3616 | F | 1146637 |
| 3617 | F | 1144743 |
| 3618 | F | 1147417 |
| 3619 | F | 1145547 |
| 3620 | F | 1147981 |
| 3621 | F | 1146086 |
| 3622 | F | 1148126 |
| 3623 | F | 1146211 |
| 3624 | F | 1148913 |
| 3625 | F | 1147044 |
| 3626 | F | 1149702 |
| 3627 | F | 1147890 |
| 3628 | F | 1150561 |
| 3629 | F | 1148660 |
| 3630 | F | 1150946 |
| 3631 | F | 1149046 |
| 3632 | F | 1152302 |
| 3633 | F | 1150392 |
| 3634 | F | 1154344 |
| 3635 | F | 1152371 |

TABLE 5-continued

| SEQ ID | or. | 5' position |
|---|---|---|
| 3636 | F | 1155448 |
| 3637 | F | 1153548 |
| 3638 | F | 1156630 |
| 3639 | F | 1154729 |
| 3640 | F | 1157756 |
| 3641 | F | 1155862 |
| 3642 | F | 1160695 |
| 3643 | F | 1158788 |
| 3644 | F | 1162326 |
| 3645 | F | 1160468 |
| 3646 | F | 1163300 |
| 3647 | F | 1161413 |
| 3648 | F | 1163763 |
| 3649 | F | 1161842 |
| 3650 | F | 1164224 |
| 3651 | F | 1162283 |
| 3652 | F | 1164800 |
| 3653 | F | 1162908 |
| 3654 | F | 1I65312 |
| 3655 | F | 1163427 |
| 3656 | F | 1165877 |
| 3657 | F | 1163960 |
| 3658 | F | 1166827 |
| 3659 | F | 1164936 |
| 3660 | F | 1168099 |
| 3661 | F | 1166212 |
| 3662 | F | 1168991 |
| 3663 | F | 1167093 |
| 3664 | F | 1169769 |
| 3665 | F | 1167907 |
| 3666 | F | 1170349 |
| 3667 | F | 1168446 |
| 3668 | F | 1170953 |
| 3669 | F | 1169031 |
| 3670 | F | 1171641 |
| 3671 | F | 1169703 |
| 3672 | F | 1172172 |
| 3673 | F | 1170256 |
| 3674 | F | 1173649 |
| 3675 | F | 1171759 |
| 3676 | F | 1174885 |
| 3677 | F | 1172999 |
| 3678 | F | 1175559 |
| 3679 | F | 1173649 |
| 3680 | F | 1176927 |
| 3681 | F | 1175025 |
| 3682 | F | 1178912 |
| 3683 | F | 1176985 |
| 3684 | F | 1179826 |
| 3685 | F | 1177910 |
| 3686 | F | 1180498 |
| 3687 | F | 1178666 |
| 3688 | F | 1181716 |
| 3689 | F | 1179839 |
| 3690 | F | 1182069 |
| 3691 | F | 1180140 |
| 3692 | F | 1183626 |
| 3693 | F | 1181716 |
| 3694 | F | 1184128 |
| 3695 | F | 1182244 |
| 3696 | F | 1185004 |
| 3697 | F | 1183084 |
| 3698 | F | 1185897 |
| 3699 | F | 1184029 |
| 3700 | F | 1187151 |
| 3701 | F | 1185251 |
| 3702 | F | 1186262 |
| 3703 | F | 1184361 |
| 3704 | F | 1189054 |
| 3705 | F | 1187160 |
| 3706 | F | 1190885 |
| 3707 | F | 1188990 |
| 3708 | F | 1191507 |
| 3709 | F | 1189579 |
| 3710 | F | 1191932 |
| 3711 | F | 1190008 |
| 3712 | F | 1192524 |
| 3713 | F | 1190640 |
| 3714 | F | 1192759 |
| 3715 | F | 1190869 |
| 3716 | F | 1193642 |
| 3717 | F | 1191742 |
| 3718 | F | 1193557 |
| 3719 | F | 1191657 |
| 3720 | F | 1194015 |
| 3721 | F | 1192120 |
| 3722 | F | 1195490 |
| 3723 | F | 1193560 |
| 3724 | F | 1196093 |
| 3725 | F | 1194215 |
| 3726 | F | 1196474 |
| 3727 | F | 1194592 |
| 3728 | F | 1197659 |
| 3729 | F | 1195724 |
| 3730 | F | 1198499 |
| 3731 | F | 1196578 |
| 3732 | F | 1199912 |
| 3733 | F | 1197986 |
| 3734 | F | 1200969 |
| 3735 | F | 1199133 |
| 3736 | F | 1202121 |
| 3737 | F | 1200227 |
| 3738 | F | 1202957 |
| 3739 | F | 1201058 |
| 3740 | F | 1202590 |
| 3741 | F | 1200694 |
| 3742 | F | 1203923 |
| 3743 | F | 1202049 |
| 3744 | F | 1204631 |
| 3745 | F | 1202753 |
| 3746 | F | 1205864 |
| 3747 | F | 1203964 |
| 3748 | F | 1206483 |
| 3749 | F | 1204592 |
| 3750 | F | 1207629 |
| 3751 | F | 1205727 |
| 3752 | F | 1208802 |
| 3753 | F | 1206909 |
| 3754 | F | 1209500 |
| 3755 | F | 1207557 |
| 3756 | F | 1210483 |
| 3757 | F | 1208584 |
| 3758 | F | 1211618 |
| 3759 | F | 1209745 |
| 3760 | F | 1212523 |
| 3761 | F | 1210554 |
| 3762 | F | 1213827 |
| 3763 | F | 1211927 |
| 3764 | F | 1214875 |
| 3765 | F | 1212992 |
| 3766 | F | 1215293 |
| 3767 | F | 1213430 |
| 3768 | F | 1216043 |
| 3769 | F | 1214183 |
| 3770 | F | 1216226 |
| 3771 | F | 1214374 |
| 3772 | F | 1216927 |
| 3773 | F | 1215064 |
| 3774 | F | 1219490 |
| 3775 | F | 1217534 |
| 3776 | F | 1219431 |
| 3777 | F | 1217534 |
| 3778 | F | 1220403 |
| 3779 | F | 1218475 |
| 3780 | F | 1221383 |
| 3781 | F | 1219499 |
| 3782 | F | 1223653 |
| 3783 | F | 1221767 |
| 3784 | F | 1224758 |
| 3785 | F | 1222881 |
| 3786 | F | 1226308 |
| 3787 | F | 1224409 |
| 3788 | F | 1225625 |
| 3789 | F | 1223654 |

TABLE 5-continued

| SEQ ID | or. | 5' position |
|---|---|---|
| 3790 | F | 1227566 |
| 3791 | F | 1225677 |
| 3792 | F | 1227858 |
| 3793 | F | 1225937 |
| 3794 | F | 1228081 |
| 3795 | F | 1226189 |
| 3796 | B | 1019 |
| 3797 | B | 2954 |
| 3798 | B | 1843 |
| 3799 | B | 3739 |
| 3800 | B | 2694 |
| 3801 | B | 4545 |
| 3802 | B | 3694 |
| 3803 | B | 5513 |
| 3804 | B | 4290 |
| 3805 | B | 6238 |
| 3806 | B | 5924 |
| 3807 | B | 7846 |
| 3808 | B | 7687 |
| 3809 | B | 9583 |
| 3810 | B | 9189 |
| 3811 | B | 11095 |
| 3812 | B | 10261 |
| 3813 | B | 12119 |
| 3814 | B | 10982 |
| 3815 | B | 12839 |
| 3816 | B | 11463 |
| 3817 | B | 13355 |
| 3818 | B | 12950 |
| 3819 | B | 14850 |
| 3820 | B | 14425 |
| 3821 | B | 16332 |
| 3822 | B | 17477 |
| 3823 | B | 19400 |
| 3824 | B | 16296 |
| 3825 | B | 18161 |
| 3826 | B | 21128 |
| 3827 | B | 22976 |
| 3828 | B | 22265 |
| 3829 | B | 24185 |
| 3830 | B | 23701 |
| 3831 | B | 25599 |
| 3832 | B | 26350 |
| 3833 | B | 28258 |
| 3834 | B | 26350 |
| 3835 | B | 28258 |
| 3836 | B | 27241 |
| 3837 | B | 29113 |
| 3838 | B | 27977 |
| 3839 | B | 29896 |
| 3840 | B | 28804 |
| 3841 | B | 30700 |
| 3842 | B | 29727 |
| 3843 | B | 31642 |
| 3844 | B | 30253 |
| 3845 | B | 32158 |
| 3846 | B | 31775 |
| 3847 | B | 33657 |
| 3848 | B | 32511 |
| 3849 | B | 34422 |
| 3850 | B | 34214 |
| 3851 | B | 36114 |
| 3852 | B | 34765 |
| 3853 | B | 36664 |
| 3854 | B | 36289 |
| 3855 | B | 38186 |
| 3856 | B | 37759 |
| 3857 | B | 39682 |
| 3858 | B | 39585 |
| 3859 | B | 41496 |
| 3860 | B | 40942 |
| 3861 | B | 42840 |
| 3862 | B | 39640 |
| 3863 | B | 41543 |
| 3864 | B | 43329 |
| 3865 | B | 45196 |
| 3866 | B | 44025 |
| 3867 | B | 45979 |
| 3868 | B | 45048 |
| 3869 | B | 46970 |
| 3870 | B | 45582 |
| 3871 | B | 47472 |
| 3872 | B | 45979 |
| 3873 | B | 47901 |
| 3874 | B | 47216 |
| 3875 | B | 49128 |
| 3876 | B | 47791 |
| 3877 | B | 49689 |
| 3878 | B | 48196 |
| 3879 | B | 50126 |
| 3880 | B | 49180 |
| 3881 | B | 51105 |
| 3882 | B | 50231 |
| 3883 | B | 52149 |
| 3884 | B | 51697 |
| 3885 | B | 53619 |
| 3886 | B | 52917 |
| 3887 | B | 54735 |
| 3888 | B | 53619 |
| 3889 | B | 55476 |
| 3890 | B | 53910 |
| 3891 | B | 55816 |
| 3892 | B | 54416 |
| 3893 | B | 56326 |
| 3894 | B | 55107 |
| 3895 | B | 57009 |
| 3896 | B | 56693 |
| 3897 | B | 58586 |
| 3898 | B | 57489 |
| 3899 | B | 59394 |
| 3900 | B | 58749 |
| 3901 | B | 60649 |
| 3902 | B | 60086 |
| 3903 | B | 62002 |
| 3904 | B | 62375 |
| 3905 | B | 64275 |
| 3906 | B | 61715 |
| 3907 | B | 63633 |
| 3908 | B | 62699 |
| 3909 | B | 64601 |
| 3910 | B | 63981 |
| 3911 | B | 65858 |
| 3912 | B | 64268 |
| 3913 | B | 66227 |
| 3914 | B | 64423 |
| 3915 | B | 66309 |
| 3916 | B | 64834 |
| 3917 | B | 66756 |
| 3918 | B | 65705 |
| 3919 | B | 67611 |
| 3920 | B | 66228 |
| 3921 | B | 68163 |
| 3922 | B | 67538 |
| 3923 | B | 69404 |
| 3924 | B | 67961 |
| 3925 | B | 69841 |
| 3926 | B | 68796 |
| 3927 | B | 70662 |
| 3928 | B | 70984 |
| 3929 | B | 72885 |
| 3930 | B | 69392 |
| 3931 | B | 71314 |
| 3932 | B | 71365 |
| 3933 | B | 73287 |
| 3934 | B | 72253 |
| 3935 | B | 74167 |
| 3936 | B | 73916 |
| 3937 | B | 75760 |
| 3938 | B | 76398 |
| 3939 | B | 78328 |
| 3940 | B | 77734 |
| 3941 | B | 79610 |
| 3942 | B | 78592 |
| 3943 | B | 80517 |

TABLE 5-continued

| SEQ ID | or. | 5' position |
|---|---|---|
| 3944 | B | 79577 |
| 3945 | B | 81476 |
| 3946 | B | 79968 |
| 3947 | B | 81861 |
| 3948 | B | 80203 |
| 3949 | B | 82108 |
| 3950 | B | 80665 |
| 3951 | B | 82565 |
| 3952 | B | 81257 |
| 3953 | B | 83184 |
| 3954 | B | 83370 |
| 3955 | B | 85203 |
| 3956 | B | 84202 |
| 3957 | B | 86080 |
| 3958 | B | 85032 |
| 3959 | B | 86902 |
| 3960 | B | 85520 |
| 3961 | B | 87367 |
| 3962 | B | 85648 |
| 3963 | B | 87548 |
| 3964 | B | 86155 |
| 3965 | B | 88052 |
| 3966 | B | 86806 |
| 3967 | B | 88768 |
| 3968 | B | 88389 |
| 3969 | B | 90207 |
| 3970 | B | 89174 |
| 3971 | B | 91107 |
| 3972 | B | 91319 |
| 3973 | B | 93151 |
| 3974 | B | 93306 |
| 3975 | B | 95184 |
| 3976 | B | 94311 |
| 3977 | B | 96210 |
| 3978 | B | 94761 |
| 3979 | B | 96578 |
| 3980 | B | 95640 |
| 3981 | B | 97452 |
| 3982 | B | 96835 |
| 3983 | B | 98743 |
| 3984 | B | 97685 |
| 3985 | B | 99639 |
| 3986 | B | 98655 |
| 3987 | B | 100585 |
| 3988 | B | 99680 |
| 3989 | B | 101592 |
| 3990 | B | 101592 |
| 3991 | B | 103448 |
| 3992 | B | 101950 |
| 3993 | B | 103878 |
| 3994 | B | 102534 |
| 3995 | B | 104467 |
| 3996 | B | 103031 |
| 3997 | B | 104947 |
| 3998 | B | 103754 |
| 3999 | B | 105653 |
| 4000 | B | 104281 |
| 4001 | B | 106192 |
| 4002 | B | 104786 |
| 4003 | B | 106618 |
| 4004 | B | 108635 |
| 4005 | B | 110512 |
| 4006 | B | 112299 |
| 4007 | B | 114196 |
| 4008 | B | 112839 |
| 4009 | B | 114713 |
| 4010 | B | 113960 |
| 4011 | B | 115829 |
| 4012 | B | 114352 |
| 4013 | B | 116272 |
| 4014 | B | 114932 |
| 4015 | B | 116831 |
| 4016 | B | 116002 |
| 4017 | B | 117886 |
| 4018 | B | 116781 |
| 4019 | B | 118702 |
| 4020 | B | 118284 |
| 4021 | B | 120181 |
| 4022 | B | 118749 |
| 4023 | B | 120691 |
| 4024 | B | 120124 |
| 4025 | B | 122009 |
| 4026 | B | 120691 |
| 4027 | B | 122601 |
| 4028 | B | 122655 |
| 4029 | B | 124563 |
| 4030 | B | 123173 |
| 4031 | B | 125141 |
| 4032 | B | 123579 |
| 4033 | B | 125526 |
| 4034 | B | 126570 |
| 4035 | B | 128539 |
| 4036 | B | 129398 |
| 4037 | B | 131325 |
| 4038 | B | 134942 |
| 4039 | B | 136814 |
| 4040 | B | 136628 |
| 4041 | B | 138531 |
| 4042 | B | 138117 |
| 4043 | B | 139995 |
| 4044 | B | 138531 |
| 4045 | B | 140363 |
| 4046 | B | 138525 |
| 4047 | B | 140361 |
| 4048 | B | 139778 |
| 4049 | B | 141692 |
| 4050 | B | 140577 |
| 4051 | B | 142487 |
| 4052 | B | 142067 |
| 4053 | B | 143981 |
| 4054 | B | 142919 |
| 4055 | B | 144787 |
| 4056 | B | 144478 |
| 4057 | B | 146417 |
| 4058 | B | 145520 |
| 4059 | B | 147378 |
| 4060 | B | 146972 |
| 4061 | B | 148872 |
| 4062 | B | 147545 |
| 4063 | B | 149452 |
| 4064 | B | 147756 |
| 4065 | B | 149677 |
| 4066 | B | 148484 |
| 4067 | B | 150382 |
| 4068 | B | 152436 |
| 4069 | B | 154325 |
| 4070 | B | 154353 |
| 4071 | B | 156228 |
| 4072 | B | 155395 |
| 4073 | B | 157286 |
| 4074 | B | 155740 |
| 4075 | B | 157613 |
| 4076 | B | 157002 |
| 4077 | B | 158902 |
| 4078 | B | 157861 |
| 4079 | B | 159764 |
| 4080 | B | 159219 |
| 4081 | B | 161121 |
| 4082 | B | 159569 |
| 4083 | B | 161484 |
| 4084 | B | 160221 |
| 4085 | B | 162109 |
| 4086 | B | 160670 |
| 4087 | B | 162572 |
| 4088 | B | 161075 |
| 4089 | B | 162983 |
| 4090 | B | 161789 |
| 4091 | B | 163728 |
| 4092 | B | 162380 |
| 4093 | B | 164291 |
| 4094 | B | 162671 |
| 4095 | B | 164573 |
| 4096 | B | 164340 |
| 4097 | B | 166222 |

TABLE 5-continued

| SEQ ID | or. | 5' position |
|---|---|---|
| 4098 | B | 165693 |
| 4099 | B | 167632 |
| 4100 | B | 166627 |
| 4101 | B | 168472 |
| 4102 | B | 168668 |
| 4103 | B | 170565 |
| 4104 | B | 169244 |
| 4105 | B | 171102 |
| 4106 | B | 169734 |
| 4107 | B | 171575 |
| 4108 | B | 171259 |
| 4109 | B | 173158 |
| 4110 | B | 171701 |
| 4111 | B | 173585 |
| 4112 | B | 172018 |
| 4113 | B | 173925 |
| 4114 | B | 172759 |
| 4115 | B | 174706 |
| 4116 | B | 173718 |
| 4117 | B | 175602 |
| 4118 | B | 174902 |
| 4119 | B | 176765 |
| 4120 | B | 175869 |
| 4121 | B | 177781 |
| 4122 | B | 176181 |
| 4123 | B | 178083 |
| 4124 | B | 177158 |
| 4125 | B | 179120 |
| 4126 | B | 177599 |
| 4127 | B | 179539 |
| 4128 | B | 177928 |
| 4129 | B | 179888 |
| 4130 | B | 179693 |
| 4131 | B | 181621 |
| 4132 | B | 180070 |
| 4133 | B | 181968 |
| 4134 | B | 182017 |
| 4135 | B | 183925 |
| 4136 | B | 182865 |
| 4137 | B | 184809 |
| 4138 | B | 184640 |
| 4139 | B | 186551 |
| 4140 | B | 185253 |
| 4141 | B | 187108 |
| 4142 | B | 185703 |
| 4143 | B | 187661 |
| 4144 | B | 186129 |
| 4145 | B | 188059 |
| 4146 | B | 186395 |
| 4147 | B | 188339 |
| 4148 | B | 188056 |
| 4149 | B | 189840 |
| 4150 | B | 191218 |
| 4151 | B | 193089 |
| 4152 | B | 191880 |
| 4153 | B | 193768 |
| 4154 | B | 193026 |
| 4155 | B | 194899 |
| 4156 | B | 193709 |
| 4157 | B | 195592 |
| 4158 | B | 194284 |
| 4159 | B | 196187 |
| 4160 | B | 194284 |
| 4161 | B | 196187 |
| 4162 | B | 196032 |
| 4163 | B | 197932 |
| 4164 | B | 196298 |
| 4165 | B | 198245 |
| 4166 | B | 198296 |
| 4167 | B | 200200 |
| 4168 | B | 199677 |
| 4169 | B | 201577 |
| 4170 | B | 203050 |
| 4171 | B | 204943 |
| 4172 | B | 204776 |
| 4173 | B | 206682 |
| 4174 | B | 205877 |
| 4175 | B | 207768 |
| 4176 | B | 207568 |
| 4177 | B | 209477 |
| 4178 | B | 208009 |
| 4179 | B | 209935 |
| 4180 | B | 208490 |
| 4181 | B | 210396 |
| 4182 | B | 209832 |
| 4183 | B | 211779 |
| 4184 | B | 210948 |
| 4185 | B | 212834 |
| 4186 | B | 211360 |
| 4187 | B | 213221 |
| 4188 | B | 212036 |
| 4189 | B | 213948 |
| 4190 | B | 212409 |
| 4191 | B | 214308 |
| 4192 | B | 214299 |
| 4193 | B | 216199 |
| 4194 | B | 215173 |
| 4195 | B | 217077 |
| 4196 | B | 215689 |
| 4197 | B | 217544 |
| 4198 | B | 216374 |
| 4199 | B | 218284 |
| 4200 | B | 216932 |
| 4201 | B | 218839 |
| 4202 | B | 217507 |
| 4203 | B | 219410 |
| 4204 | B | 218089 |
| 4205 | B | 220031 |
| 4206 | B | 218491 |
| 4207 | B | 220380 |
| 4208 | B | 218839 |
| 4209 | B | 220716 |
| 4210 | B | 219152 |
| 4211 | B | 221152 |
| 4212 | B | 220125 |
| 4213 | B | 221963 |
| 4214 | B | 221602 |
| 4215 | B | 223507 |
| 4216 | B | 222939 |
| 4217 | B | 224878 |
| 4218 | B | 223791 |
| 4219 | B | 225688 |
| 4220 | B | 224019 |
| 4221 | B | 225909 |
| 4222 | B | 224491 |
| 4223 | B | 226407 |
| 4224 | B | 225279 |
| 4225 | B | 227131 |
| 4226 | B | 225798 |
| 4227 | B | 227692 |
| 4228 | B | 227030 |
| 4229 | B | 228925 |
| 4230 | B | 228032 |
| 4231 | B | 229939 |
| 4232 | B | 228555 |
| 4233 | B | 230455 |
| 4234 | B | 228925 |
| 4235 | B | 230828 |
| 4236 | B | 229587 |
| 4237 | B | 231371 |
| 4238 | B | 231239 |
| 4239 | B | 233111 |
| 4240 | B | 231737 |
| 4241 | B | 233660 |
| 4242 | B | 232306 |
| 4243 | B | 234186 |
| 4244 | B | 233044 |
| 4245 | B | 234873 |
| 4246 | B | 234599 |
| 4247 | B | 236504 |
| 4248 | B | 233738 |
| 4249 | B | 235682 |
| 4250 | B | 235454 |
| 4251 | B | 237347 |

TABLE 5-continued

| SEQ ID | or. | 5' position |
|---|---|---|
| 4252 | B | 235569 |
| 4253 | B | 237469 |
| 4254 | B | 236954 |
| 4255 | B | 238812 |
| 4256 | B | 237891 |
| 4257 | B | 239761 |
| 4258 | B | 238568 |
| 4259 | B | 240472 |
| 4260 | B | 239227 |
| 4261 | B | 241122 |
| 4262 | B | 240341 |
| 4263 | B | 242266 |
| 4264 | B | 241805 |
| 4265 | B | 243697 |
| 4266 | B | 242570 |
| 4267 | B | 244401 |
| 4268 | B | 243155 |
| 4269 | B | 245067 |
| 4270 | B | 243636 |
| 4271 | B | 245538 |
| 4272 | B | 244754 |
| 4273 | B | 246679 |
| 4274 | B | 246248 |
| 4275 | B | 248169 |
| 4276 | B | 248035 |
| 4277 | B | 249968 |
| 4278 | B | 249397 |
| 4279 | B | 251305 |
| 4280 | B | 251305 |
| 4281 | B | 253161 |
| 4282 | B | 252487 |
| 4283 | B | 254380 |
| 4284 | B | 253274 |
| 4285 | B | 255156 |
| 4286 | B | 254230 |
| 4287 | B | 256130 |
| 4288 | B | 255120 |
| 4289 | B | 256980 |
| 4290 | B | 256331 |
| 4291 | B | 258223 |
| 4292 | B | 257706 |
| 4293 | B | 259578 |
| 4294 | B | 258488 |
| 4295 | B | 260396 |
| 4296 | B | 258089 |
| 4297 | B | 260005 |
| 4298 | B | 259202 |
| 4299 | B | 261035 |
| 4300 | B | 261140 |
| 4301 | B | 263031 |
| 4302 | B | 261834 |
| 4303 | B | 263716 |
| 4304 | B | 263031 |
| 4305 | B | 264890 |
| 4306 | B | 263293 |
| 4307 | B | 265179 |
| 4308 | B | 264599 |
| 4309 | B | 266560 |
| 4310 | B | 266208 |
| 4311 | B | 268109 |
| 4312 | B | 266867 |
| 4313 | B | 268783 |
| 4314 | B | 267558 |
| 4315 | B | 269472 |
| 4316 | B | 268249 |
| 4317 | B | 270042 |
| 4318 | B | 269121 |
| 4319 | B | 271051 |
| 4320 | B | 269709 |
| 4321 | B | 271643 |
| 4322 | B | 271051 |
| 4323 | B | 272920 |
| 4324 | B | 271761 |
| 4325 | B | 273662 |
| 4326 | B | 272570 |
| 4327 | B | 274469 |
| 4328 | B | 273370 |
| 4329 | B | 275313 |
| 4330 | B | 273884 |
| 4331 | B | 275821 |
| 4332 | B | 274219 |
| 4333 | B | 276115 |
| 4334 | B | 274796 |
| 4335 | B | 276716 |
| 4336 | B | 275980 |
| 4337 | B | 277886 |
| 4338 | B | 276241 |
| 4339 | B | 278138 |
| 4340 | B | 276716 |
| 4341 | B | 278625 |
| 4342 | B | 277185 |
| 4343 | B | 279054 |
| 4344 | B | 277489 |
| 4345 | B | 279380 |
| 4346 | B | 277886 |
| 4347 | B | 279722 |
| 4348 | B | 278125 |
| 4349 | B | 280012 |
| 4350 | B | 278841 |
| 4351 | B | 280733 |
| 4352 | B | 279577 |
| 4353 | B | 281466 |
| 4354 | B | 280672 |
| 4355 | B | 282564 |
| 4356 | B | 281767 |
| 4357 | B | 283676 |
| 4358 | B | 282564 |
| 4359 | B | 284462 |
| 4360 | B | 284311 |
| 4361 | B | 286210 |
| 4362 | B | 284740 |
| 4363 | B | 286647 |
| 4364 | B | 285998 |
| 4365 | B | 287975 |
| 4366 | B | 286210 |
| 4367 | B | 288110 |
| 4368 | B | 287201 |
| 4369 | B | 289106 |
| 4370 | B | 287803 |
| 4371 | B | 289737 |
| 4372 | B | 288217 |
| 4373 | B | 290112 |
| 4374 | B | 288417 |
| 4375 | B | 290319 |
| 4376 | B | 289106 |
| 4377 | B | 290961 |
| 4378 | B | 289459 |
| 4379 | B | 291358 |
| 4380 | B | 289914 |
| 4381 | B | 291796 |
| 4382 | B | 290477 |
| 4383 | B | 292423 |
| 4384 | B | 290381 |
| 4385 | B | 292309 |
| 4386 | B | 291463 |
| 4387 | B | 293372 |
| 4388 | B | 292104 |
| 4389 | B | 293999 |
| 4390 | B | 293027 |
| 4391 | B | 294951 |
| 4392 | B | 293507 |
| 4393 | B | 295409 |
| 4394 | B | 293999 |
| 4395 | B | 295838 |
| 4396 | B | 294889 |
| 4397 | B | 296750 |
| 4398 | B | 295312 |
| 4399 | B | 297219 |
| 4400 | B | 296373 |
| 4401 | B | 298305 |
| 4402 | B | 298114 |
| 4403 | B | 299985 |
| 4404 | B | 298656 |
| 4405 | B | 300623 |

TABLE 5-continued

| SEQ ID | or. | 5' position |
|---|---|---|
| 4406 | B | 299027 |
| 4407 | B | 300899 |
| 4408 | B | 299805 |
| 4409 | B | 301692 |
| 4410 | B | 300722 |
| 4411 | B | 302621 |
| 4412 | B | 301846 |
| 4413 | B | 303706 |
| 4414 | B | 302660 |
| 4415 | B | 304642 |
| 4416 | B | 303066 |
| 4417 | B | 304962 |
| 4418 | B | 303626 |
| 4419 | B | 305479 |
| 4420 | B | 304643 |
| 4421 | B | 306514 |
| 4422 | B | 305479 |
| 4423 | B | 307390 |
| 4424 | B | 306459 |
| 4425 | B | 308393 |
| 4426 | B | 307662 |
| 4427 | B | 309601 |
| 4428 | B | 308298 |
| 4429 | B | 310153 |
| 4430 | B | 309145 |
| 4431 | B | 311044 |
| 4432 | B | 310468 |
| 4433 | B | 312338 |
| 4434 | B | 311437 |
| 4435 | B | 313337 |
| 4436 | B | 311857 |
| 4437 | B | 313860 |
| 4438 | B | 311857 |
| 4439 | B | 313860 |
| 4440 | B | 313015 |
| 4441 | B | 314911 |
| 4442 | B | 313687 |
| 4443 | B | 315549 |
| 4444 | B | 313866 |
| 4445 | B | 315784 |
| 4446 | B | 314911 |
| 4447 | B | 316804 |
| 4448 | B | 315809 |
| 4449 | B | 317701 |
| 4450 | B | 316382 |
| 4451 | B | 318284 |
| 4452 | B | 318881 |
| 4453 | B | 320778 |
| 4454 | B | 321262 |
| 4455 | B | 323214 |
| 4456 | B | 321665 |
| 4457 | B | 323565 |
| 4458 | B | 322571 |
| 4459 | B | 324461 |
| 4460 | B | 323425 |
| 4461 | B | 325316 |
| 4462 | B | 324095 |
| 4463 | B | 325977 |
| 4464 | B | 325135 |
| 4465 | B | 327001 |
| 4466 | B | 326634 |
| 4467 | B | 328557 |
| 4468 | B | 328081 |
| 4469 | B | 322959 |
| 4470 | B | 328719 |
| 4471 | B | 330596 |
| 4472 | B | 328893 |
| 4473 | B | 330825 |
| 4474 | B | 329590 |
| 4475 | B | 331485 |
| 4476 | B | 331127 |
| 4477 | B | 333069 |
| 4478 | B | 332679 |
| 4479 | B | 334592 |
| 4480 | B | 334790 |
| 4481 | B | 336673 |
| 4482 | B | 336311 |
| 4483 | B | 338267 |
| 4484 | B | 337572 |
| 4485 | B | 339431 |
| 4486 | B | 338545 |
| 4487 | B | 340463 |
| 4488 | B | 339058 |
| 4489 | B | 341011 |
| 4490 | B | 339740 |
| 4491 | B | 341628 |
| 4492 | B | 340366 |
| 4493 | B | 342354 |
| 4494 | B | 343265 |
| 4495 | B | 345125 |
| 4496 | B | 344126 |
| 4497 | B | 345957 |
| 4498 | B | 344391 |
| 4499 | B | 346291 |
| 4500 | B | 345324 |
| 4501 | B | 347236 |
| 4502 | B | 346289 |
| 4503 | B | 348198 |
| 4504 | B | 347090 |
| 4505 | B | 348914 |
| 4506 | B | 347292 |
| 4507 | B | 349158 |
| 4508 | B | 347946 |
| 4509 | B | 349851 |
| 4510 | B | 350799 |
| 4511 | B | 352598 |
| 4512 | B | 351313 |
| 4513 | B | 353223 |
| 4514 | B | 352400 |
| 4515 | B | 354357 |
| 4516 | B | 353522 |
| 4517 | B | 355411 |
| 4518 | B | 354620 |
| 4519 | B | 356610 |
| 4520 | B | 355158 |
| 4521 | B | 357057 |
| 4522 | B | 355676 |
| 4523 | B | 357681 |
| 4524 | B | 356995 |
| 4525 | B | 358866 |
| 4526 | B | 356173 |
| 4527 | B | 358074 |
| 4528 | B | 359607 |
| 4529 | B | 361536 |
| 4530 | B | 359550 |
| 4531 | B | 361442 |
| 4532 | B | 360135 |
| 4533 | B | 362033 |
| 4534 | B | 361536 |
| 4535 | B | 363461 |
| 4536 | B | 364013 |
| 4537 | B | 365905 |
| 4538 | B | 364716 |
| 4539 | B | 366707 |
| 4540 | B | 365000 |
| 4541 | B | 366941 |
| 4542 | B | 365513 |
| 4543 | B | 367447 |
| 4544 | B | 365892 |
| 4545 | B | 367873 |
| 4546 | B | 366877 |
| 4547 | B | 368725 |
| 4548 | B | 369265 |
| 4549 | B | 371167 |
| 4550 | B | 370088 |
| 4551 | B | 371988 |
| 4552 | B | 370669 |
| 4553 | B | 372611 |
| 4554 | B | 372871 |
| 4555 | B | 374773 |
| 4556 | B | 373315 |
| 4557 | B | 375227 |
| 4558 | B | 373665 |
| 4559 | B | 375592 |

TABLE 5-continued

| SEQ ID | or. | 5' position |
|---|---|---|
| 4560 | B | 374428 |
| 4561 | B | 376335 |
| 4562 | B | 375355 |
| 4563 | B | 377248 |
| 4564 | B | 375913 |
| 4565 | B | 377796 |
| 4566 | B | 376483 |
| 4567 | B | 378318 |
| 4568 | B | 377873 |
| 4569 | B | 379798 |
| 4570 | B | 380040 |
| 4571 | B | 381898 |
| 4572 | B | 380699 |
| 4573 | B | 382561 |
| 4574 | B | 381249 |
| 4575 | B | 383174 |
| 4576 | B | 381689 |
| 4577 | B | 383629 |
| 4578 | B | 383282 |
| 4579 | B | 385161 |
| 4580 | B | 383789 |
| 4581 | B | 385647 |
| 4582 | B | 385560 |
| 4583 | B | 387427 |
| 4584 | B | 386760 |
| 4585 | B | 388588 |
| 4586 | B | 387508 |
| 4587 | B | 389369 |
| 4588 | B | 388984 |
| 4589 | B | 390900 |
| 4590 | B | 390387 |
| 4591 | B | 392260 |
| 4592 | B | 391202 |
| 4593 | B | 393055 |
| 4594 | B | 392044 |
| 4595 | B | 393959 |
| 4596 | B | 392615 |
| 4597 | B | 394499 |
| 4598 | B | 393218 |
| 4599 | B | 395123 |
| 4600 | B | 393909 |
| 4601 | B | 395807 |
| 4602 | B | 394566 |
| 4603 | B | 396498 |
| 4604 | B | 395027 |
| 4605 | B | 396931 |
| 4606 | B | 395531 |
| 4607 | B | 397467 |
| 4608 | B | 396227 |
| 4609 | B | 398132 |
| 4610 | B | 398070 |
| 4611 | B | 399935 |
| 4612 | B | 399189 |
| 4613 | B | 400970 |
| 4614 | B | 400351 |
| 4615 | B | 402208 |
| 4616 | B | 401465 |
| 4617 | B | 403507 |
| 4618 | B | 401705 |
| 4619 | B | 403666 |
| 4620 | B | 402461 |
| 4621 | B | 404410 |
| 4622 | B | 403507 |
| 4623 | B | 405356 |
| 4624 | B | 404421 |
| 4625 | B | 406295 |
| 4626 | B | 406160 |
| 4627 | B | 408052 |
| 4628 | B | 407645 |
| 4629 | B | 409450 |
| 4630 | B | 407922 |
| 4631 | B | 409744 |
| 4632 | B | 409039 |
| 4633 | B | 410960 |
| 4634 | B | 410673 |
| 4635 | B | 412559 |
| 4636 | B | 411193 |
| 4637 | B | 413064 |
| 4638 | B | 412049 |
| 4639 | B | 413946 |
| 4640 | B | 414525 |
| 4641 | B | 416425 |
| 4642 | B | 415622 |
| 4643 | B | 417559 |
| 4644 | B | 416072 |
| 4645 | B | 417968 |
| 4646 | B | 417351 |
| 4647 | B | 419259 |
| 4648 | B | 417789 |
| 4649 | B | 419748 |
| 4650 | B | 418569 |
| 4651 | B | 420453 |
| 4652 | B | 420345 |
| 4653 | B | 422177 |
| 4654 | B | 421003 |
| 4655 | B | 422873 |
| 4656 | B | 421819 |
| 4657 | B | 423675 |
| 4658 | B | 422291 |
| 4659 | B | 424158 |
| 4660 | B | 423186 |
| 4661 | B | 425075 |
| 4662 | B | 424544 |
| 4663 | B | 426443 |
| 4664 | B | 424859 |
| 4665 | B | 426714 |
| 4666 | B | 426302 |
| 4667 | B | 428193 |
| 4668 | B | 427640 |
| 4669 | B | 429523 |
| 4670 | B | 428212 |
| 4671 | B | 430111 |
| 4672 | B | 428709 |
| 4673 | B | 430627 |
| 4674 | B | 430926 |
| 4675 | B | 432851 |
| 4676 | B | 431681 |
| 4677 | B | 433569 |
| 4678 | B | 432324 |
| 4679 | B | 434223 |
| 4680 | B | 433015 |
| 4681 | B | 434902 |
| 4682 | B | 433504 |
| 4683 | B | 435426 |
| 4684 | B | 434196 |
| 4685 | B | 436042 |
| 4686 | B | 436913 |
| 4687 | B | 438807 |
| 4688 | B | 437475 |
| 4689 | B | 439423 |
| 4690 | B | 438591 |
| 4691 | B | 440490 |
| 4692 | B | 440583 |
| 4693 | B | 442491 |
| 4694 | B | 440583 |
| 4695 | B | 442441 |
| 4696 | B | 441274 |
| 4697 | B | 443135 |
| 4698 | B | 441459 |
| 4699 | B | 443353 |
| 4700 | B | 442412 |
| 4701 | B | 444339 |
| 4702 | B | 443184 |
| 4703 | B | 445100 |
| 4704 | B | 443131 |
| 4705 | B | 445100 |
| 4706 | B | 443800 |
| 4707 | B | 445789 |
| 4708 | B | 444771 |
| 4709 | B | 446620 |
| 4710 | B | 445100 |
| 4711 | B | 446962 |
| 4712 | B | 445229 |
| 4713 | B | 447187 |

TABLE 5-continued

| SEQ ID | or. | 5' position |
|---|---|---|
| 4714 | B | 445974 |
| 4715 | B | 447872 |
| 4716 | B | 448028 |
| 4717 | B | 449927 |
| 4718 | B | 448958 |
| 4719 | B | 450858 |
| 4720 | B | 449850 |
| 4721 | B | 451753 |
| 4722 | B | 451103 |
| 4723 | B | 453045 |
| 4724 | B | 451482 |
| 4725 | B | 453330 |
| 4726 | B | 452676 |
| 4727 | B | 454575 |
| 4728 | B | 453884 |
| 4729 | B | 455783 |
| 4730 | B | 455068 |
| 4731 | B | 456963 |
| 4732 | B | 455875 |
| 4733 | B | 457736 |
| 4734 | B | 457231 |
| 4735 | B | 459146 |
| 4736 | B | 458008 |
| 4737 | B | 459836 |
| 4738 | B | 458598 |
| 4739 | B | 460488 |
| 4740 | B | 459717 |
| 4741 | B | 461652 |
| 4742 | B | 460417 |
| 4743 | B | 462365 |
| 4744 | B | 461391 |
| 4745 | B | 463286 |
| 4746 | B | 461680 |
| 4747 | B | 463584 |
| 4748 | B | 462520 |
| 4749 | B | 464418 |
| 4750 | B | 463584 |
| 4751 | B | 465539 |
| 4752 | B | 464547 |
| 4753 | B | 466398 |
| 4754 | B | 465288 |
| 4755 | B | 467243 |
| 4756 | B | 465835 |
| 4757 | B | 467738 |
| 4758 | B | 466558 |
| 4759 | B | 468474 |
| 4760 | B | 467322 |
| 4761 | B | 469217 |
| 4762 | B | 467738 |
| 4763 | B | 469637 |
| 4764 | B | 469912 |
| 4765 | B | 471814 |
| 4766 | B | 470920 |
| 4767 | B | 472826 |
| 4768 | B | 472075 |
| 4769 | B | 473922 |
| 4770 | B | 472231 |
| 4771 | B | 474144 |
| 4772 | B | 472579 |
| 4773 | B | 474501 |
| 4774 | B | 473751 |
| 4775 | B | 475664 |
| 4776 | B | 475116 |
| 4777 | B | 477009 |
| 4778 | B | 477566 |
| 4779 | B | 479490 |
| 4780 | B | 477851 |
| 4781 | B | 479753 |
| 4782 | B | 478728 |
| 4783 | B | 480616 |
| 4784 | B | 479496 |
| 4785 | B | 481418 |
| 4786 | B | 479928 |
| 4787 | B | 481844 |
| 4788 | B | 481674 |
| 4789 | B | 483578 |
| 4790 | B | 482281 |
| 4791 | B | 484243 |
| 4792 | B | 482820 |
| 4793 | B | 484721 |
| 4794 | B | 484449 |
| 4795 | B | 486360 |
| 4796 | B | 485499 |
| 4797 | B | 487293 |
| 4798 | B | 486116 |
| 4799 | B | 487980 |
| 4800 | B | 486811 |
| 4801 | B | 488721 |
| 4802 | B | 487217 |
| 4803 | B | 489101 |
| 4804 | B | 487567 |
| 4805 | B | 489423 |
| 4806 | B | 487984 |
| 4807 | B | 489909 |
| 4808 | B | 489291 |
| 4809 | B | 491191 |
| 4810 | B | 489561 |
| 4811 | B | 491461 |
| 4812 | B | 490221 |
| 4813 | B | 492078 |
| 4814 | B | 490773 |
| 4815 | B | 492672 |
| 4816 | B | 491383 |
| 4817 | B | 493293 |
| 4818 | B | 491616 |
| 4819 | B | 493537 |
| 4820 | B | 492362 |
| 4821 | B | 494246 |
| 4822 | B | 495083 |
| 4823 | B | 497027 |
| 4824 | B | 496168 |
| 4825 | B | 498063 |
| 4826 | B | 496789 |
| 4827 | B | 498688 |
| 4828 | B | 497500 |
| 4829 | B | 499390 |
| 4830 | B | 498057 |
| 4831 | B | 499966 |
| 4832 | B | 498552 |
| 4833 | B | 500508 |
| 4834 | B | 499240 |
| 4835 | B | 501145 |
| 4836 | B | 499812 |
| 4837 | B | 501762 |
| 4838 | B | 500020 |
| 4839 | B | 501915 |
| 4840 | B | 500716 |
| 4841 | B | 502628 |
| 4842 | B | 504395 |
| 4843 | B | 506292 |
| 4844 | B | 504885 |
| 4845 | B | 506772 |
| 4846 | B | 507107 |
| 4847 | B | 509003 |
| 4848 | B | 507933 |
| 4849 | B | 509795 |
| 4850 | B | 510741 |
| 4851 | B | 512656 |
| 4852 | B | 508573 |
| 4853 | B | 510445 |
| 4854 | B | 513663 |
| 4855 | B | 515585 |
| 4856 | B | 515276 |
| 4857 | B | 517040 |
| 4858 | B | 517602 |
| 4859 | B | 519510 |
| 4860 | B | 517602 |
| 4861 | B | 519510 |
| 4862 | B | 518075 |
| 4863 | B | 519947 |
| 4864 | B | 518429 |
| 4865 | B | 520326 |
| 4866 | B | 521416 |
| 4867 | B | 523319 |

TABLE 5-continued

| SEQ ID | or. | 5' position |
|---|---|---|
| 4868 | B | 523196 |
| 4869 | B | 525096 |
| 4870 | B | 525033 |
| 4871 | B | 526939 |
| 4872 | B | 524599 |
| 4873 | B | 526501 |
| 4874 | B | 526494 |
| 4875 | B | 528361 |
| 4876 | B | 527330 |
| 4877 | B | 529238 |
| 4878 | B | 527167 |
| 4879 | B | 529067 |
| 4880 | B | 528673 |
| 4881 | B | 530573 |
| 4882 | B | 529456 |
| 4883 | B | 531376 |
| 4884 | B | 530864 |
| 4885 | B | 532745 |
| 4886 | B | 531906 |
| 4887 | B | 533776 |
| 4888 | B | 534199 |
| 4889 | B | 536103 |
| 4890 | B | 536674 |
| 4891 | B | 538552 |
| 4892 | B | 537422 |
| 4893 | B | 539270 |
| 4894 | B | 538165 |
| 4895 | B | 540048 |
| 4896 | B | 538658 |
| 4897 | B | 540578 |
| 4898 | B | 538970 |
| 4899 | B | 540857 |
| 4900 | B | 539859 |
| 4901 | B | 541736 |
| 4902 | B | 541474 |
| 4903 | B | 543411 |
| 4904 | B | 542791 |
| 4905 | B | 544691 |
| 4906 | B | 543234 |
| 4907 | B | 545134 |
| 4908 | B | 543608 |
| 4909 | B | 545513 |
| 4910 | B | 546851 |
| 4911 | B | 548762 |
| 4912 | B | 549793 |
| 4913 | B | 551652 |
| 4914 | B | 547523 |
| 4915 | B | 549430 |
| 4916 | B | 550754 |
| 4917 | B | 552702 |
| 4918 | B | 551775 |
| 4919 | B | 553674 |
| 4920 | B | 552876 |
| 4921 | B | 554756 |
| 4922 | B | 555340 |
| 4923 | B | 557240 |
| 4924 | B | 555736 |
| 4925 | B | 557619 |
| 4926 | B | 558229 |
| 4927 | B | 560135 |
| 4928 | B | 558821 |
| 4929 | B | 560696 |
| 4930 | B | 559955 |
| 4931 | B | 561816 |
| 4932 | B | 561979 |
| 4933 | B | 563858 |
| 4934 | B | 561979 |
| 4935 | B | 563812 |
| 4936 | B | 564167 |
| 4937 | B | 566081 |
| 4938 | B | 565229 |
| 4939 | B | 567096 |
| 4940 | B | 566419 |
| 4941 | B | 568318 |
| 4942 | B | 567974 |
| 4943 | B | 569872 |
| 4944 | B | 568753 |

TABLE 5-continued

| SEQ ID | or. | 5' position |
|---|---|---|
| 4945 | B | 570655 |
| 4946 | B | 569707 |
| 4947 | B | 571605 |
| 4948 | B | 571285 |
| 4949 | B | 573207 |
| 4950 | B | 572080 |
| 4951 | B | 573948 |
| 4952 | B | 572628 |
| 4953 | B | 574524 |
| 4954 | B | 573563 |
| 4955 | B | 575436 |
| 4956 | B | 572628 |
| 4957 | B | 574524 |
| 4958 | B | 575279 |
| 4959 | B | 577202 |
| 4960 | B | 576190 |
| 4961 | B | 578039 |
| 4262 | B | 578174 |
| 4963 | B | 580011 |
| 4964 | B | 579148 |
| 4965 | B | 581040 |
| 4966 | B | 580227 |
| 4967 | B | 582047 |
| 4968 | B | 580656 |
| 4969 | B | 582542 |
| 4970 | B | 580420 |
| 4971 | B | 582322 |
| 4972 | B | 581322 |
| 4973 | B | 583212 |
| 4974 | B | 582051 |
| 4975 | B | 583973 |
| 4976 | B | 582592 |
| 4977 | B | 584513 |
| 4978 | B | 583651 |
| 4979 | B | 585588 |
| 4980 | B | 584932 |
| 4981 | B | 586813 |
| 4982 | B | 585457 |
| 4983 | B | 587360 |
| 4984 | B | 587145 |
| 4985 | B | 589063 |
| 4986 | B | 588150 |
| 4987 | B | 590044 |
| 4988 | B | 588404 |
| 4989 | B | 590304 |
| 4990 | B | 589320 |
| 4991 | B | 591193 |
| 4992 | B | 590733 |
| 4993 | B | 592677 |
| 4994 | B | 592682 |
| 4995 | B | 594583 |
| 4996 | B | 593126 |
| 4997 | B | 595026 |
| 4998 | B | 594005 |
| 4999 | B | 595882 |
| 5000 | B | 594521 |
| 5001 | B | 596421 |
| 5002 | B | 596170 |
| 5003 | B | 598096 |
| 5004 | B | 596532 |
| 5005 | B | 598451 |
| 5006 | B | 597438 |
| 5007 | B | 599365 |
| 5008 | B | 598191 |
| 5009 | B | 600088 |
| 5010 | B | 598836 |
| 5011 | B | 600749 |
| 5012 | B | 599476 |
| 5013 | B | 601327 |
| 5014 | B | 600192 |
| 5015 | B | 602103 |
| 5016 | B | 601131 |
| 5017 | B | 603030 |
| 5018 | B | 602307 |
| 5019 | B | 604209 |
| 5020 | B | 602810 |
| 5021 | B | 604759 |

TABLE 5-continued

| SEQ ID | or. | 5' position |
|---|---|---|
| 5022 | B | 603529 |
| 5023 | B | 605402 |
| 5024 | B | 604759 |
| 5025 | B | 606662 |
| 5026 | B | 606076 |
| 5027 | B | 608046 |
| 5028 | B | 606843 |
| 5029 | B | 608746 |
| 5030 | B | 607504 |
| 5031 | B | 609404 |
| 5032 | B | 609224 |
| 5033 | B | 611138 |
| 5034 | B | 609952 |
| 5035 | B | 611865 |
| 5036 | B | 611138 |
| 5037 | B | 613033 |
| 5038 | B | 612012 |
| 5039 | B | 613917 |
| 5040 | B | 612554 |
| 5041 | B | 614453 |
| 5042 | B | 614136 |
| 5043 | B | 616017 |
| 5044 | B | 614978 |
| 5045 | B | 616936 |
| 5046 | B | 615399 |
| 5047 | B | 617342 |
| 5048 | B | 616565 |
| 5049 | B | 618402 |
| 5050 | B | 617618 |
| 5051 | B | 619515 |
| 5052 | B | 619027 |
| 5053 | B | 620937 |
| 5054 | B | 620142 |
| 5055 | B | 622052 |
| 5056 | B | 620230 |
| 5057 | B | 622124 |
| 5058 | B | 621498 |
| 5059 | B | 623385 |
| 5060 | B | 622583 |
| 5061 | B | 624479 |
| 5062 | B | 623718 |
| 5063 | B | 625598 |
| 5064 | B | 624533 |
| 5065 | B | 626462 |
| 5066 | B | 625020 |
| 5067 | B | 626893 |
| 5068 | B | 625774 |
| 5069 | B | 627660 |
| 5070 | B | 626146 |
| 5071 | B | 628010 |
| 5072 | B | 626646 |
| 5073 | B | 628522 |
| 5074 | B | 628020 |
| 5075 | B | 629982 |
| 5076 | B | 628882 |
| 5077 | B | 630730 |
| 5078 | B | 629982 |
| 5079 | B | 631822 |
| 5080 | B | 631862 |
| 5081 | B | 633762 |
| 5082 | B | 633774 |
| 5083 | B | 635675 |
| 5084 | B | 637192 |
| 5085 | B | 639082 |
| 5086 | B | 638321 |
| 5087 | B | 640221 |
| 5088 | B | 639082 |
| 5089 | B | 640954 |
| 5090 | B | 639317 |
| 5091 | B | 641243 |
| 5092 | B | 639860 |
| 5093 | B | 641780 |
| 5094 | B | 640868 |
| 5095 | B | 642770 |
| 5096 | B | 641243 |
| 5097 | B | 643106 |
| 5098 | B | 641605 |

TABLE 5-continued

| SEQ ID | or. | 5' position |
|---|---|---|
| 5099 | B | 643503 |
| 5100 | B | 642538 |
| 5101 | B | 644407 |
| 5102 | B | 643243 |
| 5103 | B | 645145 |
| 5104 | B | 643550 |
| 5105 | B | 645450 |
| 5106 | B | 643925 |
| 5107 | B | 645837 |
| 5108 | B | 645848 |
| 5109 | B | 647759 |
| 5110 | B | 645987 |
| 5111 | B | 647969 |
| 5112 | B | 646490 |
| 5113 | B | 648429 |
| 5114 | B | 646973 |
| 5115 | B | 648871 |
| 5116 | B | 648115 |
| 5117 | B | 650007 |
| 5118 | B | 648516 |
| 5119 | B | 650374 |
| 5120 | B | 650567 |
| 5121 | B | 652472 |
| 5122 | B | 651251 |
| 5123 | B | 653140 |
| 5124 | B | 653186 |
| 5125 | B | 655076 |
| 5126 | B | 653628 |
| 5127 | B | 655515 |
| 5128 | B | 656010 |
| 5129 | B | 657870 |
| 5130 | B | 656761 |
| 5131 | B | 658636 |
| 5132 | B | 658389 |
| 5133 | B | 660295 |
| 5134 | B | 660436 |
| 5135 | B | 662352 |
| 5136 | B | 663483 |
| 5137 | B | 665358 |
| 5138 | B | 664701 |
| 5139 | B | 666607 |
| 5140 | B | 665978 |
| 5141 | B | 667856 |
| 5142 | B | 667238 |
| 5143 | B | 669172 |
| 5144 | B | 668195 |
| 5145 | B | 670046 |
| 5146 | B | 668791 |
| 5147 | B | 670691 |
| 5148 | B | 669426 |
| 5149 | B | 671326 |
| 5150 | B | 671116 |
| 5151 | B | 673055 |
| 5152 | B | 671659 |
| 5153 | B | 673547 |
| 5154 | B | 672474 |
| 5155 | B | 674347 |
| 5156 | B | 673238 |
| 5157 | B | 675140 |
| 5158 | B | 674944 |
| 5159 | B | 676911 |
| 5160 | B | 674797 |
| 5161 | B | 676669 |
| 5162 | B | 675741 |
| 5163 | B | 677643 |
| 5164 | B | 676340 |
| 5165 | B | 678204 |
| 5166 | B | 676911 |
| 5167 | B | 678770 |
| 5168 | B | 677240 |
| 5169 | B | 679136 |
| 5170 | B | 677873 |
| 5171 | B | 679767 |
| 5172 | B | 678549 |
| 5173 | B | 680420 |
| 5174 | B | 679692 |
| 5175 | B | 681628 |

TABLE 5-continued

| SEQ ID | or. | 5' position |
|---|---|---|
| 5176 | B | 680320 |
| 5177 | B | 682220 |
| 5178 | B | 681126 |
| 5179 | B | 683046 |
| 5180 | B | 682558 |
| 5181 | B | 684404 |
| 5182 | B | 681857 |
| 5183 | B | 683768 |
| 5184 | B | 683046 |
| 5185 | B | 684944 |
| 5186 | B | 684128 |
| 5187 | B | 686124 |
| 5188 | B | 684893 |
| 5189 | B | 686740 |
| 5190 | B | 685389 |
| 5191 | B | 687290 |
| 5192 | B | 686207 |
| 5193 | B | 688106 |
| 5194 | B | 687534 |
| 5195 | B | 689424 |
| 5196 | B | 688416 |
| 5197 | B | 690275 |
| 5198 | B | 688955 |
| 5199 | B | 690855 |
| 5200 | B | 689727 |
| 5201 | B | 691626 |
| 5202 | B | 690496 |
| 5203 | B | 692386 |
| 5204 | B | 691349 |
| 5205 | B | 693249 |
| 5206 | B | 692864 |
| 5207 | B | 694724 |
| 5208 | B | 695287 |
| 5209 | B | 697187 |
| 5210 | B | 696275 |
| 5211 | B | 698172 |
| 5212 | B | 696786 |
| 5213 | B | 698696 |
| 5214 | B | 698185 |
| 5215 | B | 700090 |
| 5216 | B | 700037 |
| 5217 | B | 701923 |
| 5218 | B | 702172 |
| 5219 | B | 704050 |
| 5220 | B | 703443 |
| 5221 | B | 705316 |
| 5222 | B | 704441 |
| 5223 | B | 706351 |
| 5224 | B | 705516 |
| 5225 | B | 707413 |
| 5226 | B | 706312 |
| 5227 | B | 708190 |
| 5228 | B | 707058 |
| 5229 | B | 708979 |
| 5230 | B | 707856 |
| 5231 | B | 709719 |
| 5232 | B | 708906 |
| 5233 | B | 710811 |
| 5234 | B | 709258 |
| 5235 | B | 711132 |
| 5236 | B | 710074 |
| 5237 | B | 711924 |
| 5238 | B | 710328 |
| 5239 | B | 712212 |
| 5240 | B | 711748 |
| 5241 | B | 713690 |
| 5242 | B | 712456 |
| 5243 | B | 714407 |
| 5244 | B | 715001 |
| 5245 | B | 716854 |
| 5246 | B | 715983 |
| 5247 | B | 717887 |
| 5248 | B | 717800 |
| 5249 | B | 719668 |
| 5250 | B | 718468 |
| 5251 | B | 720383 |
| 5252 | B | 720469 |
| 5253 | B | 722367 |
| 5254 | B | 722645 |
| 5255 | B | 724559 |
| 5256 | B | 723280 |
| 5257 | B | 725273 |
| 5258 | B | 723775 |
| 5259 | B | 725691 |
| 5260 | B | 724469 |
| 5261 | B | 726387 |
| 5262 | B | 725016 |
| 5263 | B | 726902 |
| 5264 | B | 726088 |
| 5265 | B | 727988 |
| 5266 | B | 727397 |
| 5267 | B | 729236 |
| 5268 | B | 728347 |
| 5269 | B | 730278 |
| 5270 | B | 728816 |
| 5271 | B | 730718 |
| 5272 | B | 729846 |
| 5273 | B | 731740 |
| 5274 | B | 730005 |
| 5275 | B | 731898 |
| 5276 | B | 730377 |
| 5277 | B | 732272 |
| 5278 | B | 730759 |
| 5279 | B | 732659 |
| 5280 | B | 732249 |
| 5281 | B | 734124 |
| 5282 | B | 732647 |
| 5283 | B | 734590 |
| 5284 | B | 733144 |
| 5285 | B | 735088 |
| 5286 | B | 733858 |
| 5287 | B | 735787 |
| 5288 | B | 734124 |
| 5289 | B | 736028 |
| 5290 | B | 734523 |
| 5291 | B | 736441 |
| 5292 | B | 735088 |
| 5293 | B | 736978 |
| 5294 | B | 735416 |
| 5295 | B | 737315 |
| 5296 | B | 735822 |
| 5297 | B | 737700 |
| 5298 | B | 736099 |
| 5299 | B | 737981 |
| 5300 | B | 736714 |
| 5301 | B | 738612 |
| 5302 | B | 737448 |
| 5303 | B | 739321 |
| 5304 | B | 737802 |
| 5305 | B | 739693 |
| 5306 | B | 738048 |
| 5307 | B | 739948 |
| 5308 | B | 738964 |
| 5309 | B | 740808 |
| 5310 | B | 739282 |
| 5311 | B | 741190 |
| 5312 | B | 739956 |
| 5313 | B | 741906 |
| 5314 | B | 740743 |
| 5315 | B | 742597 |
| 5316 | B | 741190 |
| 5317 | B | 743081 |
| 5318 | B | 741942 |
| 5319 | B | 743875 |
| 5320 | B | 743009 |
| 5321 | B | 744914 |
| 5322 | B | 743875 |
| 5323 | B | 745738 |
| 5324 | B | 744325 |
| 5325 | B | 746234 |
| 5326 | B | 744824 |
| 5327 | B | 746724 |
| 5328 | B | 745207 |
| 5329 | B | 747073 |

TABLE 5-continued

| SEQ ID | or. | 5' position |
|---|---|---|
| 5330 | B | 746828 |
| 5331 | B | 748738 |
| 5332 | B | 747344 |
| 5333 | B | 749206 |
| 5334 | B | 748253 |
| 5335 | B | 750094 |
| 5336 | B | 748856 |
| 5337 | B | 750717 |
| 5338 | B | 749376 |
| 5339 | B | 751265 |
| 5340 | B | 750180 |
| 5341 | B | 752086 |
| 5342 | B | 750667 |
| 5343 | B | 752569 |
| 5344 | B | 751458 |
| 5345 | B | 753343 |
| 5346 | B | 753262 |
| 5347 | B | 755162 |
| 5348 | B | 754535 |
| 5349 | B | 756429 |
| 5350 | B | 756398 |
| 5351 | B | 758298 |
| 5352 | B | 756708 |
| 5353 | B | 758611 |
| 5354 | B | 760465 |
| 5355 | B | 762358 |
| 5356 | B | 761441 |
| 5357 | B | 763356 |
| 5358 | B | 762077 |
| 5359 | B | 763945 |
| 5360 | B | 762528 |
| 5361 | B | 764410 |
| 5362 | B | 763118 |
| 5363 | B | 765018 |
| 5364 | B | 763539 |
| 5365 | B | 765504 |
| 5366 | B | 764000 |
| 5367 | B | 765907 |
| 5368 | B | 765391 |
| 5369 | B | 767328 |
| 5370 | B | 767041 |
| 5371 | B | 768951 |
| 5372 | B | 768271 |
| 5373 | B | 770171 |
| 5374 | B | 768799 |
| 5375 | B | 770686 |
| 5376 | B | 769562 |
| 5377 | B | 771608 |
| 5378 | B | 770752 |
| 5379 | B | 772652 |
| 5380 | B | 771701 |
| 5381 | B | 773620 |
| 5382 | B | 773316 |
| 5383 | B | 775178 |
| 5384 | B | 773690 |
| 5385 | B | 775579 |
| 5386 | B | 774596 |
| 5387 | B | 776522 |
| 5388 | B | 776300 |
| 5389 | B | 778224 |
| 5390 | B | 775346 |
| 5391 | B | 777266 |
| 5392 | B | 775618 |
| 5393 | B | 777518 |
| 5394 | B | 777266 |
| 5395 | B | 779200 |
| 5396 | B | 778224 |
| 5397 | B | 780087 |
| 5398 | B | 778396 |
| 5399 | B | 780301 |
| 5400 | B | 779557 |
| 5401 | B | 781481 |
| 5402 | B | 780503 |
| 5403 | B | 782380 |
| 5404 | B | 781419 |
| 5405 | B | 783311 |
| 5406 | B | 781747 |
| 5407 | B | 783680 |
| 5408 | B | 783004 |
| 5409 | B | 784912 |
| 5410 | B | 783820 |
| 5411 | B | 785752 |
| 5412 | B | 785255 |
| 5413 | B | 787155 |
| 5414 | B | 786655 |
| 5415 | B | 788572 |
| 5416 | B | 788671 |
| 5417 | B | 790554 |
| 5418 | B | 789164 |
| 5419 | B | 791064 |
| 5420 | B | 790001 |
| 5421 | B | 791900 |
| 5422 | B | 791734 |
| 5423 | B | 793679 |
| 5424 | B | 792944 |
| 5425 | B | 794875 |
| 5426 | B | 793809 |
| 5427 | B | 795692 |
| 5428 | B | 794580 |
| 5429 | B | 796450 |
| 5430 | B | 795066 |
| 5431 | B | 796966 |
| 5432 | B | 795956 |
| 5433 | B | 797855 |
| 5434 | B | 797018 |
| 5435 | B | 798918 |
| 5436 | B | 798989 |
| 5437 | B | 800875 |
| 5438 | B | 800069 |
| 5439 | B | 801944 |
| 5440 | B | 799840 |
| 5441 | B | 801701 |
| 5442 | B | 801533 |
| 5443 | B | 803445 |
| 5444 | B | 802717 |
| 5445 | B | 804581 |
| 5446 | B | 803559 |
| 5447 | B | 805419 |
| 5448 | B | 804032 |
| 5449 | B | 805931 |
| 5450 | B | 805383 |
| 5451 | B | 807291 |
| 5452 | B | 806107 |
| 5453 | B | 807988 |
| 5454 | B | 806533 |
| 5455 | B | 808430 |
| 5456 | B | 806954 |
| 5457 | B | 808724 |
| 5458 | B | 807133 |
| 5459 | B | 809033 |
| 5460 | B | 808442 |
| 5461 | B | 810357 |
| 5462 | B | 808972 |
| 5463 | B | 810896 |
| 5464 | B | 809674 |
| 5465 | B | 811557 |
| 5466 | B | 810192 |
| 5467 | B | 812105 |
| 5468 | B | 811472 |
| 5469 | B | 813357 |
| 5470 | B | 813325 |
| 5471 | B | 815179 |
| 5472 | B | 813133 |
| 5473 | B | 815134 |
| 5474 | B | 813808 |
| 5475 | B | 815737 |
| 5476 | B | 815246 |
| 5477 | B | 817168 |
| 5478 | B | 815995 |
| 5479 | B | 817892 |
| 5480 | B | 817264 |
| 5481 | B | 819164 |
| 5482 | B | 817579 |
| 5483 | B | 819491 |

TABLE 5-continued

| SEQ ID | or. | 5' position |
|---|---|---|
| 5484 | B | 818890 |
| 5485 | B | 820733 |
| 5486 | B | 819332 |
| 5487 | B | 821217 |
| 5488 | B | 820096 |
| 5489 | B | 821951 |
| 5490 | B | 820945 |
| 5491 | B | 822870 |
| 5492 | B | 821151 |
| 5493 | B | 823079 |
| 5494 | B | 822558 |
| 5495 | B | 824449 |
| 5496 | B | 823767 |
| 5497 | B | 825634 |
| 5498 | B | 825876 |
| 5499 | B | 827737 |
| 5500 | B | 826583 |
| 5501 | B | 828435 |
| 5502 | B | 827511 |
| 5503 | B | 829428 |
| 5504 | B | 828829 |
| 5505 | B | 830729 |
| 5506 | B | 830262 |
| 5507 | B | 832158 |
| 5508 | B | 831286 |
| 5509 | B | 833182 |
| 5510 | B | 831946 |
| 5511 | B | 833848 |
| 5512 | B | 833372 |
| 5513 | B | 835267 |
| 5514 | B | 834125 |
| 5515 | B | 835992 |
| 5516 | B | 835267 |
| 5517 | B | 837193 |
| 5518 | B | 836111 |
| 5519 | B | 837952 |
| 5520 | B | 837844 |
| 5521 | B | 839751 |
| 5522 | B | 839381 |
| 5523 | B | 841221 |
| 5524 | B | 841127 |
| 5525 | B | 843073 |
| 5526 | B | 842409 |
| 5527 | B | 844323 |
| 5528 | B | 843691 |
| 5529 | B | 845602 |
| 5530 | B | 844244 |
| 5531 | B | 846153 |
| 5532 | B | 845319 |
| 5533 | B | 847139 |
| 5534 | B | 846411 |
| 5535 | B | 848300 |
| 5536 | B | 848760 |
| 5537 | B | 850653 |
| 5538 | B | 849242 |
| 5539 | B | 851174 |
| 5540 | B | 850753 |
| 5541 | B | 852649 |
| 5542 | B | 851795 |
| 5543 | B | 853690 |
| 5544 | B | 852696 |
| 5545 | B | 854596 |
| 5546 | B | 853938 |
| 5547 | B | 855846 |
| 5548 | B | 855338 |
| 5549 | B | 857240 |
| 5550 | B | 855982 |
| 5551 | B | 857873 |
| 5552 | B | 856786 |
| 5553 | B | 858722 |
| 5554 | B | 858783 |
| 5555 | B | 860735 |
| 5556 | B | 859824 |
| 5557 | B | 861787 |
| 5558 | B | 860442 |
| 5559 | B | 862329 |
| 5560 | B | 861415 |
| 5561 | B | 863252 |
| 5562 | B | 861677 |
| 5563 | B | 863558 |
| 5564 | B | 863171 |
| 5565 | B | 865099 |
| 5566 | B | 865021 |
| 5567 | B | 866922 |
| 5568 | B | 865497 |
| 5569 | B | 867408 |
| 5570 | B | 866808 |
| 5571 | B | 868732 |
| 5572 | B | 867342 |
| 5573 | B | 869242 |
| 5574 | B | 868064 |
| 5575 | B | 869974 |
| 5576 | B | 868732 |
| 5577 | B | 870664 |
| 5578 | B | 869974 |
| 5579 | B | 871880 |
| 5580 | B | 870857 |
| 5581 | B | 872753 |
| 5582 | B | 872149 |
| 5583 | B | 874087 |
| 5584 | B | 872758 |
| 5585 | B | 874658 |
| 5586 | B | 874131 |
| 5587 | B | 876122 |
| 5588 | B | 874903 |
| 5589 | B | 876793 |
| 5590 | B | 875548 |
| 5591 | B | 877437 |
| 5592 | B | 878078 |
| 5593 | B | 880011 |
| 5594 | B | 879478 |
| 5595 | B | 881385 |
| 5596 | B | 880874 |
| 5597 | B | 882771 |
| 5598 | B | 882771 |
| 5599 | B | 884644 |
| 5600 | B | 883542 |
| 5601 | B | 885447 |
| 5602 | B | 883777 |
| 5603 | B | 885689 |
| 5604 | B | 884430 |
| 5605 | B | 886335 |
| 5606 | B | 885834 |
| 5607 | B | 887782 |
| 5608 | B | 887528 |
| 5609 | B | 889442 |
| 5610 | B | 888432 |
| 5611 | B | 890292 |
| 5612 | B | 888879 |
| 5613 | B | 890775 |
| 5614 | B | 889595 |
| 5615 | B | 891481 |
| 5616 | B | 890119 |
| 5617 | B | 892034 |
| 5618 | B | 891428 |
| 5619 | B | 893320 |
| 5620 | B | 892050 |
| 5621 | B | 893950 |
| 5622 | B | 892259 |
| 5623 | B | 894158 |
| 5624 | B | 892701 |
| 5625 | B | 894611 |
| 5626 | B | 893194 |
| 5627 | B | 895056 |
| 5628 | B | 893347 |
| 5629 | B | 895263 |
| 5630 | B | 893787 |
| 5631 | B | 895711 |
| 5632 | B | 895642 |
| 5633 | B | 897542 |
| 5634 | B | 896759 |
| 5635 | B | 898650 |
| 5636 | B | 897802 |
| 5637 | B | 899694 |

TABLE 5-continued

| SEQ ID | or. | 5' position |
|---|---|---|
| 5638 | B | 899665 |
| 5639 | B | 901565 |
| 5640 | B | 900460 |
| 5641 | B | 902360 |
| 5642 | B | 903450 |
| 5643 | B | 905354 |
| 5644 | B | 905307 |
| 5645 | B | 907291 |
| 5646 | B | 907290 |
| 5647 | B | 909083 |
| 5648 | B | 908055 |
| 5649 | B | 909955 |
| 5650 | B | 908358 |
| 5651 | B | 910273 |
| 5652 | B | 908900 |
| 5653 | B | 910831 |
| 5654 | B | 909607 |
| 5655 | B | 911450 |
| 5656 | B | 911760 |
| 5657 | B | 913589 |
| 5658 | B | 912584 |
| 5659 | B | 914529 |
| 5660 | B | 913054 |
| 5661 | B | 914956 |
| 5662 | B | 914208 |
| 5663 | B | 916113 |
| 5664 | B | 915388 |
| 5665 | B | 917272 |
| 5666 | B | 915880 |
| 5667 | B | 917747 |
| 5668 | B | 916886 |
| 5669 | B | 918778 |
| 5670 | B | 917940 |
| 5671 | B | 919827 |
| 5672 | B | 919070 |
| 5673 | B | 920972 |
| 5674 | B | 920107 |
| 5675 | B | 922088 |
| 5676 | B | 920666 |
| 5677 | B | 922554 |
| 5678 | B | 921412 |
| 5679 | B | 923307 |
| 5680 | B | 922216 |
| 5681 | B | 924104 |
| 5682 | B | 922661 |
| 5683 | B | 924538 |
| 5684 | B | 924024 |
| 5685 | B | 925893 |
| 5686 | B | 924192 |
| 5687 | B | 926063 |
| 5688 | B | 925245 |
| 5689 | B | 927137 |
| 5690 | B | 925672 |
| 5691 | B | 927558 |
| 5692 | B | 926744 |
| 5693 | B | 928659 |
| 5694 | B | 928169 |
| 5695 | B | 930064 |
| 5696 | B | 928543 |
| 5697 | B | 930439 |
| 5698 | B | 929238 |
| 5699 | B | 931109 |
| 5700 | B | 931227 |
| 5701 | B | 933127 |
| 5702 | B | 932291 |
| 5703 | B | 934184 |
| 5704 | B | 933738 |
| 5705 | B | 935651 |
| 5706 | B | 933127 |
| 5707 | B | 935001 |
| 5708 | B | 935969 |
| 5709 | B | 937869 |
| 5710 | B | 937305 |
| 5711 | B | 939223 |
| 5712 | B | 937448 |
| 5713 | B | 939423 |
| 5714 | B | 938633 |
| 5715 | B | 940533 |
| 5716 | B | 939032 |
| 5717 | B | 940928 |
| 5718 | B | 939478 |
| 5719 | B | 941392 |
| 5720 | B | 940021 |
| 5721 | B | 941918 |
| 5722 | B | 941017 |
| 5723 | B | 942925 |
| 5724 | B | 941392 |
| 5725 | B | 943238 |
| 5726 | B | 941586 |
| 5727 | B | 943496 |
| 5728 | B | 942787 |
| 5729 | B | 944657 |
| 5730 | B | 943043 |
| 5731 | B | 944971 |
| 5732 | B | 943404 |
| 5733 | B | 945286 |
| 5734 | B | 944025 |
| 5735 | B | 945981 |
| 5736 | B | 944302 |
| 5737 | B | 946175 |
| 5738 | B | 944654 |
| 5739 | B | 946533 |
| 5740 | B | 945633 |
| 5741 | B | 947515 |
| 5742 | B | 946073 |
| 5743 | B | 947974 |
| 5744 | B | 946645 |
| 5745 | B | 948517 |
| 5746 | B | 947646 |
| 5747 | B | 949545 |
| 5748 | B | 948344 |
| 5749 | B | 950219 |
| 5750 | B | 950104 |
| 5751 | B | 952004 |
| 5752 | B | 951301 |
| 5753 | B | 953207 |
| 5754 | B | 951505 |
| 5755 | B | 953387 |
| 5756 | B | 952382 |
| 5757 | B | 954257 |
| 5758 | B | 952927 |
| 5759 | B | 954794 |
| 5760 | B | 953711 |
| 5761 | B | 955611 |
| 5762 | B | 955556 |
| 5763 | B | 957444 |
| 5764 | B | 956049 |
| 5765 | B | 957977 |
| 5766 | B | 957358 |
| 5767 | B | 959202 |
| 5768 | B | 958136 |
| 5769 | B | 960022 |
| 5770 | B | 959490 |
| 5771 | B | 961374 |
| 5772 | B | 960507 |
| 5773 | B | 962439 |
| 5774 | B | 961892 |
| 5775 | B | 963792 |
| 5776 | B | 965000 |
| 5777 | B | 966954 |
| 5778 | B | 967076 |
| 5779 | B | 968975 |
| 5780 | B | 968474 |
| 5781 | B | 970326 |
| 5782 | B | 969039 |
| 5783 | B | 970930 |
| 5784 | B | 969718 |
| 5785 | B | 971619 |
| 5786 | B | 970080 |
| 5787 | B | 971991 |
| 5788 | B | 970371 |
| 5789 | B | 972257 |
| 5790 | B | 970832 |
| 5791 | B | 972738 |

TABLE 5-continued

| SEQ ID | or. | 5' position |
|---|---|---|
| 5792 | B | 971481 |
| 5793 | B | 973403 |
| 5794 | B | 971909 |
| 5795 | B | 973810 |
| 5796 | B | 975372 |
| 5797 | B | 977234 |
| 5798 | B | 975634 |
| 5799 | B | 977548 |
| 5800 | B | 976739 |
| 5801 | B | 978639 |
| 5802 | B | 978543 |
| 5803 | B | 980448 |
| 5804 | B | 977907 |
| 5805 | B | 979832 |
| 5806 | B | 980997 |
| 5807 | B | 982862 |
| 5808 | B | 982167 |
| 5809 | B | 984051 |
| 5810 | B | 983206 |
| 5811 | B | 985082 |
| 5812 | B | 984344 |
| 5813 | B | 986279 |
| 5814 | B | 985741 |
| 5815 | B | 987653 |
| 5816 | B | 986106 |
| 5817 | B | 988045 |
| 5818 | B | 987667 |
| 5819 | B | 989585 |
| 5820 | B | 987418 |
| 5821 | B | 989315 |
| 5822 | B | 987936 |
| 5823 | B | 989842 |
| 5824 | B | 988447 |
| 5825 | B | 990355 |
| 5826 | B | 988979 |
| 5827 | B | 990875 |
| 5828 | B | 990066 |
| 5829 | B | 991966 |
| 5830 | B | 991268 |
| 5831 | B | 993171 |
| 5832 | B | 991858 |
| 5833 | B | 993763 |
| 5834 | B | 992722 |
| 5835 | B | 994621 |
| 5836 | B | 993082 |
| 5837 | B | 994988 |
| 5838 | B | 993290 |
| 5839 | B | 995230 |
| 5840 | B | 995015 |
| 5841 | B | 996927 |
| 5842 | B | 993839 |
| 5843 | B | 995750 |
| 5844 | B | 996203 |
| 5845 | B | 998090 |
| 5846 | B | 997094 |
| 5847 | B | 998977 |
| 5848 | B | 997835 |
| 5849 | B | 999728 |
| 5850 | B | 999224 |
| 5851 | B | 1001101 |
| 5852 | B | 1000267 |
| 5853 | B | 1002146 |
| 5854 | B | 1001594 |
| 5855 | B | 1003567 |
| 5856 | B | 1002100 |
| 5857 | B | 1003941 |
| 5858 | B | 1003571 |
| 5859 | B | 1005412 |
| 5860 | B | 1004381 |
| 5861 | B | 1006269 |
| 5862 | B | 1004753 |
| 5863 | B | 1006691 |
| 5864 | B | 1005890 |
| 5865 | B | 1007762 |
| 5866 | B | 1006199 |
| 5867 | B | 1008109 |
| 5868 | B | 1007050 |
| 5869 | B | 1008929 |
| 5870 | B | 1007819 |
| 5871 | B | 1009683 |
| 5872 | B | 1009446 |
| 5873 | B | 1011365 |
| 5874 | B | 1010314 |
| 5875 | B | 1012109 |
| 5876 | B | 1015234 |
| 5877 | B | 1017133 |
| 5878 | B | 1016571 |
| 5879 | B | 1018486 |
| 5880 | B | 1017755 |
| 5881 | B | 1019661 |
| 5882 | B | 1016781 |
| 5883 | B | 1018708 |
| 5884 | B | 1017022 |
| 5885 | B | 1018924 |
| 5886 | B | 1019233 |
| 5887 | B | 1021143 |
| 5888 | B | 1019674 |
| 5889 | B | 1021630 |
| 5890 | B | 1021020 |
| 5891 | B | 1022923 |
| 5892 | B | 1021630 |
| 5893 | B | 1023525 |
| 5894 | B | 1024510 |
| 5895 | B | 1026410 |
| 5896 | B | 1024936 |
| 5897 | B | 1026858 |
| 5898 | B | 1025836 |
| 5899 | B | 1027677 |
| 5900 | B | 1027197 |
| 5901 | B | 1029089 |
| 5902 | B | 1028022 |
| 5903 | B | 1029936 |
| 5904 | B | 1031445 |
| 5905 | B | 1033319 |
| 5906 | B | 1031943 |
| 5907 | B | 1033839 |
| 5908 | B | 1033277 |
| 5909 | B | 1035186 |
| 5910 | B | 1033697 |
| 5911 | B | 1035554 |
| 5912 | B | 1034009 |
| 5913 | B | 1035943 |
| 5914 | B | 1036282 |
| 5915 | B | 1038161 |
| 5916 | B | 1037178 |
| 5917 | B | 1039088 |
| 5918 | B | 1037902 |
| 5919 | B | 1039802 |
| 5920 | B | 1038167 |
| 5921 | B | 1040079 |
| 5922 | B | 1039198 |
| 5923 | B | 1041036 |
| 5924 | B | 1040803 |
| 5925 | B | 1042721 |
| 5926 | B | 1042560 |
| 5927 | B | 1044460 |
| 5928 | B | 1043630 |
| 5929 | B | 1045526 |
| 5930 | B | 1044850 |
| 5931 | B | 1046748 |
| 5932 | B | 1045609 |
| 5933 | B | 1047551 |
| 5934 | B | 1046761 |
| 5935 | B | 1048677 |
| 5936 | B | 1047741 |
| 5937 | B | 1049700 |
| 5938 | B | 1050218 |
| 5939 | B | 1052151 |
| 5940 | B | 1050831 |
| 5241 | B | 1052744 |
| 5942 | B | 1051223 |
| 5943 | B | 1053071 |
| 5944 | B | 1051974 |
| 5945 | B | 1053854 |

TABLE 5-continued

| SEQ ID | or. | 5' position |
|---|---|---|
| 5946 | B | 1052287 |
| 5947 | B | 1054238 |
| 5948 | B | 1053379 |
| 5949 | B | 1055253 |
| 5950 | B | 1054458 |
| 5951 | B | 1056325 |
| 5952 | B | 1055816 |
| 5953 | B | 1057680 |
| 5954 | B | 1056172 |
| 5955 | B | 1058031 |
| 5956 | B | 1056825 |
| 5957 | B | 1058710 |
| 5958 | B | 1057197 |
| 5959 | B | 1059089 |
| 5960 | B | 1058522 |
| 5961 | B | 1060355 |
| 5962 | B | 1058919 |
| 5963 | B | 1060810 |
| 5964 | B | 1059646 |
| 5965 | B | 1061521 |
| 5966 | B | 1060801 |
| 5967 | B | 1062701 |
| 5968 | B | 1061774 |
| 5969 | B | 1063687 |
| 5970 | B | 1062682 |
| 5971 | B | 1064555 |
| 5972 | B | 1064300 |
| 5973 | B | 1066236 |
| 5974 | B | 1065489 |
| 5975 | B | 1067386 |
| 5976 | B | 1067725 |
| 5977 | B | 1069601 |
| 5978 | B | 1068285 |
| 5979 | B | 1070188 |
| 5980 | B | 1068930 |
| 5981 | B | 1070898 |
| 5982 | B | 1070188 |
| 5983 | B | 1072078 |
| 5984 | B | 1071383 |
| 5985 | B | 1073283 |
| 5986 | B | 1072658 |
| 5987 | B | 1074584 |
| 5988 | B | 1073699 |
| 5989 | B | 1075652 |
| 5990 | B | 1076111 |
| 5991 | B | 1077988 |
| 5992 | B | 1077010 |
| 5993 | B | 1078959 |
| 5994 | B | 1077598 |
| 5995 | B | 1079390 |
| 5996 | B | 1078260 |
| 5997 | B | 1080217 |
| 5998 | B | 1078959 |
| 5999 | B | 1080869 |
| 6000 | B | 1079354 |
| 6001 | B | 1081215 |
| 6002 | B | 1080217 |
| 6003 | B | 1082067 |
| 6004 | B | 1080742 |
| 6005 | B | 1082621 |
| 6006 | B | 1081580 |
| 6007 | B | 1083489 |
| 6008 | B | 1083400 |
| 6009 | B | 1085290 |
| 6010 | B | 1084927 |
| 6011 | B | 1086797 |
| 6012 | B | 1085868 |
| 6013 | B | 1087768 |
| 6014 | B | 1086965 |
| 6015 | B | 1088872 |
| 6016 | B | 1088185 |
| 6017 | B | 1090076 |
| 6018 | B | 1088704 |
| 6019 | B | 1090504 |
| 6020 | B | 1089236 |
| 6021 | B | 1091181 |
| 6022 | B | 1090076 |
| 6023 | B | 1091944 |
| 6024 | B | 1093259 |
| 6025 | B | 1095056 |
| 6026 | B | 1093403 |
| 6027 | B | 1095301 |
| 6028 | B | 1094437 |
| 6029 | B | 1096375 |
| 6030 | B | 1095839 |
| 6031 | B | 1097798 |
| 6032 | B | 1096858 |
| 6033 | B | 1098751 |
| 6034 | B | 1097305 |
| 6035 | B | 1099205 |
| 6036 | B | 1097835 |
| 6037 | B | 1099724 |
| 6038 | B | 1098097 |
| 6039 | B | 1100046 |
| 6040 | B | 1098615 |
| 6041 | B | 1100561 |
| 6042 | B | 1099098 |
| 6043 | B | 1100975 |
| 6044 | B | 1099614 |
| 6045 | B | 1101442 |
| 6046 | B | 1099747 |
| 6047 | B | 1101651 |
| 6048 | B | 1101298 |
| 6049 | B | 1103227 |
| 6050 | B | 1102435 |
| 6051 | B | 1104381 |
| 6052 | B | 1105179 |
| 6053 | B | 1107090 |
| 6054 | B | 1106770 |
| 6055 | B | 1108631 |
| 6056 | B | 1107502 |
| 6057 | B | 1109392 |
| 6058 | B | 1108337 |
| 6059 | B | 1110240 |
| 6060 | B | 1108653 |
| 6061 | B | 1110570 |
| 6062 | B | 1113632 |
| 6063 | B | 1115499 |
| 6064 | B | 1115225 |
| 6065 | B | 1117081 |
| 6066 | B | 1117154 |
| 6067 | B | 1119051 |
| 6068 | B | 1118403 |
| 6069 | B | 1120310 |
| 6070 | B | 1120257 |
| 6071 | B | 1122178 |
| 6072 | B | 1120776 |
| 6073 | B | 1122682 |
| 6074 | B | 1121660 |
| 6075 | B | 1123554 |
| 6076 | B | 1122120 |
| 6077 | B | 1123999 |
| 6078 | B | 1123243 |
| 6079 | B | 1125024 |
| 6080 | B | 1123752 |
| 6081 | B | 1125688 |
| 6082 | B | 1124484 |
| 6083 | B | 1126360 |
| 6084 | B | 1125020 |
| 6085 | B | 1126928 |
| 6086 | B | 1125790 |
| 6087 | B | 1127735 |
| 6088 | B | 1126747 |
| 6089 | B | 1128662 |
| 6090 | B | 1127899 |
| 6091 | B | 1129808 |
| 6092 | B | 1128819 |
| 6093 | B | 1130695 |
| 6094 | B | 1129798 |
| 6095 | B | 1131693 |
| 6096 | B | 1131563 |
| 6097 | B | 1133490 |
| 6098 | B | 1132846 |
| 6099 | B | 1134684 |

TABLE 5-continued

| SEQ ID | or. | 5' position |
|---|---|---|
| 6100 | B | 1134070 |
| 6101 | B | 1136016 |
| 6102 | B | 1135089 |
| 6103 | B | 1137037 |
| 6104 | B | 1135815 |
| 6105 | B | 1137715 |
| 6106 | B | 1136186 |
| 6107 | B | 1138084 |
| 6108 | B | 1137365 |
| 6109 | B | 1139255 |
| 6110 | B | 1140364 |
| 6111 | B | 1142228 |
| 6112 | B | 1141611 |
| 6113 | B | 1143485 |
| 6114 | B | 1142478 |
| 6115 | B | 1144291 |
| 6116 | B | 1145907 |
| 6117 | B | 1147783 |
| 6118 | B | 1146953 |
| 6119 | B | 1148846 |
| 6120 | B | 1147769 |
| 6121 | B | 1149703 |
| 6122 | B | 1148415 |
| 6123 | B | 1150357 |
| 6124 | B | 1148758 |
| 6125 | B | 1150658 |
| 6126 | B | 1149462 |
| 6127 | B | 1151258 |
| 6128 | B | 1149932 |
| 6129 | B | 1151845 |
| 6130 | B | 1150814 |
| 6131 | B | 1152747 |
| 6132 | B | 1151409 |
| 6133 | B | 1153285 |
| 6134 | B | 1152540 |
| 6135 | B | 1154341 |
| 6136 | B | 1154863 |
| 6137 | B | 1156751 |
| 6138 | B | 1155886 |
| 6139 | B | 1157813 |
| 6140 | B | 1156963 |
| 6141 | B | 1158871 |
| 6142 | B | 1158093 |
| 6143 | B | 1159947 |
| 6144 | B | 1160998 |
| 6145 | B | 1162864 |
| 6146 | B | 1162864 |
| 6147 | B | 1164740 |
| 6148 | B | 1163244 |
| 6149 | B | 1165090 |
| 6150 | B | 1164244 |
| 6151 | B | 1166175 |
| 6152 | B | 1164517 |
| 6153 | B | 1166482 |
| 6154 | B | 1165167 |
| 6155 | B | 1167100 |
| 6156 | B | 1165789 |
| 6157 | B | 1167710 |
| 6158 | B | 1166376 |
| 6159 | B | 1168228 |
| 6160 | B | 1166872 |
| 6161 | B | 1168764 |
| 6162 | B | 1168598 |
| 6163 | B | 1170498 |
| 6164 | B | 1169447 |
| 6165 | B | 1171347 |
| 6166 | B | 1170043 |
| 6167 | B | 1171947 |
| 6168 | B | 1170689 |
| 6169 | B | 1172616 |
| 6170 | B | 1171556 |
| 6171 | B | 1173507 |
| 6172 | B | 1172305 |
| 6173 | B | 1174210 |
| 6174 | B | 1172562 |
| 6175 | B | 1174508 |
| 6176 | B | 1174018 |
| 6177 | B | 1175899 |
| 6178 | B | 1175429 |
| 6179 | B | 1177348 |
| 6180 | B | 1175793 |
| 6181 | B | 1177675 |
| 6182 | B | 1177347 |
| 6183 | B | 1179199 |
| 6184 | B | 1179316 |
| 6185 | B | 1181171 |
| 6186 | B | 1180309 |
| 6187 | B | 1182212 |
| 6188 | B | 1181048 |
| 6189 | B | 1182918 |
| 6190 | B | 1182162 |
| 6191 | B | 1184078 |
| 6192 | B | 1182528 |
| 6193 | B | 1184437 |
| 6194 | B | 1184078 |
| 6195 | B | 1186015 |
| 6196 | B | 1184698 |
| 6197 | B | 1186540 |
| 6198 | B | 1185631 |
| 6199 | B | 1187530 |
| 6200 | B | 1186079 |
| 6201 | B | 1188004 |
| 6202 | B | 1186704 |
| 6203 | B | 1188610 |
| 6204 | B | 1189251 |
| 6205 | B | 1191165 |
| 6206 | B | 1187609 |
| 6207 | B | 1189506 |
| 6208 | B | 1191165 |
| 6209 | B | 1193050 |
| 6210 | B | 1192378 |
| 6211 | B | 1194291 |
| 6212 | B | 1192265 |
| 6213 | B | 1194114 |
| 6214 | B | 1193058 |
| 6215 | B | 1194987 |
| 6216 | B | 1193224 |
| 6217 | B | 1195115 |
| 6218 | B | 1194035 |
| 6219 | B | 1195955 |
| 6220 | B | 1194384 |
| 6221 | B | 1196265 |
| 6222 | B | 1194291 |
| 6223 | B | 1196205 |
| 6224 | B | 1195955 |
| 6225 | B | 1197863 |
| 6226 | B | 1196570 |
| 6227 | B | 1198423 |
| 6228 | B | 1197051 |
| 6229 | B | 1198951 |
| 6230 | B | 1198058 |
| 6231 | B | 1199931 |
| 6232 | B | 1198960 |
| 6233 | B | 1200867 |
| 6234 | B | 1200490 |
| 6235 | B | 1202395 |
| 6236 | B | 1204512 |
| 6237 | B | 1203426 |
| 6238 | B | 1202606 |
| 6239 | B | 1204532 |
| 6240 | B | 1203139 |
| 6241 | B | 1205063 |
| 6242 | B | 1203691 |
| 6243 | B | 1205597 |
| 6244 | B | 1204382 |
| 6245 | B | 1206284 |
| 6246 | B | 1205249 |
| 6247 | B | 1207170 |
| 6248 | B | 1206651 |
| 6249 | B | 1208536 |
| 6250 | B | 1206976 |
| 6251 | B | 1208862 |
| 6252 | B | 1208092 |
| 6253 | B | 1210002 |

TABLE 5-continued

| SEQ ID | or. | 5' position |
|---|---|---|
| 6254 | B | 1209115 |
| 6255 | B | 1210973 |
| 6256 | B | 1209979 |
| 6257 | B | 1211892 |
| 6258 | B | 1210739 |
| 6259 | B | 1212639 |
| 6260 | B | 1211761 |
| 6261 | B | 1213680 |
| 6262 | B | 1212985 |
| 6263 | B | 1214894 |
| 6264 | B | 1214299 |
| 6265 | B | 1216189 |
| 6266 | B | 1215132 |
| 6267 | B | 1217036 |
| 6268 | B | 1215714 |
| 6269 | B | 1217542 |
| 6270 | B | 1216541 |
| 6271 | B | 1218462 |
| 6272 | B | 1216828 |
| 6273 | B | 1218677 |
| 6274 | B | 1217166 |
| 6275 | B | 1218973 |
| 6276 | B | 1219876 |
| 6277 | B | 1221743 |
| 6278 | B | 1220892 |
| 6279 | B | 1222895 |
| 6280 | B | 1220288 |
| 6281 | B | 1222189 |
| 6282 | B | 1221657 |
| 6283 | B | 1223517 |
| 6284 | B | 1223930 |
| 6285 | B | 1225828 |
| 6286 | B | 1225211 |
| 6287 | B | 1227132 |
| 6288 | B | 1226090 |
| 6289 | B | 1227979 |
| 6290 | B | 1227132 |
| 6291 | B | 1229039 |
| 6292 | B | 1228061 |
| 6293 | B | 1229948 |
| 6294 | B | 1228293 |
| 6295 | B | 267 |
| 6296 | B | 1228524 |
| 6297 | B | 444 |
| 6298 | B | 267 |
| 6299 | B | 2068 |
| 6300 | F | 25997 |
| 6301 | F | 24032 |
| 6302 | F | 27128 |
| 6303 | F | 25189 |
| 6304 | F | 66744 |
| 6305 | F | 64845 |
| 6306 | F | 70130 |
| 6307 | F | 68200 |
| 6308 | F | 132477 |
| 6309 | F | 130559 |
| 6310 | F | 177854 |
| 6311 | F | 175906 |
| 6312 | F | 208127 |
| 6313 | F | 206180 |
| 6314 | F | 208688 |
| 6315 | F | 206807 |
| 6316 | F | 208732 |
| 6317 | F | 206877 |
| 6318 | F | 210051 |
| 6319 | F | 208141 |
| 6320 | F | 298801 |
| 6321 | F | 296907 |
| 6322 | F | 351495 |
| 6323 | F | 349572 |
| 6324 | F | 419727 |
| 6325 | F | 417822 |
| 6326 | F | 553133 |
| 6327 | F | 551247 |
| 6328 | F | 556301 |
| 6329 | F | 554410 |
| 6330 | F | 593567 |
| 6331 | F | 591675 |
| 6332 | F | 594641 |
| 6333 | F | 592748 |
| 6334 | F | 661934 |
| 6335 | F | 660041 |
| 6336 | F | 706309 |
| 6337 | F | 704409 |
| 6338 | F | 803092 |
| 6339 | F | 801192 |
| 6340 | F | 849060 |
| 6341 | F | 847142 |
| 6342 | F | 913050 |
| 6343 | F | 911152 |
| 6344 | F | 926614 |
| 6345 | F | 924714 |
| 6346 | F | 930121 |
| 6347 | F | 928238 |
| 6348 | F | 986297 |
| 6349 | F | 984362 |
| 6350 | F | 996001 |
| 6351 | F | 994109 |
| 6352 | F | 999731 |
| 6353 | F | 997877 |
| 6354 | F | 1009782 |
| 6355 | F | 1007891 |
| 6356 | F | 1010540 |
| 6357 | F | 1008671 |
| 6358 | F | 1012465 |
| 6359 | F | 1010540 |
| 6360 | F | 1028431 |
| 6361 | F | 1026524 |
| 6362 | F | 1086215 |
| 6363 | F | 1084362 |
| 6364 | F | 1118417 |
| 6365 | F | 1116527 |
| 6366 | F | 1169595 |
| 6367 | F | 1167713 |
| 6368 | F | 1180592 |
| 6369 | F | 1178709 |
| 6370 | F | 1182406 |
| 6371 | F | 1180498 |
| 6372 | F | 1194573 |
| 6373 | F | 1192667 |
| 6374 | F | 1195654 |
| 6375 | F | 1193753 |
| 6376 | B | 26870 |
| 6377 | B | 28721 |
| 6378 | B | 27835 |
| 6379 | B | 29730 |
| 6380 | B | 67456 |
| 6381 | B | 69351 |
| 6382 | B | 70820 |
| 6383 | B | 72708 |
| 6384 | B | 133173 |
| 6385 | B | 135068 |
| 6386 | B | 178637 |
| 6387 | B | 180518 |
| 6388 | B | 208864 |
| 6389 | B | 210727 |
| 6390 | B | 209376 |
| 6391 | B | 211305 |
| 6392 | B | 209483 |
| 6393 | B | 211383 |
| 6394 | B | 210875 |
| 6395 | B | 212766 |
| 6396 | B | 299694 |
| 6397 | B | 301582 |
| 6398 | B | 352312 |
| 6399 | B | 354200 |
| 6400 | B | 420390 |
| 6401 | B | 422291 |
| 6402 | B | 553822 |
| 6403 | B | 555736 |
| 6404 | B | 557050 |
| 6405 | B | 558930 |
| 6406 | B | 594583 |
| 6407 | B | 596527 |

TABLE 5-continued

| SEQ ID | or. | 5' position |
|---|---|---|
| 6408 | B | 595405 |
| 6409 | B | 597289 |
| 6410 | B | 662614 |
| 6411 | B | 664530 |
| 6412 | B | 707138 |
| 6413 | B | 709063 |
| 6414 | B | 803951 |
| 6415 | B | 805790 |
| 6416 | B | 849771 |
| 6417 | B | 851730 |
| 6418 | B | 913917 |
| 6419 | B | 915796 |
| 6420 | B | 927331 |
| 6421 | B | 929238 |
| 6422 | B | 930857 |
| 6423 | B | 932735 |
| 6424 | B | 986987 |
| 6425 | B | 988912 |
| 6426 | B | 996771 |
| 6427 | B | 998623 |
| 6428 | B | 1000593 |
| 6429 | B | 1002496 |
| 6430 | B | 1010541 |
| 6431 | B | 1012452 |
| 6432 | B | 1011365 |
| 6433 | B | 1013249 |
| 6434 | B | 1013146 |
| 6435 | B | 1015044 |
| 6436 | B | 1029168 |
| 6437 | B | 1031036 |
| 6438 | B | 1087041 |
| 6439 | B | 1088885 |
| 6440 | B | 1119102 |
| 6441 | B | 1121033 |
| 6442 | B | 1170355 |
| 6443 | B | 1172218 |
| 6444 | B | 1181427 |
| 6445 | B | 1183338 |
| 6446 | B | 1183263 |
| 6447 | B | 1185158 |
| 6448 | B | 1195296 |
| 6449 | B | 1197175 |
| 6450 | B | 1196406 |
| 6451 | B | 1198306 |

TABLE 6

| clone Name | SEQ ID NO (B) | SEQ ID NO (F) | Chromosomal region |
|---|---|---|---|
| 790313H3# | 6452 | 6648 | A |
| 790331B1# | 6453 | 6649 | A |
| 790233A9# | 6454 | 6650 | A |
| 790031G7# | 6455 | 6651 | A |
| 890021E4# | 6456 | 6652 | A |
| 790021E11# | 6457 | 6653 | A |
| 790332G10# | 6458 | 6654 | A |
| 790271B6# | 6459 | 6655 | A |
| 790253H6# | 6460 | 6656 | A |
| 790214E8# | 6461 | 6657 | A |
| 790352D2# | 6462 | 6658 | A |
| 790373F2# | 6463 | 6659 | A |
| 790424A7# | 6464 | 6660 | A |
| 790282F3# | 6465 | 6661 | A |
| 790272F5# | 6466 | 6662 | A |
| 790424F6# | 6467 | 6663 | A |
| 890033H11# | 6468 | 6664 | A |
| 790264H10# | 6469 | 6665 | A |
| 790293A5# | 6470 | 6666 | A |
| 790391E8# | 6471 | 6667 | A |
| 890022B8# | 6472 | 6668 | A |
| 790332B9# | 6473 | 6669 | A |
| 790251B9# | 6474 | 6670 | A |
| 790344E8# | 6475 | 6671 | B |
| 790323F3# | 6476 | 6672 | B |
| 790231G2# | 6477 | 6673 | B |
| 790341C5# | 6478 | 6674 | B |
| 790332H9# | 6479 | 6675 | B |
| 890013A8# | 6480 | 6676 | B |
| 790394F2# | 6481 | 6677 | B |
| 790222G5# | 6482 | 6678 | B |
| 790402A10# | 6483 | 6679 | B |
| 790283F6# | 6484 | 6680 | B |
| 790041H11# | 6485 | 6681 | B |
| 790381C7# | 6486 | 6682 | B |
| 790213E1# | 6487 | 6683 | B |
| 790211C4# | 6488 | 6684 | B |
| 790251B5# | 6489 | 6685 | B |
| 790043H9# | 6490 | 6686 | B |
| 790303F7# | 6491 | 6687 | B |
| 790251G5# | 6492 | 6688 | B |
| 790044H7# | 6493 | 6689 | B |
| 790022E4# | 6494 | 6690 | B |
| 790252A8# | 6495 | 6691 | B |
| 790313E9# | 6496 | 6692 | B |
| 790264G2# | 6497 | 6693 | B |
| 790372A4# | 6498 | 6694 | B |
| 790411C2# | 6499 | 6695 | B |
| 790322B7# | 6500 | 6696 | B |
| 790254F7# | 6501 | 6697 | B |
| 790323B12# | 6502 | 6698 | B |
| 790263E5# | 6503 | 6699 | B |
| 790223C8# | 6504 | 6700 | B |
| 790231H2# | 6505 | 6701 | B |
| 790324E12# | 6506 | 6702 | B |
| 790271D7# | 6507 | 6703 | B |
| 790222E8# | 6508 | 6704 | B |
| 790083G7# | 6509 | 6705 | B |
| 790241D3# | 6510 | 6706 | B |
| 790303C8# | 6511 | 6707 | B |
| 790283F10# | 6512 | 6708 | B |
| 790241B7# | 6513 | 6709 | B |
| 790373F10# | 6514 | 6710 | B |
| 790362F9# | 6515 | 6711 | B |
| 790263H8# | 6516 | 6712 | B |
| 790393D10# | 6517 | 6713 | B |
| 790313D12# | 6518 | 6714 | B |
| 890024C6# | 6519 | 6715 | B |
| 890024B10# | 6520 | 6716 | B |
| 790212E2# | 6521 | 6717 | B |
| 790362E10# | 6522 | 6718 | B |
| 790344G11# | 6523 | 6719 | B |
| 890011D2# | 6524 | 6720 | B |
| 790341B11# | 6525 | 6721 | B |
| 790064E10# | 6526 | 6722 | B |
| 790212E1# | 6527 | 6723 | B |
| 790213G5# | 6528 | 6724 | B |
| 790331F2# | 6529 | 6725 | B |
| 890024B9# | 6530 | 6726 | B |
| 790421F5# | 6531 | 6727 | B |
| 890014D11# | 6532 | 6728 | B |
| 790373F3# | 6533 | 6729 | B |
| 790293D4# | 6554 | 6730 | B |
| 790211A3# | 6535 | 6731 | B |
| 790211H8# | 6556 | 6732 | B |
| 790264E7# | 6557 | 6733 | B |
| 790292B11# | 6538 | 6734 | B |
| 790312A2# | 6539 | 6735 | B |
| 890012D5# | 6540 | 6736 | B |
| 790012D12# | 6541 | 6737 | B |
| 790291E10# | 6542 | 6738 | B |
| 790241C9# | 6543 | 6739 | B |
| 790343F1# | 6544 | 6740 | B |
| 790241D7# | 6545 | 6741 | B |
| 790031H7# | 6546 | 6742 | B |
| 790081C4# | 6547 | 6743 | B |
| 790013B7# | 6548 | 6744 | B |
| 790213F3# | 6549 | 6745 | B |
| 790292F9# | 6550 | 6746 | B |
| 790423F4# | 6551 | 6747 | B |

TABLE 6-continued

| clone Name | SEQ ID NO (B) | SEQ ID NO (F) | Chromosomal region |
|---|---|---|---|
| 790331F3# | 6552 | 6748 | B |
| 790222B10# | 6553 | 6749 | B |
| 790261G12# | 6554 | 6750 | B |
| 790423G10# | 6555 | 6751 | B |
| 790392A9# | 6556 | 6752 | B |
| 790331B5# | 6557 | 6753 | B |
| 70323H3# | 6558 | 6754 | B |
| 890014H8# | 6559 | 6755 | B |
| 790231B6# | 6560 | 6756 | B |
| 790252F7# | 6561 | 6757 | B |
| 790392C10# | 6562 | 6758 | B |
| 790021D4# | 6563 | 6759 | B |
| 790052D10# | 6564 | 6760 | B |
| 790261E3# | 6565 | 6761 | B |
| 890023E10# | 6566 | 6762 | B |
| 790244B7# | 6567 | 6763 | B |
| 790383E1# | 6568 | 6764 | B |
| 790401B11# | 6569 | 6765 | B |
| 790411B5# | 6570 | 6766 | B |
| 790423A11# | 6571 | 6767 | B |
| 790031A4# | 6572 | 6768 | B |
| 790241G3# | 6573 | 6769 | B |
| 790044F7# | 6574 | 6770 | B |
| 790252B10# | 6575 | 6771 | B |
| 790293F9# | 6576 | 6772 | B |
| 790282H3# | 6577 | 6773 | B |
| 790381C10# | 6578 | 6774 | B |
| 790024H5# | 6579 | 6775 | B |
| 790354H7# | 6580 | 6776 | B |
| 790411F9# | 6581 | 6777 | B |
| 790324G10# | 6582 | 6778 | B |
| 790014A5# | 6583 | 6779 | B |
| 790381F3# | 6584 | 6780 | B |
| 790424D3# | 6585 | 6781 | B |
| 790394A10# | 6586 | 6782 | B |
| 790423C10# | 6587 | 6783 | B |
| 790214D6# | 6588 | 6784 | B |
| 790214C4# | 6589 | 6785 | B |
| 790014F11# | 6590 | 6786 | B |
| 790352F10# | 6591 | 6787 | B |
| 790381H6# | 6592 | 6788 | B |
| 790282G5# | 6593 | 6789 | B |
| 790263C8# | 6594 | 6790 | B |
| 890022B4# | 6595 | 6791 | B |
| 790283C6# | 6596 | 6792 | B |
| 790293B2# | 6597 | 6793 | B |
| 790073A3# | 6598 | 6794 | B |
| 790313E10# | 6599 | 6795 | B |
| 790361D3# | 6600 | 6796 | B |
| 790014A11# | 6601 | 6797 | B |
| 790254G2# | 6602 | 6798 | B |
| 790381C6# | 6603 | 6799 | B |
| 790424E3# | 6604 | 6800 | B |
| 790421G8# | 6605 | 6801 | B |
| 790013C3# | 6606 | 6802 | B |
| 790263E8# | 6607 | 6803 | B |
| 790373C1# | 6608 | 6804 | B |
| 790041C1# | 6609 | 6805 | B |
| 790344A7# | 6610 | 6806 | B |
| 790271D6# | 6611 | 6807 | B |
| 790342H2# | 6612 | 6808 | B |
| 890021A6# | 6613 | 6809 | B |
| 790381E7# | 6614 | 6810 | C |
| 790013G10# | 6615 | 6811 | C |
| 790254A4# | 6616 | 6812 | C |
| 790213D8# | 6617 | 6813 | C |
| 790052A4# | 6618 | 6814 | C |
| 790213D3# | 6619 | 6815 | C |
| 790394D2# | 6620 | 6816 | C |
| 790214D2# | 6621 | 6817 | C |
| 790014A4# | 6622 | 6818 | C |
| 790324H4# | 6623 | 6819 | C |
| 790082B4# | 6624 | 6820 | C |
| 790324A6# | 6625 | 6821 | C |
| 790424A12# | 6626 | 6822 | C |
| 790044G8# | 6627 | 6823 | C |
| 790323C6# | 6628 | 6824 | C |
| 790312G4# | 6629 | 6825 | C |
| 790053C11# | 6630 | 6826 | C |
| 890022B7# | 6631 | 6827 | C |
| 790392A2# | 6632 | 6828 | C |
| 890023D8# | 6633 | 6829 | C |
| 790301F1# | 6634 | 6830 | C |
| 790343A11# | 6635 | 6831 | C |
| 790421A2# | 6636 | 6832 | C |
| 790271G2# | 6637 | 6833 | C |
| 790302G12# | 6638 | 6834 | C |
| 790341E5# | 6639 | 6835 | C |
| 790283B6# | 6640 | 6836 | C |
| 790222A4# | 6641 | 6837 | C |
| 790241B8# | 6642 | 6838 | C |
| 790014C2# | 6643 | 6839 | C |
| 790402C1# | 6644 | 6840 | C |
| 790264E9# | 6645 | 6841 | C |
| 790242G4# | 6646 | 6842 | C |
| 790422F3# | 6647 | 6843 | C |

TABLE 7

| SEQ ID | or. | 5' position |
|---|---|---|
| 6452 | B | 29372 |
| 6453 | B | 30198 |
| 6454 | B | 31007 |
| 6455 | B | 31126 |
| 6456 | B | 32735 |
| 6457 | B | 32264 |
| 6458 | B | 32898 |
| 6459 | B | 33582 |
| 6460 | B | 33519 |
| 6461 | B | 34836 |
| 6462 | B | 35795 |
| 6463 | B | 35548 |
| 6464 | B | 35825 |
| 6465 | B | 37239 |
| 6466 | B | 36761 |
| 6467 | B | 37045 |
| 6468 | B | 36761 |
| 6469 | B | 37958 |
| 6470 | B | 38636 |
| 6471 | B | 39813 |
| 6472 | B | 41140 |
| 6473 | B | 40575 |
| 6474 | B | 40526 |
| 6475 | B | 501495 |
| 6476 | B | 502410 |
| 6477 | B | 502586 |
| 6478 | B | 503233 |
| 6479 | B | 503749 |
| 6480 | B | 504488 |
| 6481 | B | 504206 |
| 6482 | B | 504310 |
| 6483 | B | 505455 |
| 6484 | B | 505877 |
| 6485 | B | 506655 |
| 6486 | B | 506513 |
| 6487 | B | 507532 |
| 6488 | B | 507742 |
| 6489 | B | 508050 |
| 6490 | B | 507771 |
| 6491 | B | 509120 |
| 6492 | B | 509646 |
| 6493 | B | 510137 |
| 6494 | B | 510953 |
| 6495 | B | 511165 |
| 6496 | B | 511526 |
| 6497 | B | 511993 |
| 6498 | B | 513012 |
| 6499 | B | 512983 |

TABLE 7-continued

| SEQ ID | or. | 5' position |
|---|---|---|
| 6500 | B | 512781 |
| 6501 | B | 514155 |
| 6502 | B | 515036 |
| 6503 | B | 515287 |
| 6504 | B | 516292 |
| 6505 | B | 516234 |
| 6506 | B | 516337 |
| 6507 | B | 517347 |
| 6508 | B | 517005 |
| 6509 | B | 516888 |
| 6510 | B | 516234 |
| 6511 | B | 517560 |
| 6512 | B | 517337 |
| 6513 | B | 516756 |
| 6514 | B | 518943 |
| 6515 | B | 519833 |
| 6516 | B | 520123 |
| 6517 | B | 520574 |
| 6518 | B | 520888 |
| 6519 | B | 522154 |
| 6520 | B | 523041 |
| 6521 | B | 522052 |
| 6522 | B | 522217 |
| 6523 | B | 523035 |
| 6524 | B | 524995 |
| 6525 | B | 523567 |
| 6526 | B | 523477 |
| 6527 | B | 523967 |
| 6528 | B | 525211 |
| 6529 | B | 525215 |
| 6530 | B | 526133 |
| 6531 | B | 525674 |
| 6532 | B | 526561 |
| 6533 | B | 526697 |
| 6534 | B | 526715 |
| 6535 | B | 526844 |
| 6536 | B | 527261 |
| 6537 | B | 527503 |
| 6538 | B | 528775 |
| 6539 | B | 528249 |
| 6540 | B | 530307 |
| 6541 | B | 527772 |
| 6542 | B | 529406 |
| 6543 | B | 527752 |
| 6544 | B | 529829 |
| 6545 | B | 529907 |
| 6546 | B | S29574 |
| 6547 | B | 529635 |
| 6548 | B | 530391 |
| 6549 | B | 531516 |
| 6550 | B | 532154 |
| 6551 | B | 532606 |
| 6552 | B | 533407 |
| 6553 | B | 533664 |
| 6554 | B | 533916 |
| 6555 | B | 534707 |
| 6556 | B | 533482 |
| 6557 | B | 534614 |
| 6558 | B | 534935 |
| 6559 | B | 536823 |
| 6560 | B | 535986 |
| 6561 | B | 536143 |
| 6562 | B | 537505 |
| 6563 | B | 537618 |
| 6564 | B | 538165 |
| 6565 | B | 538702 |
| 6566 | B | 540278 |
| 6567 | B | 539156 |
| 6568 | B | 539619 |
| 6569 | B | 540115 |
| 6570 | B | 540724 |
| 6571 | B | 541484 |
| 6572 | B | 540968 |
| 6573 | B | 542062 |
| 6574 | B | 541898 |
| 6575 | B | 543100 |
| 6576 | B | 543846 |
| 6577 | B | 543820 |
| 6578 | B | 544382 |
| 6579 | B | 545158 |
| 6580 | B | 545678 |
| 6581 | B | 545905 |
| 6582 | B | 546683 |
| 6583 | B | 547718 |
| 6584 | B | 547184 |
| 6585 | B | 547684 |
| 6586 | B | 547342 |
| 6587 | B | 548946 |
| 6588 | B | 549071 |
| 6589 | B | 550054 |
| 6590 | B | 549989 |
| 6591 | B | 550426 |
| 6592 | B | 550055 |
| 6593 | B | 550132 |
| 6594 | B | 550132 |
| 6595 | B | 551400 |
| 6596 | B | 551572 |
| 6597 | B | 551468 |
| 6598 | B | 550849 |
| 6599 | B | 552137 |
| 6600 | B | 552325 |
| 6601 | B | 552583 |
| 6602 | B | 553033 |
| 6603 | B | 553629 |
| 6604 | B | 553960 |
| 6605 | B | 553914 |
| 6606 | B | 554354 |
| 6607 | B | 555783 |
| 6608 | B | 555687 |
| 6609 | B | 556441 |
| 6610 | B | 557054 |
| 6611 | B | 556627 |
| 6612 | B | 557292 |
| 6613 | B | 557050 |
| 6614 | B | 815995 |
| 6615 | B | 817104 |
| 6616 | B | 817104 |
| 6617 | B | 816920 |
| 6618 | B | 820464 |
| 6619 | B | 821017 |
| 6620 | B | 821379 |
| 6621 | B | 821504 |
| 6622 | B | 822723 |
| 6623 | B | 823298 |
| 6624 | B | 823380 |
| 6625 | B | 824414 |
| 6626 | B | 824204 |
| 6627 | B | 825288 |
| 6628 | B | 825346 |
| 6629 | B | 825403 |
| 6630 | B | 826237 |
| 6631 | B | 824995 |
| 6632 | B | 826838 |
| 6633 | B | 828146 |
| 6634 | B | 827878 |
| 6635 | B | 827571 |
| 6636 | B | 828472 |
| 6637 | B | 828484 |
| 6638 | B | 828691 |
| 6639 | B | 829507 |
| 6640 | B | 829169 |
| 6641 | B | 828763 |
| 6642 | B | 829769 |
| 6643 | B | 831582 |
| 6644 | B | 830481 |
| 6645 | B | 831468 |
| 6646 | B | 831670 |
| 6647 | B | 832293 |
| 6648 | F | 28484 |
| 6649 | F | 29043 |
| 6650 | F | 29656 |
| 6651 | F | 30157 |
| 6652 | F | 30712 |
| 6653 | F | 31175 |

TABLE 7-continued

| SEQ ID | or. | 5' position |
|---|---|---|
| 6654 | F | 31658 |
| 6655 | F | 31902 |
| 6656 | F | 32638 |
| 6657 | F | 33203 |
| 6658 | F | 33804 |
| 6659 | F | 34164 |
| 6660 | F | 34426 |
| 6661 | F | 35131 |
| 6662 | F | 35675 |
| 6663 | F | 36097 |
| 6664 | F | 36641 |
| 6665 | F | 36835 |
| 6666 | F | 37236 |
| 6667 | F | 38287 |
| 6668 | F | 38711 |
| 6669 | F | 39117 |
| 6670 | F | 39798 |
| 6671 | F | 500539 |
| 6672 | F | 501016 |
| 6673 | F | 501319 |
| 6674 | F | 501632 |
| 6675 | F | 502155 |
| 6676 | F | 502623 |
| 6677 | F | 503025 |
| 6678 | F | 503681 |
| 6679 | F | 504389 |
| 6680 | F | 504744 |
| 6681 | F | 505468 |
| 6682 | F | 505652 |
| 6683 | F | 505822 |
| 6684 | F | 505833 |
| 6685 | F | 506933 |
| 6686 | F | 507220 |
| 6687 | F | 507559 |
| 6688 | F | 508216 |
| 6689 | F | 508619 |
| 6690 | F | 509329 |
| 6691 | F | 509783 |
| 6692 | F | 510383 |
| 6693 | F | 510729 |
| 6694 | F | 511188 |
| 6695 | F | 511773 |
| 6696 | F | 511869 |
| 6697 | F | 512946 |
| 6698 | F | 513202 |
| 6699 | F | 513821 |
| 6700 | F | 514322 |
| 6701 | F | 514811 |
| 6702 | F | S151O1 |
| 6703 | F | 515611 |
| 6704 | F | 515911 |
| 6705 | F | 516123 |
| 6706 | F | 516169 |
| 6707 | F | S1621S |
| 6708 | F | 516305 |
| 6709 | F | 517240 |
| 6710 | F | 517993 |
| 6711 | F | 518174 |
| 6712 | F | 518756 |
| 6713 | F | 519133 |
| 6714 | F | 519646 |
| 6715 | F | 520201 |
| 6716 | F | 520563 |
| 6717 | F | 521015 |
| 6718 | F | 521162 |
| 6719 | F | 521543 |
| 6720 | F | 521739 |
| 6721 | F | 522328 |
| 6722 | F | 522567 |
| 6723 | F | 522915 |
| 6724 | F | 523300 |
| 6725 | F | 523791 |
| 6726 | F | 523959 |
| 6727 | F | 524369 |
| 6728 | F | 524801 |
| 6729 | F | 525085 |
| 6730 | F | 525241 |
| 6731 | F | 525738 |
| 6732 | F | 526263 |
| 6733 | F | 526628 |
| 6734 | F | 526779 |
| 6735 | F | 527004 |
| 6736 | F | 527230 |
| 6737 | F | 527381 |
| 6738 | F | 527545 |
| 6739 | F | 527691 |
| 6740 | F | 527932 |
| 6741 | F | 527995 |
| 6742 | F | 528167 |
| 6743 | F | 528610 |
| 6744 | F | 529063 |
| 6745 | F | 529710 |
| 6746 | F | 531140 |
| 6747 | F | 531488 |
| 6748 | F | 531842 |
| 6749 | F | 532064 |
| 6750 | F | 532350 |
| 6751 | F | 532794 |
| 6752 | F | 533117 |
| 6753 | F | 533536 |
| 6754 | F | 533868 |
| 6755 | F | 534200 |
| 6756 | F | 534844 |
| 6757 | F | 535213 |
| 6758 | F | 535678 |
| 6759 | F | 535970 |
| 6760 | F | 536504 |
| 6761 | F | 537013 |
| 6762 | F | 537710 |
| 6763 | F | 538047 |
| 6764 | F | 538353 |
| 6765 | F | 538718 |
| 6766 | F | 539188 |
| 6767 | F | 539471 |
| 6768 | F | 539910 |
| 6769 | F | 540774 |
| 6770 | F | 540962 |
| 6771 | F | 541721 |
| 6772 | F | 542198 |
| 6773 | F | 542644 |
| 6774 | F | 543180 |
| 6775 | F | 543877 |
| 6776 | F | 544601 |
| 6777 | F | 544866 |
| 6778 | F | 545442 |
| 6779 | F | 545948 |
| 6780 | F | 546209 |
| 6781 | F | 546585 |
| 6782 | F | 546960 |
| 6783 | F | 547114 |
| 6784 | F | 547726 |
| 6785 | F | 548045 |
| 6786 | F | 548480 |
| 6787 | F | 548561 |
| 6788 | F | 548775 |
| 6789 | F | 549037 |
| 6790 | F | 549153 |
| 6791 | F | 549597 |
| 6792 | F | 550049 |
| 6793 | F | 550520 |
| 6794 | F | 550890 |
| 6795 | F | 550997 |
| 6796 | F | 551040 |
| 6797 | F | 551247 |
| 6796 | F | 551854 |
| 6799 | F | 552333 |
| 6800 | F | 552603 |
| 6801 | F | 552823 |
| 6802 | F | 553207 |
| 6803 | F | 553898 |
| 6804 | F | 554298 |
| 6805 | F | 554767 |
| 6806 | F | 555323 |
| 6807 | F | 555595 |

TABLE 7-continued

| SEQ ID | or. | 5' position |
|---|---|---|
| 6808 | F | 555965 |
| 6809 | F | 556248 |
| 6810 | F | 815116 |
| 6811 | F | 815376 |
| 6812 | F | 815849 |
| 6813 | F | 816098 |
| 6814 | F | 818726 |
| 6815 | F | 819337 |
| 6816 | F | 820080 |
| 6817 | F | 820750 |
| 6818 | F | 821170 |
| 6819 | F | 821815 |
| 6820 | F | 822490 |
| 6821 | F | 822789 |
| 6822 | F | 823244 |
| 6823 | F | 823762 |
| 6824 | F | 823964 |
| 6825 | F | 824245 |
| 6826 | F | 824609 |
| 6827 | F | 824948 |
| 6828 | F | 825490 |
| 6829 | F | 826064 |
| 6830 | F | 826405 |
| 6831 | F | 826480 |
| 6832 | F | 827089 |
| 6833 | F | 827418 |
| 6834 | F | 627496 |
| 6835 | F | 827730 |
| 6836 | F | 828180 |
| 6837 | F | 828348 |
| 6838 | F | 828729 |
| 6839 | F | 830099 |
| 6840 | F | 830281 |
| 6841 | F | 830491 |
| 6842 | F | 830550 |
| 6843 | F | 830576 |

PUBLICATIONS CITED IN THE SPECIFICATION

Adames et al., 1985, Nature, 318:533–538.
Aldous, M. B. et al., 1992, J. Infect. Dis., 166:646–649.
Alexander et al., 1987, Mol. Cell. Biol., 7:1436–1444.
Allan, G. M. et al., 1995, Vet. Microbiol., 44:49–64.
Altschul, S. F. et al., 1990, J. Mol. Biol., 215:403–410.
Altschul et al., 1993, Nature Genetics, 3:266–272.
Altschul et al., 1997, Nucl. Acids Res., 25:3389–3402.
Ansubel et al., 1989, Current Protocols in Molecular Biology, Green Publishing Associates and Wiley Interscience, NY.
Arlinghaus, H. F. et al., 1997, Anal. Biochem., 69, 18, 3747–53.
Bai, M. Et al., 1993, J. Virol., 67:5198–5205.
Barany, F., 1911, PNAS. USA, 88:189–193.
Beattie, K. et al., 1993, Clin. Chem., 39(4):719–721.
Bernoist and Chambon, 1981, Nature, 290:304–310.
Borman, S., 1996, Chem. Eng. News, 74(50):42–43.
Braun, J. et al., 1994 Ann., Rheum Dis 53:100–105.
Brinster et al., 1982, Nature, 296:39–42.
Buckholz, R. G., 1993, Yeast systems for the expression of heterologous gene products. Curr. Op. Biotechnology 4:538–542.
Burg, J. L. et al., 1996, Mol. and Cell. Probes, 10:257–271.
Campbell, L A. et al., 1992 J. Clin. Microbiol. 30:434–439.
Casas-Ciria J. et al., 1996
Chatelier, R. C. et al., 1995, Anal. Biochem., 229(1):112–118.
Chee, M. et al., 1996, Science, 274:610–613.
Chu, B. C. F. et al., 1986, NAR, 14:5591–5603.
Chu, P. W. G. et al., 1993, Virus Research, 27:161–171.
Clark, E. G., 1997, American Association of Swine Practitioners, 499–501.
Cole et al., 1985, in Monoclonal Antibodies and Cancer Therapy, Alan R. Liss, Inc., pp. 77–96.
Cote et al., 1983, PNAS USA, 80:2026–2030.
Cserzo, M., Wallin, E., Simon, I. von Heijne G and Elofsson, A., 1997, Prot. Eng., 10:673–676.
DeBoer et al., 1980, Scientific American, 242:74–94.
DeBoer et al., 1983, PNAS USA, 80:21–25.
Derisi, J. et al., 1996, Nature Genet, 14:457–460.
Distance Relationships: Atlas of Protein Sequence and Structure, Washington: National Biomedical Reserach Foundation.
Duck, P. et al., 1990, Biotechniques, 9:142–147.
Dulac, G. C. et al., 1989, Can. J. Vet. Res., 53:431–433.
Edwards, C. P., and Aruffo, A., 1993, Current applications of COS cell based transient expression systems. Curr. Op. Biotechnology 4:558–563.
Edwards, S. et al., 1994, Vet. Rec., 134:680–681.
Erlich, H. A., 1989, In PCR Technology. Principles and Applications for DNA Amplification. New York: Stockton Press.
Falsey, et al., J. Infect. Dis. 168:493–496.
Fanger and Drakeman, 1995, Drug News and Perspectives, 8:133–137.
Felgner, et al., 1987, Proc. Natl. Acad. Sci., 84:7413.
Fodor, S. P. A. et al., 1991, Science, 251:767–771.
Fontes, E. P. B. et al., 1994, J. Biol. Chem., Vol. 269, NO 11:8459–8465.
Fox, G. Et al., 1989, J. Gen. Virol., 70:625–637.
Fraley et al., 1980, J. Biol. Chem., 255:10431.
Gardner et al., 1981, Nucl. Acids Res. 9:2871
Gaydos, C. A. et al., 1994 J. Clin. Microbiol. 32:903–905.
Grayston, J. T. et al., 1986 N. Engl. J. Med., 315:161–168.
Grayston, J T. et al., 1996 Rev., Med Interne 17, 45S–47S.
Gonnet et al., Science, 256:1443–1445.
Grosschedl et al., 1984, Cell, 38:647–658.
Guateli, J. C. et al., 1990, PNAS. USA, 87:1874–1878.
Hackland, A. F. et al., 1994, Arch. Virol., 139:1–22.
Hahn, D L. Et al., 1991 JAMA. 266
Haidl, et al., 1992 N. Engl. J. Med. 326:576–577.
Haidl, et al., Chlamydial infections 1994
Hammer et al., 1987, Science, 235:53–58.
Hanahan, 1985, Nature, 315:115–122.
Hanson, S. F. et al., 1995, Virology, 211:1–9.
Harding, J. C., 1997, American Association of Swine Practitioners, 503.
Harding, R. M. et al., 1993, Journal of General Virology, 74:323–328.
Hashiguchi, K. et al., 1992 J. Laryngol. Otol. 106:208–210.
Hayashi, S. and Wu, H. C., 1992, in N. M. Hooper and A. J. Turner (ed.) Lipid Modification of Proteins: A Practical Approach. Oxford University Press, New York, pp. 261–285.
Heinkoff and Heinkoff, 1993, Proteins, 17:49–61.
Herrera-Estrella et al., 1983, Nature, 303:209–213.
Herrera-Estrella, 1984, Nature, 310:115–120.
Heyraud-Nitschke, F. et al., 1995, Nucleic Acids Research, Vol. 23, NO. 6.
Higgins et al., 1996, Meth. Enzymol., 266:383–402.
Horner, G. W., 1991, Surveillance 18(5):23.
Houbenweyl, 1974, in Meuthode der Organischen Chemie, E.
Wunsch Ed., Volume 15-I et 15-II, Thieme, Stuttgart.
Hsia, R. et al., 1997, Molecular Micorbiology, 25:351–359.
Hueck, C. J., 1998, Molec. Biology Rev., 62:379–433.
Huovinen, P. et al., 1989 Ann., Intern Med 110:612–616.
Huse et al., 1989, Science, 246:1275–1281.
Huygen, K. et al., 1996, Nature Medicine, 2(8):893–898.
Innis, M. A. et al. 1990. in PCR Protocols. A guide to Methods and Applications. San Diego: Academic Press.
Inoue et al., 1987, Nucl. Acids Res., 15:6131–6148.
Inoue et al., 1987, FEBS Lett. 215:327–330.

Jackson, L A. et al., 1997 Am., J. Pathol. 150.:1785–1790.
Jantos et al., 1997, J. Clin. Microbiol., 35(3):620–623.
Kabat E. Et al., 1983, Sequences of Proteins of Immunological Interest, U.S. Dept. Of Health and Human Services.
Kaneda, et al., 1989, Science, 243:375.
Karlin and Altschul, 1990, Proc. Natl. Acad. Sci. USA, 87:2267–2268
Kelsey et al., 1987, Genes and Devel., 1:161–171.
Kievitis, T. et al., 1991, J. Virol. Methods, 35:273–286.
Kleemola, M. et al., 1988, J. Infect. Dis. 157:230–236.
Kohler, G. et al., 1975, Nature, 256(5517):495–497.
Kollias et al., 1986, Cell, 46:89–94.
Kozbor et al., 1983, Immunol. Today, 4:72.
Krone, J. R. et al., 1997, Anal. Biochem., 244, 1, 124–132.
Krumlauf et al., 1985, Mol. Cell. Biol., 5:1639–1648.
Kuo, C C. et al., 1988, J. Clin. Microbiol. 26:812–815.
Kuo, C C. et al., 1993, J. Infect. Dis. 167:841–849.
Kwoh, D. Y. et al., 1989, PNAS. USA, 86:1173–1177.
Ladany, S. et. al., 1989, J. Clin. Microbiol. 27:2778–2783.
Laitinen, K. et al., 1997. *Chlamydia pneumoniae* Infection Induces Inflammatory Changes in the Aortas of Rabbits. Infect. Immun. 65:4832–4835.
Lazarowitz, S. G. et al., 1989, The EMBO Journal, Vol. 8 NO. 4:1023–1032.
Leder et al., 1986, Cell, 45:485–495.
Lee, C. A., 1997, Trends Microbiol., 5:148–156.
Leininger, E. et al., 1991, PNAS USA, 88:345–349.
Lipshutz, R. J. et al., 1995, Biotechniques, 19(3):442–447.
Liu, H. et al., 1997, J. Gen. Virol. 78(Pt6):1265–1270.
Livache, T. et al., 1994, NAR, 22(15):2915–2921.
Lockhart, D. J. et al., 1996, Nature Biotechnol., 14:1675–1680.
Longbottom et al., 1998, Infect Immunol., 66:1317–1324.
Luckow, V. A., 1993, Baculovirus systems for the expression of human gene products. Curr. Op. Biotechnology 4:564–572.
Lukacova, M. Et al., 1994, Infect. Immunol. June, 62(6):2270–2276.
MacDonald, 1987, Hepatology, 7:425–515.
Mankertz, A. et al., 1997, J. Virol., 71:2562–2566.
Mason et al., 1986, Science, 234:1372–1378.
Matson, R. S. et al., 1994, Analytical Biochemistry, 217:306–310.
Matthews, J. A. et al., 1988, Anal. Biochem., 169:1–25.
McNeilly, F. et al., 1996, Vet. Immunol. Immunopathol., 49:295–306.
Meehan, B. M. et al., 1997, J. Gen. Virol., 78:221–227.
Mérel, P., 1994, De la PCR aux puces à ADN, Biofutur, 139:58.
Merrifield, R. D., 1966, J. Am. Chem. Soc., 88(21):5051–5052.
Midoux, 1993, Nucleic Acids Research, 21:871–878.
Miele, E. A. et al., 1983, J. Mol. Biol., 171:281–295.
Moazed, T. C. et al., 1997. Murine Model of *Chlamydia pneumoniae* Infection and Atherosclerosis. J. Infect. Dis. 175:883–890.
Mogram et al., 1985, Nature, 315:338–340.
Mordhorst, C. H. et al., 1992 Eur., J. Clin. Microbiol. Infect Dis 11:617–620.
Morrison et al., 1984, PNAS USA, 81:6851–6855.
Murphy, F. A. et al., 1995, Sixth Report of the International Committee on Taxonomy of Viruses. Springer-Verlag Wien New York.
Nakai, K. and Kanehisa, M., 1991, Proteins, 11:95–110.
Nielsen, H. et al., 1997, Protein Engin., 10:1–6.
Neuberger et al., 1984, Nature, 312:604–608.
ODonell-Maloney, M. J., 1996, Trends Biotechnol., 14:401–407.
Ogawa, H. et al., 1992 J. Laryngol. Oto 106:490–492.
Olins, P. O., and Lee, S. C., 1993, Recent advances in heterologous gene expression in *E. coli.* Curr. Op. Biotechnology 4:520–525.
Ornitz et al., 1986, Cold Spring Harbor Symp. Quant. Biol., 50:399–409.
Pagano et al., 1967, J. Virol., 1:891.
Pearson and Lipman, 1988, PNAS USA, 85(8):2444–2448.
Peterson, E. M. et al., 1998, Infect. Immunol. Aug., 66(8):3848–3855.
Peterson, E. et al., 1988. Protective Role of Magnesium in the Neutralization by Antibodies of *Chlamydia trachomatis* Infectivity.
Pierschbacher and Ruoslahti, 1987, J. Biol. Chem., 262:17294–17298.
Pinkert et al., 1987, Genes and Devel., 1:268–276.
Pugsley, A. P., 1993, Microbiol. Rev., 57:50–108.
Puolakkainen, M. et al., 1993 J. Clin. Microbiol. 31:2212–2214.
Readhead et al., 1987, Cell, 48:703–712.
Reeves, P. R. et al., 1996, in Bacterial Polysaccharide Synthesis and Gene Nomenclature, Elsevier Science Ltd., pp. 10071–10078.
Relman, D. et al., 1990, Cell, 61:1375–1382.
Roivainen, M. Et al., 1994, Virology, 203:357–365.
Rolfs, A. et al., 1991, In PCR Topics. Usage of Polymerase Chain reaction in Genetic and Infectious Disease. Berlin: Springer-Verlag.
Salzberg et al., 1998, Nucl. Acids Res., 26:544–548.
Sambrook, J. et al., 1989, In Molecular cloning: A Laboratory Manual. Cold Spring Harbor, NY: Cold Spring Harbor Laboratory Press.
Sanchez-Pescador, R., 1988, J. Clin. Microbiol., 26(10):1934–1938.
Sani, 1985, Nature, 314:283–286.
Sarver et al., 1990, Science, 247:1222–1225.
Schnaitman, C. A. and Klena, J. D., 1993, Microbiol. Rev., 57:655–682.
Schneewind, O. Et al., 1995, Science, 268:103–106.
Schwartz and Dayhoff, eds., 1978, Matrices for Detecting Karlin and Altschul, 1990, PNAS USA, 87:2267–2268.
Segev D., 1992, in <<Non-radioactive Labeling and Detection of Biomolecules>>. Kessler C. Springer Verlag, Berlin, New-York:197–205.
Sheldon, E. L., 1993, Clin. Chem., 39(4):718–719.
Shiver, J. W., 1995, in Vaccines 1995, eds Chanock, R. M. Brown, F. Ginsberg, H. S. & Norrby, E.), pp.95–98, Cold Spring Harbor Laboratory Press, Cold Spring Harbor, New York.
Shoemaker, D. D. et al., 1996, Nature Genet, 14:450–456.
Shor, A. et. al., 1992 S. Afr. Med. J. 82:158–161.
Sosnowsky et al., 1997, PNAS., 94, 1119–1123.
Struyve, M. et al., 1991, J. Mol. Biol., 218:141–148.
Sundelof, et al., 1993 Scand. J. Infec. Dis. 25:259–261.
Sutcliffe, I. C. and Russell, R. R. B., 1995, J. Bacteriol. 177:1123–1128.
Swift et al., 1984, Cell, 38:639–646.
Takeda et al., 1985, Nature, 314:452–454.
Tascon, R. E et al., 1996, Nature Medicine, 2(8):888–892.
Thom, D. H. et al., 1990 Am. J. Epidemiol 132:248–256.
Thomas, G N. et al., 1997 Scand., J. Infect. Dis. Suppl 104, 30–33.
Tischer, I. et al., 1982, Nature, 295:64–66.
Tischer, I. et al., 1986, Arch. Virol., 91:271–276.
Tischer, I. et al., 1988, Zentralbl Bakteriol Mikrobiol Hyg [A] 270:280–287.
Tischer, I. et al., 1995, Arch. Virol., 140:737–743.
Thompson et al., 1994, Nucl. Acids Res., 22(2):4673–4680.
Urdea, M. S., 1988, Nucleic Acids Research, 11:4937–4957.
Villa-Kamaroff et al., 1978, PNAS USA, 75:3727–3731.
Wagner et al., 1981, PNAS USA, 78:1441–1445.
Walker, G. T. et al., 1992, NAR 20:1691–1696.
Walker, G. T. et al., 1992, PNAS. USA, 89:392–396.
White, B. A. et al., 1997, Methods in Molecular Biology, 67, Humana Press, Towota
Yamamoto et al., 1980, Cell, 22:787–797.
Yershov, G. et al., 1996, PNAS., USA, 93:4913–4918. .

SEQUENCE LISTING (6849 sequences)

SEQ ID NO: 1 - DNA, 1230025 bp, Chlamydia pneumoniae
  misc_feature (1)..(15000): n=a or c or g or t
  misc_feature (15001)..(30000): n=a or c or g or t
  misc_feature (30001)..(45000): n=a or c or g or t
  misc_feature (45001)..(60000): n=a or c or g or t
  misc_feature (60001)..(75000): n=a or c or g or t
  misc_feature (75001)..(90000): n=a or c or g or t
  misc_feature (90001)..(105000): n=a or c or g or t
  misc_feature (105001)..(120000): n=a or c or g or t
  misc_feature (120001)..(135000): n=a or c or g or t
  misc_feature (135001)..(150000): n=a or c or g or t
  misc_feature (150001)..(165000): n=a or c or g or t
  misc_feature (165001)..(180000): n=a or c or g or t
  misc_feature (180001)..(195000): n=a or c or g or t
  misc_feature (195001)..(210000): n=a or c or g or t
  misc_feature (210001)..(225000): n=a or c or g or t
  misc_feature (225001)..(240000): n=a or c or g or t
  misc_feature (240001)..(255000): n=a or c or g or t
  misc_feature (255001)..(270000): n=a or c or g or t
  misc_feature (270001)..(285000): n=a or c or g or t
  misc_feature (285001)..(300000): n=a or c or g or t
  misc_feature (300001)..(315000): n=a or c or g or t
  misc_feature (315001)..(330000): n=a or c or g or t
  misc_feature (330001)..(345000): n=a or c or g or t
  misc_feature (345001)..(360000): n=a or c or g or t
  misc_feature (360001)..(375000): n=a or c or g or t
  misc_feature (375001)..(390000): n=a or c or g or t
  misc_feature (390001)..(405000): n=a or c or g or t
  misc_feature (405001)..(420000): n=a or c or g or t
  misc_feature (420001)..(435000): n=a or c or g or t
  misc_feature (435001)..(450000): n=a or c or g or t
  misc_feature (450001)..(465000): n=a or c or g or t
  misc_feature (465001)..(480000): n=a or c or g or t
  misc_feature (480001)..(495000): n=a or c or g or t
  misc_feature (495001)..(510000): n=a or c or g or t
  misc_feature (510001)..(525000): n=a or c or g or t
  misc_feature (525001)..(540000): n=a or c or g or t
  misc_feature (540001)..(555000): n=a or c or g or t
  misc_feature (555001)..(570000): n=a or c or g or t
  misc_feature (570001)..(585000): n=a or c or g or t
  misc_feature (585001)..(600000): n=a or c or g or t
  misc_feature (600001)..(615000): n=a or c or g or t
  misc_feature (615001)..(630000): n=a or c or g or t
  misc_feature (630001)..(645000): n=a or c or g or t
  misc_feature (645001)..(660000): n=a or c or g or t
  misc_feature (660001)..(675000): n=a or c or g or t
  misc_feature (675001)..(690000): n=a or c or g or t
  misc_feature (690001)..(705000): n=a or c or g or t
  misc_feature (705001)..(720000): n=a or c or g or t
  misc_feature (720001)..(735000): n=a or c or g or t
  misc_feature (735001)..(750000): n=a or c or g or t
  misc_feature (750001)..(765000): n=a or c or g or t
  misc_feature (765001)..(780000): n=a or c or g or t
  misc_feature (780001)..(795000): n=a or c or g or t
  misc_feature (795001)..(810000): n=a or c or g or t
  misc_feature (810001)..(825000): n=a or c or g or t
  misc_feature (825001)..(840000): n=a or c or g or t
  misc_feature (840001)..(855000): n=a or c or g or t
  misc_feature (855001)..(870000): n=a or c or g or t
  misc_feature (870001)..(885000): n=a or c or g or t
  misc_feature (885001)..(900000): n=a or c or g or t
  misc_feature (900001)..(915000): n=a or c or g or t
  misc_feature (915001)..(930000): n=a or c or g or t
  misc_feature (930001)..(945000): n=a or c or g or t
  misc_feature (945001)..(960000): n=a or c or g or t
  misc_feature (960001)..(975000): n=a or c or g or t
  misc_feature (975001)..(990000): n=a or c or g or t
  misc_feature (990001)..(1005000): n=a or c or g or t
  misc_feature (1005001)..(1020000): n=a or c or g or t
  misc_feature (1020001)..(1035000): n=a or c or g or t
  misc_feature (1035001)..(1050000): n=a or c or g or t
  misc_feature (1050001)..(1065000): n=a or c or g or t
  misc_feature (1065001)..(1080000): n=a or c or g or t
  misc_feature (1080001)..(1095000): n=a or c or g or t
  misc_feature (1095001)..(1110000): n=a or c or g or t
  misc_feature (1110001)..(1125000): n=a or c or g or t
  misc_feature (1125001)..(1140000): n=a or c or g or t
  misc_feature (1140001)..(1155000): n=a or c or g or t
  misc_feature (1155001)..(1170000): n=a or c or g or t
  misc_feature (1170001)..(1185000): n=a or c or g or t
  misc_feature (1185001)..(1200000): n=a or c or g or t
  misc_feature (1200001)..(1215000): n=a or c or g or t
  misc_feature (1215001)..(1230000): n=a or c or g or t
  misc_feature (1230001)..(1230025): n=a or c or g or t
atagaaaactattaaaaaatcattgattctgtcgggaaagtatgcggataaaattcagagagaataaggagaggaagatgacaaggcagagttatgttttgggcaattggaaaatgcacaaaacaatccaagaagctaaagagtatgttcaaacattagcttctntactacaaggagaacctctttcctgcactataggcatagcttctccatttacctctttgagagcgattcatgagatgataaacactacgggagcttttctctggttgggagcacaaaatgtccatcccgagctttcgggtgcttttactggagaaatttccttacctatgcttaaggaggtaggagtggaatttgttttagtaggtcactccgagcgtcgtcatatttttggagagagtgatgcctttattgcttcaaaggtaaagtctgtagctcaggcgggactcgtgcctgttctttgtgttggagagagcttagaagttcgtgaagagggaaaggcgcatcaggtaatcaaaaaacagttgcttttgggattggaacagatggataatggttccgaatttttgatcgcctatgaaccagtatgggctatcggcacagggaaggtggcagaagcttcggatgtgcaagatattcatatgttttgtcgtgaggtagtggcagagaggttctcagaagctacagctgaagagatttcgattttgtacggaggatctgtgaaggtcgataatgctcagcgatttgggcaatgtagcgacgtcgatggtcttttagttggcgganttctttagangggcaaagtttttttgaagtcgctaaaaattttaatgtataatttgtgagagttatgagatttttttgtctattttttcttgggttcctaggatcttttcattgtgttgctgaagacaagggcgtggatttatttggagtctgggacgataaccaaattacagagtgtgacgatagttacatgacagagggtcgtgaagaggttgaaaaggtagtggacgcttagtccatcggcttttatttatattctccctaaggaagtcctgtattgaagatcgctttctcatagatagaagtaattttcagatagtcaataattggtttttttaagagaatgctaggcaggtgctcgtgtttgggcatttgattaagtctacatgaatctggagggagagattcttctggtattgagaagtagaacaaaaaacaaggatcagacgttctccgatgtcttcctaatcgatgtctttaaataaggagattggcatgacagtgttgttttacgcatttttattcattttcctttttctatgtgtaattctttgtggcttaatcctggttcaagagagtaagagcatggggttaggttcttcgttcggcgtggattctggagattctgtctttggtgtctctactccagatattttgaaaaaagtgacttcatngtgtgctgttgctttctgcataggttgtttactactttcattttccacgaatctcttggggaaaaagttagatgctaaagaatttctattgcctgctgctgaggagagcgacactcaagcttcttctgagagcgttgaagcagatgaatcctagcctatttgcggaattaggtgttgtctagattgaagtgcaataaagctagcaagtttttatcttcatacgagatatgagtgtacggtcggataagagtagaaatctttcttttgttcctatggttaagaagtcctttggcttccttaaagagtatgactcttatcaacccaagaaatgttttagatccaagtgcttgtcgtacgagatttcttcacagagctctgccaagcccatgttcagactatgattagacgtttagaatattacggcagtcctattttaaggaaaaagtcttccccaattgcagagatcacagatgagattcgtaatctcgtgagtgatatgtgtgatactatggaagcacatcgtggtgtcggtttagccgctcctcaggtagggaaaaacgtcagtttatttgtcatgtgtgtagatagagagactgaggatggagagttgattttctctgagtctccgagggtatttatcaatcctgttctatcagatccttctgaaaccccgatcataggtaaagaaggatgtctttctattcctggattgcgaggagaagtattccgccctcagaaaatcacagtgaccgctatggatctcaatggtaaaatatttactgagcacttggaaggattcactgcacgtatcattatgcacgagactgaccatctgaatggagttctctatattgatcttatggaagaacccaaagatcctaaaaaatttaaagcctctttagagaagatcaaacgtcgctacaatacacacttgagtaaagaagaactagtttcttaattgctcttcagtctgatgtaggtgatattttcttgtctcttgcgtcacatttgttgtcagctttgcttatttccccgaacaaatttcgtcaaaggttttaaaatgtgtcttgctgatttttgctaagagctctttccctcgttgcttagcgatctctcttcctgctgctttgacattgaatccagcacctttaggaagctgtacttgatattgttcttccaacttctgtatcgactgtacaaatgcatctctagccaatatagaagctgctgctacgactacatcttgttctgcacgtggcttttgtattaaagtaatatcggtttcttttttttgaagtgctttgagtagggtgtattctgaagctgcaaactgatctgaaatagcaaagacatctcctgcaggtttgggtgctaagttgttgataacagtagcgtgggcccaagcaagaagtgtatttaaattctggaatttcccatatagctcgttatatttttctgggtatagaatgatgacatcgcagacacatagtgagcgtatgatacgtgctaaagaagcgattttcgtgtctttgagatttttagagtcttggactttattctcatagagtttttttaagatctctgcattcgatgcatagactgccgcaatacataaagggccaaaaaaatcacctttccctgattcatcgactcccaaccttggacgaaggtcttgctctacccttgcatgggtgaaggtatgaaggatttctggttctaagaaaaattctatgaattcctcacttcctttaccttggattacgagtttcccggaggggtatagagtgcaggtaacagtgttagagcgagcttgaaatacggtattctgtggctgagaaaagataaaatttttttcttttagctgatctcttaaattgttttgagcagaagttgttaaagtaacaacaaatggtggcggcatgcaggacatctacctataaattatagaaaaaatttagaacgattgaattcctagtcctaggaatccaggatgcaaagtgctcatactttttatttttgcctactatatcgtatagttatgacaacttccaagtacaaattaaacaacaattttgtatatttctgcaaataactgcggggagccaaagatacaagagtgtaagatgtctagtattttacattcttaaggttttgagaaacactatataggtaatcatgcaagaacacatacataaagaattgctacatctaggtgaaatctttcgctcatcacgagagtctcaatccctatcgttaaaggatgtagaggctgcaacctcgatacgatatagttgtttagaagctattgaacaggggtgtttaggaaaattgatttctccagtttatgctcagggatttattaagaaatacgctacgtatcttgggttggatggagatagtatcttacaagaacatccttatgtcatgaaaatttttaaagagttttcagatcataatatggagatgcttttagaccttgaatcgatgggaggaaggaattctccggaaagagcaattcattcttggtcgaatctttggtgggcagggctgatcattataggtggcatcatggtgtggtggctcggatcgttgttttctattttttaacttaaggtctgttggtctctatttagaccaacagataggatggagtacttcttaccctaatttgaatagttgtgagactttctgagccccttgcaaaagttgtctttgattttcaggagaccagggatcttcatccctaccctcatcatcctcaggacctaagggctctcctaaaccatcacttcctgttgtactatcacagccatcggttcggtctcttctctgttgggagcttcctccaacaccgaaggcactggcatggaatgccaaatcctccgcctgtcacaataccatctctttctatttcgtcgtcatcccacgggtcaggaggtggtggagcttgtctaggagcttcgccttgggtttgtctccaaatgttctctccagctgtggtggtgactaatacctttctaagaattctttgccaaggaccttggactctagggtcaagaacagtttgctctggatgtagaggatctaaaggaagatatccttttgaaagaaggcatagaaggacaaggacttcaaatacctgagattctaaactcaaaccaataccaggacctaagaaagtcgcaagatcactggcaacaagtctttttagtgatttttttattaagtccacaatttgtttagcagcttgtcctaaaggacccttgtaaccggattctaagctcaaaacctctaacctggataatttttgtaataaagtcctaaaattgagtttgcatgtaacacggcattcttgagcggggtgcttcttttgttgaggagctggcgcgcctcctacagcaccttgtagctgttcttcgtctgttggaggtgggggacagggttgctgttctggttgtagaatccaacaagtaggaggattgtcagatgaagttacaaaggaaagagccccctctgaaacagcttgaagtatgagactccatggtggtgtctgttgcatgtcttcgcctaagccgttgttttgtaaaagcttgactagagattcacccatgcatcttggttgagctgcttttagtagttcccgatgtagcttgcaaccattttcaacctcctgtttatccccgtcacccaacggttcaccttgctcaatcttctgtgtacagtgcggtagctgttggaaagacataccaacacaaataggtccgtattgctgtataagttgttgtagaaattgtgctgagggattatcaggatcatccacggtctctaagcagcatgcgcaacatcctccccatatccattgtaagaaaccaggacaatgctctctgcaccagggagtcccggttctataacaataatgtcctagacgttgcattctagcactatctaagagattattaagtaacgagcctgcttgttctaccatacctagcacattgtctgatccgagcgagatacccatttcacgacctccagtcccaggctgttgtgtaattacacgtccaccttgagagccagattggcctccttcttgcagtggaatatcttctcctccgggatttggtgggggcgtttcgcgataataacaattacaatttccacatggaaatgtcatgaggcttctcctttagtgaggttgagttgtatggatttttataattacgagttcttctagaaaggaattatagaatgttcagatagagtattttaaagcgggttatttcttattggatgattaagaaaaataggaaatcttgattatgtttttttgtcgagattacttttagagaaagagtttaaagtgatcgcgggttattagtcaatttattttttaatttaacatagatcctctcttaagtttccttgttgtgatgggataaatatttggggaagaaatgccgcaaaattttttctaagttctcaaacttttcaagaaaacatagattcttggatagaacaaaagcttcgcggcaaaaaataggaatcttattctttgtttatttttatccctaaaaatagagtttgtaaatgacccgagcattcaaggatacgctgttgatacgccaaattcccatcctcatcatcatcttcattttcatcttcttcttcgagacttgacatgagagggacagattctgcaggggtaggacaatcaagactttcctgtcttactaatgagggtttcttttttaaaaacgatgctgaagttttccctgttctatagctgtattgtagtcgatagaagatggtcataatcggatcatctatcatgtgtatatctacgacagatgtctcatcggtatttgcagggcaatagccaatcgctaacatcaataaaacgacgatatcacgaaaatttgggcacgtataacatatttctccacctgtgtgctttagaatagaagatgtgctttgtgatgcagataagagaaagctattcagcattttcacaatcaggagaccaaaaggacctaaagctgaaaaatctcctgtttttagattggtgacttggatttttcctaattgtctggccatgccattgtcattgtatttttttgctacgtactggggctctgcaccgactgaagatgggcgtcgcgcatctcttgatccacaggataggcgtgacgtcgttaaggggctcgtatttaagatatagcacgcaggaatgcgtgtagaattagaagcagaagatgttcctgaggcttcctctgattctatagttttttcccaagaccttgtagcaataaagcttagcacggcttggactagtgaatcgtctagaccgcgttctctaatgctgttgactccttcaaggaaaaagttttgagaaaggctctgcatcgttccatagagctgggttttagcttccgagcaatgctgtctaaattcatttttctgttcttcagacaaaatagtgtttttttctacaagttccattaagttgaggcccatagttttagcagctaaagcaacggcaataggaccatgggtctgttcgcattcatggacaagtccagcaacctgattatcctctctgtctaagcaacacgctttatacgttccacaaatgagtcttccaaaagatccgcaacgctgaccacatccagttgcgtaactgtcataacaatactctgtacatccttgcgttcgtctatgtgatagaatggagtctaccaattctcctgcttcttggatcatgtgtattgtactttcatcaccttgagcagtattaaattggacacgtttctctacttttgtaattttagtaggttgcgtagttataggagcagctcctccactcgaaccagcttcttcgcttatatctgaagccgattgccgcgttgtttcttctgttgttgttacttcaacccattcgcagttgaaatttccacacattctgaaccaagaattatttgggcaaaccatagtcgtacctttttaatatttagatttatttaggttttagagagttgaaaagaactctctaagaacaggaaaagagtcggtatgctctgcttgcgactgtgctgtttggaatgggaaacgaagggatcccagtgtctatagcacagtagagtgaggctaaacgtcaaaattgatttgaagaaatttgaattgctgacaagagggggagaggaattaaaaacgtcggacggaagaagatgtttagagcatgtataaagaaaattttaaattagatgcattatttcatgggtcttaccttatttagacttaagatggtaaggaagtctataaaatcattttttttaaaatctacggaatttaaaaaattacttgataatgatgtggagtcgtagaagtgcaaactcactagaaatttcctgaatttgagaaggagtttaaaataggtattcttgaaaagatcaatgcacgtgtagtggaaagaaaggcgtaacctacactggaaggagtttcttttagaagaaggtttcttttttcgttgttaatgacaaaaactctctaagaacatcgtgtcaaccgtttttattgttgtgtttatttaaaaaaaagattatatccttcatgcaaattggtgctgttggaaacaaatgttgaaaatccagaaaaaaagaatgtgtgtcagcgtagtcatcacggtaggcgccatagtggggtttttcaattctgcagacgcagcaccaaagaaaaagaagatccctatacagattctctactcctttactaaagtctcttcctatttaaaaaacgaagacgcaagtactatattttgcgtcgatgtggatcgtggacttctccagcatcggtatttaggtagtccaggatggcaggaaaccagacgtcggcagttatttaaatccttagaaaatcaatcatacggcaacgaacgtttaggagaagaaactcttgctattgatattttcaggaacaaagagtgcttggagagcgagatcccagagcagatggaagctatccttgcaaattcctcggccttggtcttaggcatctcttcttttgggatcacaggaattcctgcgactttgcatagtttgcttcgacagaatctatctttccaaaaacgctctatagcatcggagagcttccttttaaagatcgatagtgccccctcagatgcctctgttttttataaaggcgtgcttttccgcggagagactgcgatcgtggatgcgttaagccaattatttgcccagctcgatctttctcctaaaaaaattatctttctaggagaagaccctgaggtcgttcaagctgttgggtctgcttgtataggttggggcatgaactttttaggcctggtatactatcctgctcaagaaagccttttttcttatgttcatccttactctacagcaacggagctccaagaagcacagggtttacaagtaatttcagatgaagtcgcacagcttactttaaacgctcttccgaaaatgaattaacatgatgttagaacaacaagccctacgtattctctttccccctgagggtgcttagggccctttttatctagcatgagcggagatttaggttttagtgagatttttggtaaatatgaaaatattttcttaaaaagatcatgaaacagtcatacttttgcattgaaggatctttatgagacgttatcttttcatggttctagctttatgcctatatagagcagcccctctcgaagcagtggtcattaaaattactgatgcgcaggcagttcttaagtttgctagagagaaaactttagtatgtttcaatattgaagatactgtggtatttcctaaacagatggtcggccagtctgcatggctctacaatagagagctcgatcttaagactacactctccgaagaacaagccagagagcaggcgtttctggagtggatggggatttcttttcttgtcgattatgaattggtgagcgcgaacttaaggaatgtactcacaggcttatctttgaaacgatcttgggtactcgggatttctcaaagacctgtgcatttgataaaaaatactcttcgcattctgcgttctttcaacatagacttcacctcgtgtccagctatttgtgaagatggttggctctctcatcctacaaaggacacaacattcgatcaggccatggctatagaaaaaaacattttgtttgttggctctctcaaaaacggtcagcccatggacgcagcccttgaagttcttctctctgggatctcttctcctcctagccaaatcatctatgtggatcaggatgcagaacgtttgcgttctatcggtgctttttgtaaaaaagcaaacatttattttatagggatgctctacaccccagccaagcagcgtgtagaaagttacaatcctaaacttactgcgatccaatggtcgcagattcgtaagaatctttccgatgaatattatgaatccctcttgagctatgtaaagagcaaagggtagtgtcagcaaatcgatgtgggaatggtatcctgtggatggcatagacacgcaaggcgttttttatgccgtttttagatccttgtaggtgcagaaaaactaaaaagatcggaagagaagggattcgaacccctggttcctgtaagagaacttctgatttcgaatcagacgcattcgaccactctgccactcttccgtaatgcttcaatagtttagagaatctacactcagattgtctacatgtattgcacaatgtttttcataaatttatgaaatcataatgaagattagagaagatggccgagtagtgaagacgaattcttagagaaaaattagagtgttttcttgcgtatctaggcagaaaactaccctcaagaagaggcttgagggtgaaacatctaatttttgtcagaatgatgagagtggcagcctcctgaagagcagctgtctccgtgtgaatgacgggacttcttgctgcagaaaggacaaaagcttagcaagcaaatgacaccagcaattccaatgataatataggtaatttgggtggcaggagtagaaacgcctccacacaacttagcaataatatttaatttattgtgagtgattcctataagtcccacgttcaatgcacaaagaataacaataagagaggataatcctcgaataattttgcctagcatcgcttttctcctaagtgatgtatacttaatttcatcttttaatcttttttataatttaataaacagtttttttcaaaagacttctttgctaaagtctctcagtctcgttgactttttgaatacaaaggtttaagttgttcaagaagtttttgaactgtaaacaacttccagtttttatgattagagagacagttcagaataaaaacttcaattttttaagtttagataatctttctttacttgcattgagaaaagagcatatttttataagccgcaatttaggataacatatggagcaatttcatttggatagggaagaaattttacttttggcaaaggcctcagcactacaactttctgaagagcttatccaggagtatcaaacttctttaagcgctgtgattacttctatgaaagaagctcttgccatagagattgatgatgcggattcatgcgaatctctttttatgcatgtagtaaatgttgaagatttgagagaagattcggtgacctctgatttcaatcgagaggaatttttgcgtaatgttccagagtctttagggggattagtgaaagttcctgcggtaatcaagtaagggagtctgaaaaattatgtatcgatatagtgctttagaattagcaaaagctgtgactttaggggaactgacagccacaggggtgactcaacatttttttcatagaatagaagaagctgaggggcaggtaggtgcctttatttccttgtgtaaggaacaagctttagaacaggcagagctcatagataaaaagcgttcgcgtggagaacctttaggaaaactcgcaggtgttcctgtaggaattaaagataatattcacgttacaggcctgaagacaacatgcgcctctcgtgtgctcgagaattatcaaccaccgtttgatgctactgttgtagaaagaatcaaaaaagaagatgggattatcttaggcaaactcaatatggatgagtttgctatgggatcaacaacgctatattctgcttttcatcctacccacaacccctgggatttatctcgtgttcctggaggttcttcagggggatctgcggccgcagtttctgctagattttgtcccgtagccctaggatcagataccggaggatccatccgtcagcccgcagcattttgtggtgttgtaggttttaagccttcctacggagccgtttcgcgttacgggcttgtagcctttgcctcttcgctagatcaaatcggtcctttagccaatactgtagaagacgtcgccctaatgatggatgtgttttctggtagagatcctaaagatgcaacctcaagagagtttttccgtgattcttttatgagcaagttgtctacggaggttcctaaagtgattggggtgcctagaacatttttagagggactccgtgatgatattagggagaatttcttctcttcattagccatttttgaaggagaaggaacccatcttgtggatgtggagttggatattctcagccacgctgtatctatatattacattttagcatctgctgaagctgccacgaatttagcaaggttcgatggggtgcgttatggatatcgttctcctcaagcgcataccatcagccaactctacgatctctcacgtggagaaggatttggcaaagaggtcatgcgcagaatcctcttagggaactatgtcttgtctgcggagagacagaatgtttattataagaaagctacggcagtgcgtgctaagattgtaaaagcatttagaactgcatttgaaaagtgtgaaatcttagccatgcccgtctgttctagccccgcgtttgaaataggagaaattctagatcctgtgactttatatctacaggatatctatactgtagctatgaatttagcgtatcttcctgccattgccgtaccctctggattttctaaggagggcctgcccttaggcctacagattatcggacagcaaggacaagaccaacaagtgtgccaagtgggttacagtttccaagagcatgcgcaaattaagcaattgttttctaagagatatgccaaaagtgttgttctaggaggtcaatcatgagtgctgtttatgcagattgggaatcagtcataggacttgaagttcacgtagaattgaacacagcatccaagttatttagctctgctttaaatcgctttggagatgaaccaaacactaatatttctacagtatgtacaggattgccaggatcattgcctgtattgaatcagagtgccgtggagaaagctgtgctttttggctgcgctgtcgaaggtgaaatctctctattgagtcgtttcgataggaagtcttacttctatcccgatagtcccaggaattttcaaattacacaattcgaacatcctattatccgaggaggacgcattaaggcgattgtccaaggggaagagcgttattttgaattagcccaaacccatatagaagatgatgccggaatgctgaagcacttcggagagtttgccggtgtagactacaatcgtgccggagtccccctaatcgaaattgtttcaaaaccctgtatgttttgtcctgaagatggctgttgttacgcaacttctttggtttccttgttagactatattggaatttccgattgcaatatggaagaaggctccatccgttttgatgtcaatgtctccgtacgccctaagggatccccagaacttcgcaataaggtagaaatcaagaatatgaactccttcgcttttatggcacaagctttagaagctgaaaaacaacgtcagatcgatgagtatcttaatcagccaaataaagatcccaagctggtgattccagccgctacctaccgctgggatcccgaaaagaaaaaaactgtgctgatgcgtctcaaagagagtgccgaagattataaatattttcccgagcctgatctgccgacactacaattgacagagtcctatatagaaaggattcgcaagaccttgccagaacttccttatgacaagtaccatcgctatattcaggagtacggtctatccgaagatatcgcaagtattctgatcagcgataagaatatcgcaacgttttttgaagtcgcttgtaaagattgtaaaaactttaggtctttatctaactgggtaaccgttgaatttggaggccgctgcaaaaccctaggagtgaagttgccatcttcaggaattttccccgagggagtcgctcagctggtcaacgcaatcgaccaaggtgtgatcacagggaaaattgctaaggaaatcgcagatcttatgatggaatccccaggaaagaatcctgaggagattttaaaagagaagccagagctgcttcccatgtcagatgaaggggaattgcagaaaattatcgcagaggtggttcttgcaaatcctgaatctatcgtagactataaaaatggaaagactaaggctctaggattcctagtcgggcagattatgaagcgtacagcaggaaaagctcctcccaagcgagtgaacgaacttttacttttagaattagataagggctagaattttctgtcacagtctgtcttaaaaaatcataaaagcatgttagagatctttctaacatgctttttttatctaaatacacatttctaagttgcaaaaacgaaagcagaaaatttcgatttgcctttctacctacactttatggatccatcagaattaaattttgcaaagccatgtctacgcgggagataattctttttaagtgacaagaaattcttgtgctcggcttgctttcttattcttattgacgtattgcttgatcagatattcattttgatttaggtactaaaatgcgattttcgctctgcggatttcctctagttttttcttttacattgctctcagtcttcgacacttctttgagtgctactacgatttctttaaccccagaagatagttttcatggagatagtcagaatgcagaacgttcttataatgttcaagctggggatgtctatagccttactggtgatgtctcaatatctaacgtcgataactctgcattaaataaagcctgcttcnatgtgacctcaggaagtgtgacgttcgcaggaaatcatcatgggtnatattttaataatatttcctcaggaactacaaaggaaggngctgtactttgttgccaagatcctcaagcaacggcacgtttttctgggttctccacgctctcttttaatcagagccccggagatattaaagaacagggatgtctctattcaaaaaatgcacttatgctcttaaacaattatgtagtgcgttttgaacaaaaccaaagtaagactaaaggcggagctattagtggggcgaatgttactatagtaggcaactacgattccgtctctttctatcagaatgcagccacttttggaggtgctatccattcttcaggtcccctacagattgcagtaaatcaggcagagataagatttgcacaaaatactgccaagaatggttctggaggggctttgtactccgatggtgatattgatattgatcagaatgcttatgttctatttcgagaaaatgaggcattgactactgctataggtaagggaggggctgtctgttgtcttcccacttcaggaagtagtactccagttcctattgtgactttctctgacaataaacagttagtctttgaaagaaaccattccataatgggtggcggagccatttatgctaggaaacttagcatctcttcaggaggtcctactctatttatcaataatatatcatatgcaaattcgcaaaatttaggtggagctattgccattgatactggaggggagatcagtttatcagcagagaaaggaacaattacattccaaggaaaccggacgagcttaccgtttttgaatggcatccatcttttacaaaatgctaaattcctgaaattacaggcgagaaatggatactctatagaattttatgatcctattacttctgaagcagatgggtctacccaattgaatatcaacggagatcctaaaaataaagagtacacagggaccatactcttttctggagaaaagagtctagcaaacgatcctagggattttaaatctacaatccctcagaacgtcaacctgtctgcaggatacttagttattaaagagggggccgaagtcacagtttcaaaattcacgcagtctccaggatcgcatttagttttagatttaggaaccaaactgatagcctctaaggaagacattgccatcacaggcctcgcgatagatatagatagcttaagctcatcctcaacagcagctgttattaaagcaaacaccgcaaataaacagatatccgtgacggactctatagaacttatctcgcctactggcaatgcctatgaagatctcagaatgagaaattcacagacgttccctctgctctctttagagcctggagccgggggtagtgtgactgtaactgctggagatttcctaccggtaagtccccattatggttttcaaggcaattggaaattagcttggacaggaactggaaacaaagttggagaattcttctgggataaaataaattataagcctagacctgaaaaagaaggaaatttagttcctaatatcttgtgggggaatgctgtagatgtcagatccttaatgcaggttcaagagacccatgcatcgagcttacagacagatcgagggctgtggatcgatggaattgggaatctcttccatgtatctgcctccgaagacaatataaggtaccgtcataacagcggtggatatgttctatctgtaaataatgagatcacacctaagcactatacttcgatggcattttcccaactctttagtagagacaaggactatgcggtttccaacaacgaatacagaatgtatttaggatcgtatctctatcaatatacaacctccctagggaatattttccgttatgcttcgcgtaaccctaatgtaaacgtcgggattctctcaagaaggtttcttcaaaatcctcttatgatttttcattttttgtgtgcttatggtcatgccaccaatgatatgaaaacagactacgcaaatttccctatggtgaaaaacagctggagaaacaattgttgggctatagagtgcggagggagcatgcctctattggtatttgagaacggaagacttttccaaggtgccatcccatttatgaaactacaattagtttatgcttatcagggagatttcaaagagacgactgcagatggccgtagatttagtaatgggagtttaacatcgatttctgtacctctaggcatacgctttgagaagctggcactttctcaggatgtactctatgactttagtttctcctatattcctgatattttccgtaaggatccctcatgtgaagctgctctggtgattagcggagactcttggcttgttccggcagcacacgtatcaagacatgcttttgtagggagtggaacgggtcggtatcactttaacgactatactgagctcttatgtcgaggaagtatagaatgccgcccccatgctaggaattataatataaactgtggaagcaaatttcgtttttagaaggtttccattgcctgtgtggttccggatcttaactataaatcctggactatggatcataggcattgggtctctcgaacttgtgtggagaataacgacattttatatgcataacggaatactcgtatcacctcagcccctagagacattctttaggggttctttatttgtctaaacttcgtattttatcgagaatcctttacgttcttggtttgcttgtctccgaggagttctctaacgaatcatagggattccagggttctgttccttgagtcctttggcagctgatttgcgtctttctcaggagtagagcgtgtggtttcagggcttgggactcctagtaagacgagccattctgatagcctctctaggagagcgcttcgaagaggttcctgcaactgcttctaagtaaaaatttaaagagaagtctagttttttcgatacattgacttcttttttgaaaccagacactcattgctagccgaattttaagagtccatgagcatgatttctgtaaaatcctcgcaatgagctttttgtcttctcaccttatgatgtgctttctataagtatttaaatgaacttttattaaaagagttttcgctataacctttcgctcattttttcctttcttgtcgtgataccgctaactgatagcactacaagctctctttcaacgtctctcttagatgaaggaaacccacaatccatgaggaaacttcgtattcttgcgatcgttctcatagctttgagcattattttgattgcaggtggtgtggtattgcttactgtagcgatccctggattaagttcagtcatttcttccccggcagggatgggtgcctgtgctttgggatgtgtgatgcttgctttagggatcgatgttcttctgaagaaacgagaagtccctatagttctcgcatctgtaactacgacaccaggaactggcagccctagaagtggtatttctatttcaggagctgatagcaccatacgttctcttcctacgtatctcttggacgagggacatccacaatccatgaggaaacttcgtattcttgcgatcgttctcatagtttttagcattattttgattgcaagtggtgtggtattgcttactgtagcgatccctggattaagttcagtcatttcttccccggcagggatgggtgcctgtgctttgggatgtgtgatgcttgctttagggatcgatgttcttctgaagaaacgagaagtccctatagttctcgcatctgtaactacgacaccaggaactggcagccctagaagtggtatttctatttcaggagctgatagcaccatacgttctcttcctacgtatcccttggacgagggacatccacaatccatgaggaaacttcgtattcttgcgatcgttctcatagtttttagcattattttgattgcaagtggtgtggtattgcttactgtagcgatccctggattaagctcgatcatttcttccccagcggagatgggtgcttgtgctttgggatgtgtgatgcttgctttggggatcgacgttcttctgaagaaacgagaagtccctatagtagttcccgcacctattcctgaagaagtcgtcatagatgatatagatgaagagagtatacggctgcagcaggaagctgaagccgctttagcaagacttcctgaggagatgagtgcatttgaaggttacataaaagttgtcgagagtcatttggagaacatgaaaagcctgccttatgatggtcatgggctagaagagaaaacgaaacatcagataagagtcgtcagatcttctttgaaggctatggttccagaatttttagatatcagaagaatttttgaagaagaagagttcttttttctctcagctcgcaaacgacttatagatttagctactactttagtagagagaaaaattttaacagagcaacttgagcgcaataatttaaggaaagcgttttcttatttatatcaggactcaatttttaaaaaaattattgataacttcgagaagttagcatggaaatttatgattttgagtaaatcaatttgtcgatttacaattatttttgaaaatcatgaacatggtgtagcaaagagcctgttacacaagaatgcagtgttactggagaaggtaatctataggagtttgcaaaaaagctatagagatataggcatgtcatctgcaaagatgaaaatcttgcacggcaacccttttttctctttggaagataataaaaagacgataatgaaagaacacgcagagatgcttgaaagtctcagtagctataggaaggtatttttagctctatctgatgagaacgttgtagatacacctagcgatccaaagaaatgggatttgtcaggaatcccctgtagggacgcgttgtctgagatttctcgtgatgaacagtggcagaagaaagcacatctaaagcatcaagagtccctctatacgcaagctagggatcgtttaacagaccagagctctaaagaaaatcagaaagagttagagaaagctgaacaagagtacatatcttcttgggaacgggttaaaaaatttgagattgagagagtacaggagaggatacaggcaattcaaaagctttatcctaatatcctcgagagagaagaagaaaccacaggtcaggagactgtgactccaactgttcaagggacgacggcttcatccgatttaacagatattttaggaagaatagaggtctccagtagggaggataatcagaatcaagagtcttgtgtaaaagtcttaagaagtcatgaggtagaaatgagctgggaagtcaaacaagagtatggccctaagaaaaaagaatttcaggatcaaatgggttctttagagaggttttttacagagcatattgaagagttagaagtattacagaaggactactctaaacacttgtcttattttaaaaaagtaaacaataagaaagaggttcaatatgcgaagtttaggttgaaggttttagagtcagatttagaagggattctagctcagactgagagtgctgagagtctgttaactcaagaagaacttccgattcttgcaactcggggagccttagagaaagctgttttcaaagggagtctatgttgcgcgctagcaagcaaagcaaaaccctattttgaagaggatcccagattccaagattctgatacgcaattgcgagctctgactctaaggttacaggaggctaaggcaagcctggaagaagagataaagagattttcaaatcttgagaacgatattgcagaggaaagacgccttcttaaagagagcaagcagacgttcgaaagagcaggtttaggggttctccgagaaattgcagtcgagtctacttatgatttgcgttccttaacaaatacatgggaagggaccccagagagtgagaaggtctattttagcatgtatcttaattattacaacgaagagaaacgtagggnnaaaacaagattggttgaaatgacacagaggtatagagattttaaaatggccttggaagctatgcagtttaatgaagaagcccttttgcaagaggaactctctattcaagctcccagtgaataacaagaatccgaggcaagagctcggcatgtcgctcgctataggctacgagttgcccaatctcgtttggctgatttagaagctggagtcatccagaaacgtaaaacaatcaaagatttgttcaagaaacgacagtctcaaccttcttctaagaaatagaaaatttcgtccatgcttccagggttttgaaatgagaaaaagaccttggaataaaataattgatatgagtagcttagttgctttaacttatgtttttgagcatgatgacatcacagattcataatgcaagtattcttatctcctcaactaccccccccccccccgacgctctctaggggtttcttgttctaaacttcgtagtttatcgatcactcttttagttcttggtgtgcttttgttgaccttggggattccgggactcactgcagggatctcttttggagccggtttgggattttctgctttaggaggagtgctcgtgatttcgggacttctattccttctagtaagacgagaggttccgacagtacgttcagaggaaattcccagaggggtttctgtgaccccttctgaagagcctgctctagagaaggctcaaaaagaaccggagacaaagaaaattttagatcggttgccgaaggaattggatcagttagatacgtatattcaggaagtgtttgcatgtttagagaggctgaaggatcctaagtacgaagatcgaggtcttttaacagaggcgaaggagaaacttcgagtttttgacgttgttgagaaagatatgatgtcagagtttttagacatacaacgagtgttgaatgaggaagcatattatgtagaacattgtcaagatcccctagagaatatagcctacgagattttctcttcccaagagcttcgtgactactactgtgcaggggtgtgtgggtatttgccttctggggatgctcgagcggatcgattaaagagatcagttaaggaggtaatggatcgctttatgagggtgacctggaaatcttgggaggcatcagtcatgttggatcatagctatggggtagcgcgagagttattcaagaaggcagtaggagtactagaggagagtgtctataaaattctgtttaagagctatagagatgcgttttatgaatgtgagaaggcaaagatccagagggatgggcgtttcaaatggttataggatacgagtgctcatgcggaacaaaggtttagggatatcaatggttgttgggaggacttaaagcaaacgatcttttgggtaggagaacatgattgtacggacatagagaccgtacgtaaaagctgtatgtggctggatcgttatgcagataaatttattttgagggaaaaagaggaaaagatggagcgtcatgagctctttcatgcgactatggtccgaaaagcatctgggcacgcgtatgctaaagctaaagcagcctttgaaaaggagagatctaatgagaatcagaggaaagtcaaggatgttgaaaaatggttatctaaaggtttagcggagtttcgtaatcaagagtctcgcagagctcgggagaggctgagagagctgcaaactttgtatcctgaggtttctgtagaagagagagtgttagagagacaaaggactaaaaaagttaatctggagaacttgtatgcagatatagaaaagaagtatcaccactgtgttcgagagcaagagcattactggaaagaggtagagaacaaggaagcagagtatagggagaacggagaaaaggttctctctgccgaggaggtgtcagagtgtcttcagaggttggaagattgtttagagacgtggtctaagaaattaacaaaagcggaagagagtgtctttgagatgaagtttgatgcgacagaaaaactagggaataaagtactttctgatgtaacgaaccgtcttgagattttatgtgaagatgctgaggagatgatttttcgaatcgaagagatagagatgactctgcgtatggtagagcttccactactttttatgaaaaatacttttgagaaagcctctctacaatacaacagctgcaaagagatgttagccaaagtagagccccaatgtaaggaaagcccaacctatagaagtagccaagagcgcttagaaaggttgaatcaggatttacaaacagcatatacaaattgccaggagagactccagggtttttcagatttggaatcaaaagtacgtacatgtagagatcatcttagagagcagatgaaacatttcgaagttcaaggactgaattttataaacgaagagcttttatgggtcggggcagagctctttacacaagccagattggatctagtagcaacagttccgtatatggagttctatttgcagtaccataatattaaaagagaaaaagttcgatcccaatggatggcgaagaccgagaggtatagagagattcggcaggcatttcaaggggtgatgaaggaagatttgttagcagaagatacgatcttgaaagaagaagattattggctgcttcgcgatgattggttgctgcgtgatgagaggaagaatagacaaagacgtttaatctgtaataagatagcagcagcgcaacagcgagtcaaaggcttctaacctgaagagatttaaaagatcctgaaagagaaaacacctcttgtggctagagtgcgttctttatttactcgcgaggaccatacctagcataaaactccaggagctgtgtttctttaaaattctttgaataaaatactatatattagtagcttagtgggtttaatttatgtgtttgatcgcgatggcaccacagattcataatgcaagtacttctatctccgcagctacccccccccccaacactctgtagggtcgatttcttctccatctaaacttcgcgttttagcgattacttttttagtttttggtatgctcttactgatttcaggagctctctttctgacgttagggattccaggattgagtgcagcaatttcttttggattaggcatcggtctctccgcattaggaggagtgctgatgatttcgggactactatgtcttttagtaaaacgagagattccgacagtacgaccagaagaaattcctgaaggggtttcgctggctccttctgaggagccagctctacaggcagctcagaagactttagctcagctgcctaaggaattggatcagttagatacagatattcaggaagtgttcgcatgtttaagaaagctgaaagattctaagtatgaaagtcgaagttttttaaacgatgctaagaaggagcttcgagtttttgactttgtggttgaggataccctctcggagattttcgagttgcggcagattgtggctcaagagggatgggatttaaactttttgatcaatgggggacgaagcctcatgatgactgcagaatctgaatcgcttgatttgtttcatgtatcgaagcggctagggtatttaccttctggggatgttcgaggggaggggttaaagaaatctgcgaaggagatagtcgctcgtttgatgagcttgcattgcgagattcacaaggtggcggtagcgtttgataggaattcctatgcgatggcagaaaaggcgtttgcgaaagcgttgggagctttagaagagagtgtgtatcggagtctgacgcagagttatagagataaatttttggagagtgagagggcgaagatcccatggaatgggcatataacctggttaagagatgatgcgaagagtgggtgtgctgaaaagaagcttcgggatgccgaggaacgttggaagaaatttaggaaagcagtcttttgggtagaagaagacgggggctttgacatcaataatctccttggagactgggggacagtgcttgatccttatagacaagagagaatggacgagataacgttccatgagttgtatgaaaaaactacgtttttgaaaagactgcacagaaagtgtgcgttagcgaaaacaacctttgaaaagaagagatctaaaaagaatttgcaggcagtcgaggaggcgaatgcacgtaggttgaaatatgtaagggattggtatgatcaggagtttcagaaagcaggggagagattagagaaactgcatgctttgtatcctgaggtttcagtctctataagagagaacaaaatacaagagacgcgctctaatttagagaaagcctatgaggctatcgaagagaactatcgttgctgtgtccgagagcaagaggactactggaaagaagaagagaaaagggaagcggagtttagggagaggggaaacaagattctttctcctgaggagctggaaagttctttggagcaattcgaccatggtttgaaaaatttttctgagaaattaatggaattggaagggcatatcttaaaacttcagaaagaagccacagcagaggtggagaataaaatactttcagatgcagagagccgccttgagattgtatttgaagatgtcaaggagatgccctgtcgaattgaggagatagagaagacgctgcgtatggcggagctgcccctacttcctacgaagaaggcgtttgagaaggcctgctcacaatataatagctgcgcagagatgttggagaaggtgaagccttactgcaaggagagcctcgcctatgtgactagcaaagagcgtttagtgagcttggatgaagatttacgacgagcctacacagagtgtcagaagagattccagggggattcgggtttggagtcggaagtaagagcctgtcgagagcaactgcgagagcggatccaagagtttgaaactcaagggctggacttggtggaaaaagagttgctttgtgtgagtagtagattaagaaatacagagtgcgattgtgtatctggtgttaagaaagaagcacctcctggtaagaagttttatgcccagtattatgatgagatttatcgagttagagttcaatcccgatggatgacgatgtctgagagattgagagagggagttcaagcatgcaacaagatgttgaaggcaggcctaagcgaagaagataaggttcttaaagaagaagagtattggttgtatcgagaggagagaaagaataaagagaaacgtttggttggtactaagatagtagcaacgcagcagcgagttgcagcatttgaatccatagaagttcctgagattcctgaggccccagaggagaaaccgagtttgctggataaagcgcgttctttatttactcgcgaggaccattcctagaactattctaggagtctatgtgcactattttttaagaggtttattattccgtgggtatgtctgagagactttgattaaatgggatattattatatcctagttgctctaatcaatattcctcttatgattttggtattcgatcatgactgcagcaccagctattctacacgtatccccgacgccccctgaagaaacaaaattcgttattcctaaagatagtaaatctcgcgctcttgggattactttattagtcgtaggcatccttctggtagtttgtggtgcgattgtactcagtggagtgatttctggattgagtgcactcattgtttgtggattgggtattagtacgatttctctaggagttgtcctatttgttttaggattgatattattacttagaaagcgggaacttaccttagaacagatcgaggctaagcaaattgcggagacctttgctgatgaactgaaagaactagaaatgtacattcagtcgacagagaaaagcttagagaagatagaagggtcccgttatagtgaccaaggttttctgaatcgtgccacccaaaaaatcttagatttagaatcttcattgagctctattacttctgagtttcgtgatcttaggcaactctttgatgaagaaaaaatagagttactttctggagaaaggcttttagaatttattgcagcgaatttatttaaacaaggaagagatgtctatttaaatttagggaatttagcagacattcgtgcgtacatggggcccaacaattataaagttgcgatggtcatagaaaaagctaaagcagttgtgcatgagtttatagttctgactacaatggctagggaattagagttttttttctaaaaaataaatatggtttattaaaggggatgtaccaggagaatctaagattgttggaaaggcttctttataatagtgttcaaaagagctatgcggatcggctgttttcctatgaaaagacaaagatggtgcacgatactccgctgattccttgggaagaggataaggaaaaatgtgctgaagctgagaaagctttcttagagcaacagaagattctcctagattatggaaaatctatcttttggctgaatgagaacgatgagatcaatttaaacgatccttggagttggggtcttaatacggtgaggactaggaaagtattccaagaggttgacgacagtgaacgttggaatcataaggtactcattcaaaaactcgaggacgattatgagaaacttctagaggaaagttcaaaagagtctactgaagcaaataagaagcttttatctgacttagtagatcgtcttgaagatgctaagacaaaatttttcctgaagaaacaggaggaggtggagactcgcgttaaggatcttagagctcgatatggaggcacagtagatcctaagcaggatacggaagctaagaagaaagtcgaattggaggctagcttagaaacctttttagattccatcgaatcagagctagtacagtgtttagaagatcaagatatatattggaaagaacaggatgtcaaagatctagcacgtacgcaagagctcgaggaacaagatattgaagcgaagagggaagaagctgccgaagacctaagaaagtcttaatgagcgtttaaagaagtcaaaaactatgttagatagggctaaatggcatattgaaaatgctgaggacagtattacctggtggactagtcagatagaaatgaaggatatgaaagcaagactgaagatcttaaaagaagatataacaagtgttctacctgaaatagatgagattgaaacgtgtttaagcttagaggagcttcctttgcttacgaccagggaactcttaactaagtcctacctaaagtttaagatttgttcggaaacactattaaaaatgacttctgtgtttgagaacaatatctatgttcaggagtacgaggttcagctgcaaaatctagggtttaagttacaaggtatatctcagagattcggaaagaaacaagacgattttgcgaatctagaggaacaggttgctttgcaaaagaaacgactcagagagctcactcagaattttgaaatacaaggattcaatttcatgaaagaagattttaaggcagccgctaaagatctttatataagaagtacagctgaacaaaagatgaactttgatgtgccttgcatggagctcttccgtaggtatcatgaggaggtcaacaagccgcttcttgagttgatgtacaattgtgcagacagttatagagatgctaagaaaaagctttgctctctacgtcttgatgaaaaagagttattacaaaaagaaatcaagaaagaggaattttatcaaaagaaacaacaaaggcatgcagatagatcacgtcatactaggtatcaaaagctacgaattgctgaagagcttgctcttgagctgaagaagaaaatctaatcactaaagcctagttaagggttcttttgaattgggccctgtgtttccatttctctagggatcctcttagctgaggatcttctttgtacctcttttgattcgaaaagaggtgctattgtgagttgccaatagcaacgatccaccttcgtttttgaaaagatacatcagttgctaagggaacttttcagaaaatatcataaaaaactcccaagattttggcttggaaagcgagcctttcttgctacttttgttacaacaaaagtgttctattttaacgtgcgtatcatttgtgactaagagatagacttgctttctttatctaatcttctgtattggaaagaaagccccttgagggaaaaaaaggttgttatgaagattccactccgctttttattgatatcattagtacctacgctttctatgtcgaatttattaggagctgctactaccgaagagttatcggctagcaatagcttcgatggaactacatcaacaacaagcttttctagtaaaacatcatcggctacagatggcaccaattatgtttttaaagattctgtagttatagaaaatgtacccaaaacaggggaaactcagtctactagttgttttaaaaatgacgctgcagctggagatctaaatttcttaggagggggattttctttcacatttagcaatatcgatgcaaccacggcttctggagctgctattggaagtgaagcagctaataagacagtcacgttatcaggattttcggcactttcttttcttaaatccccagcaagtacagtgactaatggattgggagctatcaatgttaaagggaatttaagcctattggataatgataaggtattgattcaggacaatttctcaacaggagatggcggacaattaattgtgcaggctccttgaagatcgcaaacaataagtccctttcttttattggaaatagttcttcaacacgtggcggagcgattcataccaaaaacctcacactatcttctggtggggaaactctatttcaggggaatacagcgcctacggctgctggtaaaggaggtgctatcgcgattgcagactctggcaccctatccatttctggagacagtggcgacattatctttgaaggcaatacgataggagctacaggaaccgtctctcatagtgctattgatttaggaactagcgctaagataactgcgttacgtgctgcgcaaggacatacgatatacttttatgatccgattactgtaacaggatcgacatctgttgctgatgctctcaatattaatagccctgatactggagataacaaagagtatacgggaaccatagtcttttctggagagaagctcacggaggcagaagctaaagatgagaagaaccgcacttctaaattacttcaaaatgttgcttttaaaaatgggactgtagttttgaaaaggtgatgtcgttttaagtgcgaacggtttctctcaggatgcaaactctaagttgattatggatttagggacgtcgttggttgcaaacaccgaaagtatcgagttaacgaatttggaaattaatatagactctctcaggaacgggaaaaagataaaactcagtgctgccacagctcagaaagatattcgtatagatcgtcctgttgtactggcaattagcgatgagagtttttatcaaaatggctttttgaatgaggaccattcctatgatgggattcttgagttagatgctgggaaagacatcgtgatttctgcagattctcgcagtatagatgctgtacaatctccgtatggctatcagggaaagtggacgatcaattggtctactgatgataagaaagctacggtttcttgggcgaagcagagttttaatcccactgctgagcaggaggctccgttagttcctaatcttctttggggttcttttatagatgttcgttccttccagaattttatagagctaggtactgaaggtgctccttacgaaaagagattttgggttgcaggcatttccaatgttttgcataggagcggtcgtgaaaatcaaaggaaattccgtcatgtgagtggaggtgctgtagtaggtgctagcacgaggatgccgggtggtgataccttgtctctgggttttgctcagctctttgcgcgtgacaaagactactttatgaataccaatttcgcaaagacctacgcaggatctttacgtttgcagcacgatgcttccctatactctgtggtgagtatccttttaggagagggaggactccgcgagatcctgttgccttatgtttccaagactctgccgtgctctttctatgggcagcttagctacggccatacggatcatcgcatgaagaccgagtctctaccccccccccccccgacgctctcgacggatcatacttcttggggaggatatgtctgggctggagagctgggaactcgagttgctgttgaaaataccagcggcagaggatttttccaagagtacactccatttgtaaaagtccaagctgtttacgctcgccaagatagctttgtagaactaggagctatcagtcgtgattttagtgattcgcatctttataaccttgcgattcctcttggaatcaagttagagaaacggtttgcagagcaatattatcatgttgtagcgatgtattctccagatgtttgtcgtagtaaccccaaatgtacgactaccctactttccaaccaagggagttggaagaccaaaggttcgaacttagcaagacaggctggtattgttcaggcctcaggttttcgatctttgggagctgcagcagagcttttcgggaactttggctttgaatggcggggatcttctcgtagctataatgtagatgcgggtagcaaaatcaaattttagcgatttctctttcgatgctatttttccatggctatttttaaaatgatagccatggttatagatacgtagtccttatttcaaagaagacactgttgcattagatacgctctctgatccctcaaaatcacattttggtatctgattgctaagattgcaggataccacgcatcttaagagaaaggcgctcttacctagtagaggttgagtgaatttcttgacttgtttctcctattggtgtatctcttaaaatattaaattcaaaatcaaagtatatattttacaatgaagtcttctttccccaagtttgtattttctacatttgctattttccctttgtctatgattgctaccgagacagttttggattcaagtgcgagtttcgatgggaataaaaatggtaatttttcagttcgtgagagtcaggaagatgctggaactacctacctatttaagggaaatgtcactctagaaaatattcctggaacaggcacagcaatcacaaaaagctgttttaacaacactaagggcgatttgactttcacaggtaacgggaactctctattgttccaaacggtggatgcagggactgtagcaggggctgctgttaacagcagcgtggtagataaatctaccacgtttatagggttttcttcgctatcttttattgcgtctcctggaagttcgataactaccggcaaaggagccgttagctgctctacgggtagcttgagtttgacaaaaatgtcagtttgctcttcagcaaaaacttttcaacggataatggcggtgctatcaccgcaaaaactctttcattaacagggactacaatgtcagctctgttttctgaaaatacctcctcaaagaaaggcggagccattcagacttccgatgcccttaccattactggaaaccaaggggaagtctctttttctgacaatacttcttcggattctggagctgcaatttttacagaagcctcggtgactatttctaataatgctaaagtttcctttattgacaataaggtcacaggagcgagctcctcaacaacgggggatatgtcaggaggtgctatctgtgcttataaaactagtacagatactaaggtcaccctcactggaaatcagatgttactcttcagcaacaatacatcgacaacagcgggaggagctatctatgtgaaaaagctcgaactggcttccggaggacttaccctattcagtagaaatagtgtcaatggaggtacagctcctaaaggtggagccatagctatcgaagatagtggggaattgagtttatccgccgatagtggtgacattgtctttttagggaatacagtcacttctactactcctgggacgaatagaagtagtatcgacttaggaacgagtgcaaagatgacagctttgcgttctgctgctggtagagccatctacttctatgatcccataactacaggatcatccacaacagttacagatgtcttaaaagttaatgagactccggcagattctgcactacaatatacagggaacatcatcttcacaggagaaaagttatcagagacagaggccgcagattctaaaaatcttacttcgaagctactacagcctgtaactctttcaggaggtactctatctttaaaacatggagtgactctgcagactcaggcattcactcaacaggcagattctcgtctcgaaatggacgtaggaactactctagaacctgctgatactagcaccataaacaatttggtcattaacatcagttctatagacggtgcaaagaaggcaaaaatagaaaccaaagctacgtcaaaaaatctgactttatctggaaccatcactttattggacccgacgggcacgttttatgaaaatcatagtttaagaaatcctcagtcctacgacatcttagagctcaaagcttctggaactgtaacaagcaccgcagtgactccagatcctataatgggtgagaaattccattacggctatcagggaacttggggcccaattgtttgggggacaggggcttctacgactgcaaccttcaactggactaaaactggctatattcctaatcccgagcgtatcggctctttagtccctaatagcttatggaatgcatttatagatattagctctctccattatcttatggagactgcaaacgaagggttgcagggagaccgtgctttttggtgtgctggattatctaacttcttccataaggatagtacaaaaacacgacgcgggtttcgccatttgagtggcggttatgtcataggaggaaacctacatacttgttcagataagattcttagtgctgcattttgtcagctctttggaagagatagagactactttgtagctaagaatcaaaggtacagtctacggaggaactctctattaccagcacaacgaaacctatatctctcttccttgcaaactacggccttgttcgttgtcttatgttcctacagagattcctgttctcttttcaggaaaccttagctacacccatacggataacgatctgaaaaccaagtatacaacatatcctactgttaaaggaagctgggggaatgatagtttcgctttagaattcggtggaagagctccgatttgcttagatgaaagtgctctatttgagcagtacatgcccttcatgaaattgcagtttgtctatgcacatcaggaaggttttaaagaacagggaacagaagctcgtgaatttggaagtagccgtcttgtgaatcttgccttacctatcgggatccgatttgataaggaatcagactgccaagatgcaacgtacaatctaactcttggttatactgtggatcttgttcgtagtaaccccgactgtacgacaacactgcgaattagcggtgattcttggaaaactttcggtacgaatttggcaagacaagctttagtccttcgtgcagggaaccatttttgctttaactcaaattttgaagcctttagccaattttcttttgaattgcgtgggtcatctcgcaattacaatgtagacttaggagcaaaataccaattctaatgcgttagctttggtaaagagctccatacatcgaagggaaaagagcttttaagatttcttgaaggctcttttcgatttcgatttccattttagtgttttgctaaaacactttctaatttttttcttttgttttctacattgaaaaaaagagagttacggcagctgtaaagtttttaatattgctccctttgttccatttatgtagcgttcagactttgcactaaaacgagggtgtcatatgagatcgtctttttccttgttattaatatcttcatctctagcctttcctctcttaatgagtgtttctgcagatgctgccgatctcacattagggagtcgtgacagttataatggtgatacaagcaccacagaatttactcctaaagcggcaacttctgatgctagtggcacgacctatattctcgatggggatgtctcgataagccaagcagggaaacaaacgagcttaaccacaagttgtttttctaacaccgcaggaaatcttaccttcttagggaacggattttctcttcattttgacaatattatttcgtctactgttgcaggtgttgttgttagcaatacagcagcttctgggattacgaaattctcaggattttcaactcttcggatgcttgcagctcctaggaccacaggtaaaggagccattaaaattaccgatggtctggtgtttgagagtatagggaatcttgatcttaatgaaaatgcctctagtgaaaatgggggagccatcaatacgaagactttgtctttgactgggagtacgcggtttgtagcgttccttggcaatagctcgtcgcaacaagggggagcgatctatgcttctggtgactctgtgatttctgagaatgcaggaatcttgagcttcggaaacaacagtgcgacaacatcaggaggcgcgatctctgctgaagggaaccttgtgatctccaataaccaaaatatctttttcgatggctgcaaagcaactacaaatggcggagctattgattgtaacaaagcaggggcgaacccagaccctatcttgactctttcaggaaatgagagcctgcattttctgaataacacagcaggaaatagtggaggtgcgatttataccaaaaaattggtgttatcctcaggacgaggaggagtgttattttctaacaacaaagctgcgaatgctactcctaaaggaggggcaattgcgattctagattctggagagattagcatttctgcagatctcggcaatatcattttcgagggcaatactacgagcactacaggaagtcctgcgagtgtgaccagaaatgctatagatcttgcatcgaatgcaaaatttttaaatctccgagcgactcggggaaataaagttattttctatgatcctatcacgagctcaggagctactgataagctctctttgaataaagctgacgcaggatctggaaatacctatgaaggctacatcgttttctctggagagaaactctcagaagtaagaaacctgacaatctgaagtctacatttacacaggctgtagagcttgctgcaggtgccttagtattgaaagatggagtgactgtagttgcaaatactataacgcaggtcgagggatcgaaagtcgttatggatggagggactacttttgaggcaagcgctgagggggtcactctcaatggcctagccattaatatagattccttagatgggacaaataaagctatcattaaggcgacggcagcaagtaaggatgttgccttatcagggcctatcatgcttgtagatgctcaggggaactattatgagcatcataatctcagtcaacagcaggtctttgccttaatagagctttctgcacaaggaacgatgactactacagatatccccgataccccaattctaaatactacgaatcactatggtatcaagggaactggaataattgtttgggtcgacgatgcaactgcaaaaacaaaaaatgctaccttaacttggactaaaacaggatacaagccgaatccagaacgtcagggacctttggttcctaatagcctgtggggttcttttgtcgatgtccgctccattcagagcctcatggaccggagcacaagttcgttatcttcgtcaacaaatttgtgggtatcaggaatcgcggactttttgcatgaagatcagaaaggaaaccaacgtagttatcgtcattctagcgcgggttatgcattaggaggaggattcttcacggcttctgaaaatttctttaattttgctttttgtcagctttttggctacgacaaggaccatcttgtggctaagaaccatacccatgtatatgcaggggcaatgagttaccgacacctcggagagtctaagaccctcgctaagattttgtcaggaaattctgactccctaccttttgtcttcaatgctcggtttgcttatggccataccgacaataacatgaccacaaagtacactggctattctcctgttaagggaagctggggaaatgatgccttcggtatagaatgtggaggagctatcccggtagttgcttcaggacgtcggtcttgggtggatacccacacgccatttctaaacctagagatgatctatgcacatcagaatgactttaaggaaaacggcacagaaggccgttctttccaaagtgaagacctcttcaatctagcggttcctgtagggataaaatttgagaaattctccgataagtctacgtatgatctctccatagcttacgttcccgatgtgattcgtaatgatccaggctgcacgacaactcttatggtttctggggattcttggtcgacatgtggtacaagcttgtctagacaagctcttcttgtacgtgctggaaatcatcatgcctttgcttcaaactttgaagttttcagtcagtttgaagtcgagttgcgaggttcttctcgtagctatgctatcgatcttggaggaagattcggattttaatcctaagttttccaacgagatagcatcagggtaagccagggctctatgtaagagatttcatagagccctctctttgtcttgctttttgtattttatttttatatttcgtgaatccgttgttccaatgttcgaaaggtatcctagatgagattgctgttgtcttgtcctatgctttttatagctgcatgtgcctcattttttggctttcaggaagaaatgcaaggcagaaatatacaatctcttgatgcaaatgcttctagtctaggggaacttttttctatttctacgaagggagtgtcttgtctagaactccatagggagatcgcacgctaaatatgagaatataatatgaagacttcagtttctatgttgttggccctgctttgctcgggggctagctctattgtactccatgccgcaaccactccactaaatcctgaagatgggtttattggggagggcaatacaaatactttttctccgaaatctacaacggatgctgcaggaactacctactctctcacaggagaggttctgtatatagatccggggaaaggtggttcaattacaggaacttgctttgtagaaactgctggcgatcttacatttttaggtaatggaaataccctaaagttcctgtcggtagatgcaggtgctaatatcgcggttgctcatgtacaaggaagtaagaatttaagcttcacagatttcctttctctggtgatcacagaatctccaaaatccgctgttactacaggaaaaggtagcctagtcagtttaggtgcagtccaactgcaagatataaacactctagttcttacaagcaatgcctctgtcgaagatggtggcgtgattaaaggaaactcctgcttgattcagggaatcaaaaatagtgcgatttttggacaaaatacatcttcgaaaaaaggaggggcgatctccacgactcaaggacttaccatagagaataacttagggacgctaaagttcaatgaaaacaaagcagtgacctcaggaggcgccttagatttaggagccgcgtctacattcactgcgaaccatgagttgatattttcacaaaataagacttctgggaatgctgcaaatggcggagccataaattgctcaggggaccttacatttactgataacacttctttgttacttcaagaaaatagcacaatgcaggatggtggagctttgtgtagcacaggaaccataagcattaccggtagtgattctatcaatgtgataggaaatacttcaggacaaaaaggaggagcgatttctgcagcttctctcaagattttgggagggcagggaggcgctctcttttctaataacgtagtgactcatgccacccctctaggaggtgccatttttatcaacacaggaggatccttgcagctcttcactcaaggaggggatatcgtattcgaggggaatcaggtcactacaacagctccaaatgctaccactaagagaaatgtaattcacctcgagagcaccgcgaagtggacgggacttgctgcaagtcaaggtaacgctatctatttctatgatcccattaccaccaacgatacgggagcaagcgataacttacgtatcaatgaggtcagtgcaaatcaaaagctctcgggatctatagtattttctggagagagattgtcgacagcagaagctatagctgaaaatcttacttcgaggatcaaccagcctgtcactttagtagaggggagcttagtacttaaacagggagtgaccttgatcacacagggattctcgcaggagccagaatccacgcttcttttggatctggggacctcattataagcttctacagaagatattgtcatcacaaatttatctataaatgccgataccatttacggaaagaatcctatcaatattgtagcttcagcagcgaataagaacattaccctaacaggaaccttagcacttgtaaatgcagatggagctttctatgagaaccataccttgcaagactctcaagactatagctttgtaaagttatctccaggagcgggagggactataattactcaagatgcttctcagaagcctcttgaagtagctccttctagaccacattatggctatcaaggacattggaatgtgcaagtcatcccaggaacgggaactcaaccgagccaggcaaatttagaatgggtgcggacaggataccttccgaatcccgaacggcaaggatctttagttcccaatagcctgtggggttcttttgttgatcagcgtgctatccaagaaatcatggtaaatagtagccaaatcttatgtcaggaacggggagtctggggagctggaattgctaatttcctacatagagataaaattaatgagcaccgctatcgccatagcggtgtcggttatcttgtgggagttggcactcatgctttttctgatgctacgataaatgcggctttttgccagctcttcagtagagataaagactacgtagtatccaaaaatcatggaactagctactcaggggtcgtatttcttgaggataccctagagtttagaagtccacagggattctatactgatagctcctcagaagcttgctgtaaccaagtcgtcactatagatatgcagttgtcttacagccatagaaataatgatatgaaaaccaaatacacgacatatccagaagctcagggatcttgggcaaatgatgtttttggtcttgagtttggagcgactacatactactaccctaacagtacttttttatttgattactactctccgtttctcaggctgcagtgcacctatgctcaccaggaagacttcaaagagacaggaggtgaggttcgtcactttactagcggagatcttttcaatttagcagttcctattggcgtgaagtttgagagattttcagactgtaaaaggggatcttatgaacttacctttgcttatgttcctgatgtgattcgcaaagatcccaagagcacggcaacattggctagtggagctacgtggagcacccacggaaacaatctctccagacaaggattacaactgcgtttagggaaccactgtctcataaatcctggaattgaggtgttcagtcacggagctattgaattgcggggatcctctcgtaattataacatcaatctcgggggtaaataccgattttaatagggaactgagagttccttattgtagagagtatttacaaggattttgagacgaaagagatttcttgttgtaggtatctctccacagggtctagttcaatttctatagttcatggggtttctttttttataaagaagaaaccccatgtctgacgagacctcacctggatctattgcattctctatggtaagggatccatgacttgacacaggaggttcattctcatgtctaagtcagaggttagaagggaggttttttaaggtttgtcgagctttaagaagaagaaaaatcgactatctgcttctcggcgttcatacaccccatagagctgccaatgttcgaagatcttcgtccctagaatcatctggtattctaggtagttcggagtgtcctgcgatgccagccatagcgtaaggataagcggtaattccaacagggatgaggtcgtacaaataatttccctaaaatgagattcctatgatcagagagaggggagtctaaaagctggtcaatgggacggctgacatctaaaatgaagttctccctgtcacacttaatcaggctgtatttgcttctatgcagggattctagagtcatagccacattgtcatttccgatccactcccaacgtatgttcatgtgatcccaacagtgctttttccaaatccattcagcatctaaggagactgtatttttctttccaaaaggtagagatagctcgcatgcagttttgggaaacgtgggtttgctttctgtattgctcaagatgtgggtagtccacagcttcgcatggattctcgggaatcgagggttagtcttactcagtaccgaggtatctatacccgctttcagaaggtttaaggagtgaaaggcatcttgaatggaaaagatataatgatcttcattcttagctagaggacgagtctctgtaatgaaggtaacgaacggctctataatatggcgtctttgaatgtaggacttatgtaatagaaagcgataatcaagttgtagcttcgcggaaagctgactatggcgcgaggagatctcaggaacatcgctatagtaaatcagagaactccctagggtggaggagagcgttcctataggtagaggcacagttttatggagcttagggcgcgcagcaagacgtagtgaagagaaattctcgccaacgatatgatcgctaaaagcaaagtttaaatacccacattctacgatgttttcaaggtacactcccgtattataaatagaaatcgggtactgccttaatgttaaataagggagctcttggttggcattttggaaagagtttaccttaacagaagaggtgagatacccttcaaaatagttgtcattccaagtgcaatcgacacgtgtggggcctgtatttttcaacatgaagttgttggggaaaatgtcagcaacagtttcccaactatcgctgagatggtattctccagaaaaatttacatgcttatgcgtgaagcagaaatctccgtgtaggcgatagcgatcatgagcttctgccatatcgatagcaaggcggtgggcataatagcttttcatattgaagacattctcaggaacctgcttctgagaacaatggaggttgaatcccatgccgacgccatgcttgaaaaagctatccaagaaaaatgtcgaggagaaatgcttcctagaaatcggcgagtagctcatccccaaataggatcccagaaatcctcctgttcctcctcgaaagtttatcggaggcttagggatctccataggcatgatagaaaatggaggtaagaaaagtatcggaatgcgacacacccttaatgttgtcttccctatagaaagaagactatctgaagaatattccaggtaatctccggagaggcacaggtcttttttgggaccctcggaggtagagatatatcccttccgaatgactatggtttctggggttagagtgatcatagacccccctagaaaccaaggatacatcgcgaatcttccattagtaagaagacaagagtctgtatcttcgtaatactctaggtaatcacaaactagggtttttgccctatagttcaccataacattgccatgtgcgacaagcttcaggctttgacccacagtattttctacatacactttattggcttgtatccgcaggttgttatggatattcaataccccatcttcgatggtcacaatcccagaaacactcttaaagtgactaagataggagtttttctttttcacagcctcttgatgagtcaaagcatcagctgaggaacccataagaacaaaggaagctagaaataagaagcaacgtttcataagacgtaggttggggttactccacaatttttatgagtaagcctgcaaggactgggaaattttttgcatctccttccgtcatcagttgtatcaataaacggatatcttcggaagacttcgaggtggctagtgtctctagaatatccaacatgagcttcgtacggctttctggggtgacctgataacgtagatagggcatgctgggatggggtctttggttttccgtgtccacaaataacaaggtttcctgaattagcttttttgcataatcatggagagaacgttttttttcaggatctttggtgagattataaatagcaagatctgcataggcgcggatgataggttctccaggaagcttcgcagcttggaaaagtagatctaaggcttcctgatgtgaggtgtgacttaaaaaagaaatcgcagtagtggcaagctgagttttctgactcgccaaaagcttataaatacaggggaggtaagcttctttaggtaggcggaagagaaacgtaaggatctgctcttcaagacctcgggttgtggagagcaacctttccctctcctggggatcttgagggactatgatgttcacccgcttccaattttgtaaagtacgccccttagagaaactcaaggctagagtctcattataatgtggttggacaagcctttcggtaatgtattccagtagtttaggggtgtcacaccctaactctaagagagctaaagctacattcaacttgcttcgctgttcttagtttttaggaatatcggcagggcaatcggaatccctatctcagagggtagatgccgtaaggcatacagggctcgaggccgctcctcaagtgcttgcttttttatcacgggaagagcgtcctcttctttccccaaagcaattaaagcttgagctgctgctaaagtgacatccacatcaggcttctgcaattgcttttttatattgtagtagctctgaccatccttaagcttccctaaagcataaagaatagcttcttgatcttgaggagacgcactcgttagcaaattcctaagtgtcggaagaaagcgtttttgttggtattctccgatctgcaaagctgtggcactccgaatcgcgcttttcttggcagctaagagatcccgaatataagcatcagattcttcagtctccaagcgtaggaatattgccgcagataggcattggatttcttcgggaagcttatgaatgaaagaatgtagatgatcaatgactttagtgttcttcaaattagcaagtctataggcggcttctaagcggatgacaggatagggagatgctaaagctttaaacagtaagtcgtcagaagttttcccaagatgtcctgagactgccgataaaaccagtagctgctgcagggggtctgcagtttccatagcttgggagagcacgtccaaggcttctgaagatcccgccaggcctgctccaatgatggtgctttttctagtttgcggatctgaggagtggatgctttgcttgagatagtcttctccgatttttcttaaaacgaagaagtcatgatcaccgtaggcatctagagcttccagatatgttgctaaggcctgctgtgtagattgcgtacttatataaaggatcttatgacctacagactcagggaatttagcaacaagagaaatgggaagactacacaataaaagtccaaagagagttagatggaatagtcccatagatcgatgttcaactcctctagcaagtatttcaatgtttggatagggagaccttgaacattataaacacatccatggacctttttcaaaatcaagccaccatggcaaacgtcataagcgccacaattatttaatgttcctacagtgtcgatataagactctatgcggtgatcaggaatcatagtaagtgaaatctgagaagtctctgaccctgtgaggagttttcccttatgtaatacggcaatactcgtgaccacatcatgcgtctgattcctcaaggtctttaacatctggatagcgnntgctttgncttgaggttttgtgaaaatacggccatcgtaagaaacaatagtatcgccagtgaggataatacagtcacaaggcgaatgtagctcagaaactgcataggccttttgtgcggcaagttcttgtgtataggctataggatccccagagtagctgactttactctcatcaaaatttgaaggaatgacagtaaagggaacacgaaatttttctaaaataaattttcttcttggcgaagaagaccctaaaactaaaggaagggacatagaataaaagctcctcgtgttagatacattacaacaattgcttatgacctgcagtatagtctaccatagttccatcgaagaatgtaatcttatctttatcaaagatcaataacttcgtagcacaatcttgaatcagtcctctgtcgtgagagacaaaaatcgctgtgcccttatagtcattgatagcccaagaaagagcagacacagactctaagtctaagtggttgttcgcttcatcaaggataaggacattatggttttctagcatcatccccgccatgagaagacgagctgtttctcctccagataatgcttggatttgcttgaaagcatcatcgcctccaaaaagcattttccctaacacactgcggatttcttgatcgttaattccggttttgcgattgcgtancactcaaatagcgtttcttgaccacaatcagctagaacatcgctgtggttttgaggaaaatatgaacagatagcttgatggcctaacttgatacttcctgaagaaggagcctcaacacctgcaagtaacttcattaatgtagttttacccaatccattgttcccgataataccaagcttgtctccttgataaatctctaaagaaaaaggatggattacctgatgatccccataatcctttgtaatcgcttctaaagacaaaacgactttccctgaggatttgtcagatagggggaaacgaatgtaaggacgttggatattggatttttttaattcttgtggctgaagcttcttaatctctcttaatcgagactgcacttgactcgctcgtgatcccgcaccaaatttagcaacaaattccttaagctgagaaattttcttttccttagatttgatgtcggccttttcttgctcgcgagacgcggttttcatctctaccatatcgtcatagtttccagggtagataatgatcgtgtcgtaatcaatgtcagcaatgtgagtcgtaattgtatttaagaaatgacggtcgtgactgactacaatgacagtgccttcataatcttttaaaaagtttcccagccaattaatggaatagaggtccaagtggtttgttggctcatcaagaagaagtgcttcggggtgaccaaagagagcctggcaaagaagaactcgaaattgtaggtctatgggaatcatagccattttcttatcaaacatctcattggggatgccaatgcctgtgaggagttcttcggcttctgaatctgctcggtacccattttcctcgccgatgatctcttcaatttcaccaagctccattccaatggcgtcagtaaattcttgtagatagagattatcacggcgttgtaaagcttcccaaagacgagtatttcccataatgacacaatctaagactgttgtgtcgtgaaagctatcgatattttgacgcaggatccccacttttttaggtaaggaaatcgaacctcttgtaggttctatcattcccataatgatttttaaaagggtggactttcctgcgccgttaggaccagtaagaccgtagcagttcccggggttgaaaacgacggaaacatcatcgaataaaattcgagtgcctaaagatttgccaattttatctaatactatgctcatagcagacagcataacaaagtgctgcttagagtacaagagctttgccctgttctcttaggcatggggatgggcttcttggtgggtctgtttttttaactttacagagacttgcgtatagaccgttgttgtctctaaagaactatgaccaagaagtgcttggattgtttttaaatccataccactctctagccaatgggtggctatagtgtgacggattgtatggggggtgatgtgccctgaaagtccagaacgtcgaagatattcttgaaaacttctgtcaatagatcgtgttgaaatgcgcctcccaaagcgattgagaaagatggcttgaggatccttttccaaacgctttctatccggatggttcaggtagatttggatccattgtatggcattcgatgtcacgggaataatcctttcttttttccctttcccacggatgcgaatcagatgagtactcaaatcaaagtcctgtttattaacagcgacaatctcactaatcctcaaacccgaactatagaacagctccatgagacagcgatcacgaagtccgtgatatttagaaatgtcaggagtcgccatcagcacttcaacttgcgcataggtcatcggggaaggcagctccttaggaagacgaggtccgtggatagtttccgcagattttccaaaagaatcttttgaataacacagtaatgggcaaagcttttaatggaagagaggcaacgcttaattgttctcttagctttgccattttctatcagtttcgcgatgtacatgcgtacatgctctttggtgaataaggaaaaaggaagttcagagactttgcgcttctctgtggctaactgtaaaggagaagaaggagcgaggttaccacgttccnctaaaaaaattttcaatccattaagatctagacaataatttcttaatgtatgcggagaggcactttttaccattttcaaatagtctaagaacgaatagatagaggcaatcataacttctctttaccttacaataaagatcgtaaaaagacttcctcttagctttaggaaggctagcttcttactattctttccgagctatttatttagaagaggatttttcggaaaggggtagctgcgatattcttgtgctacggacacattaggaaatactgccgaggcttctttataaaaatcatccagatttaagtaacgtgccgagaagtgtgtgagaataagcttttgtgttgcggcacgtttcgcaagagtcgccgcttgttttgcagtcatatgaaaatggctctcagcaagatggcggtgctgttcgaggtaggtgctttcacacaacatcatgcagctattttttgcgagatctatagcagcttggcaaggcaaagtatccgcaataatcgcaatgctatcccccttgcggacgtagctaacatcactaagatataccgtagaaccgcctatcgaaatttcttggtcacgaataagatcttggataatcagaccacgaatgcctcgagattccagctctttaggaagaaattttatagtgtctggttccgtgattctccatcctaaagtgtctacttggtgttggagtcgctgtgcttcaatacgaaaactaccaaaatcttcgacaattccttcctcagagattggatgctccaccacctggatggtttcgtgataaattgttccataacgtaagcggtcaaagtattttttccctgaagcaggatagtagcaatggatagggtgcgaaaccttgtccaagttaagacgcatcaacatggagcctagacccaaacaatgatctccatggaaatgactcacaaaaattctattgactgttgtaggagcaatatttgcaaagatgaattgcctttgagtgccttcaccaggatcaaaaagtagaccctcaccattccagcgaaataggtaggctccttgattgcgtgttcgtgtaggctgttggctcgagcaccctaaaataattaactctctagaactcataaggatttactttaagaaaaagtcacagaataaactaagtgaaattatatacgccactacaacttttgaatgacaacttttttatcatttaaaattttgttttcttataactcctgcattgttgtcttcatatttataggaatcgcaagatagttatgggtctgtcggttgcttgcagaaccaagggagtatcgctttccgttgtacgggtggaggagatgaagaatcagaactctcattgcctgatgattgatgttctagatcttctatagggagggggacggtttttttcaatagcacaggttttctttttttcgacggaaccatgggttttggtgctgatctcttatgtatgctacttgtcgttctatgtaaggagtgtttagttttcttcttcttctttgagctttctgttgttgaagttttagacccttttgtagttgccgtatgaggtgcttttcccttggctttgcgatggagttcaggggaagattcatcagaggattcaatttcagaagaacgcttgctttgcctaggtgaatggtgttcatcagagatgtgaggactctcttcaccacttttgaatttgtttgttacatagttgacgcctttttctaattgcgttcttatgaagttttttggttcgtggtcatgatgtggggagagttgcgggctcccttttctagacgcagattttgtaggttgtgattcagaggcatcttttggggcaatttcttttgttttttttgtggatatccaattaatgagacacggattgaaaatactcaagagcactagaagtgccaatgagcttaaacaaagaggaattcctacagagggaataaacatgcacagcatagctccaacaagaactacgacgacgagaacgcatataatgattaggtaagcaatgttgcaaatgtctcgaatcgatttggaaggagccgcttgtttgatcggttgaggtttatggaaatacgaagtcactgagttgcgcaggctaggaataagatgggacatagcaaagttagattaaagctctctgaaaagaacagcttatgtattcaaggtctgtttgtaaatatacagacttttttatacgcattaaatctaccttaatgcgtataaaaatagtgattctcaagagaacaagggttcaacttggctttctattttagcttgggaaaagcaactttgagaacatcatcatagtgtgaaacaaaatgtattttcaaccctgttttcagatatgcaggaagctcttcatagtctctacggttgtcttcagggaaaatcaagatgttcaatcgtgatcttcgagctgcaatcagtttctctcgaatgcctcctacacctaaaacacgacctgtaagagtaatttctccagtcattcccaaattattcactaccggagtttccaacagcaacgaaaggagagaggtcaccatagtaattcctgcagaaggaccgtctttaggggtggctccctcaggaatgtggatatgtacttgagactttggaaagaacgtatagcctggggcataccgatggagagcactgtgaaggtaggtccaagcaatctgagaagactccttcattacttccccagcctgacctgtaaggtgcatgtctgttttgagtgaggacacctgtacactttctatatataacgttgctccacctaaagaggtccaggcaagtcctgtggccactcctacaggagtggattcatagaagcgatcgctagaaaatatcggtttccctaagtaggtctgcagatttttcgaagagattttaaaagtaatcttcttagatttgggtttttcttgattttgaacaatctttaaagcaactttcctcaatacttttttgatattcccattaagagtacgtaccccagcttctcgtgcatagttattgatcatgtactttaaagcttcaggttggaaattcacttcgcttgctgttaaaccgatttctttgcgagctttgggaactagatactttttagcaatttgaagtttctcttctaaaatgtagccagaaagtcggagaatctccatgcgatctaaaagaggatccggaatggtatctagaacattggcagttaaaatgaatagtacattggatagatcaacacgtacgtctaaataatgatcaagaaaatctttgttttgctcaggatctaaaacctctaataaggcagaggcaggatctccatgataactcgcaccaattttatctacctcatcaatcataatcacaggattcatagcttggctttgcttgagcgcctggaccatttttcctggcattgccccaatataggtgcggcgatgccccttgatctcggcctcatcacgcatgcctcctactgagaaacggaagaactttctatgcaggactttagcaatgtgcgccctatgcttgttttcccaactcctggagggcctacaagacagatgatacttccttttaatcctttggaaagcttacctacactgattaactcgagaatgcgttgtttaatctcatcaaggccatagtgatccttgttcaggacgatttctgctttctttaagtcatggtattctttactttgtatgccccaaggaatgattgtcagccaatccaggtaattgcggcatacggtatattccgccgaagaagtttctaaagtctgaagtttttcaatttcatcttgaatcacttccatagcataatcaggaacatggcgttttcttagcctttccgaaaacttctctatatcaatagcgcggtcttctttctctaaccccagttcttttttantcgtttttaactgctcttttaagaagaattccttttggcttttngtaatcgtagcttcaattttttgattaatgctgctctggaggcggcttaagtctaattccttttttagtaagatcagtgccttatcaatgcgatcatgcatgttggtggtctctaagacctcttggagctcttcccgagttgctgttgttaaagcaacagagaaatccgcaagcttgcctggttcagtaaaatccgaatgaccaagaaaaatttgtagttcttctttaaagagaggatttagttttaaaaggtctttgatgacagagacaatactaatagagtacgcttttagctcttctgtaagctctttattgtccgcatgataggaaactcgagctttaagatatttgtctttaatgggttctataatccgaatacgctcttcaatgcttaaaagaacttgagcactgccaccctcgattggcatgatacggaggattcttgcggcaactccagttttatgcagctggttgaagctcacttttaaaatatcggcgttctcttttttggttaagacaagaccaatatatttttgagacgacttcgctaaaacctttaatacttcataataaggacccgactcaataagaatgggagccgccattccggggaaaaaaggtcgtttatttaatggcaggataaataactcagaaggcagcaaacgctccgtagactgatcttcggattcctcttcagattcatctaaaagcttttcaacatcttctggatttggatctaagatgggggagtcgctattggttgtagagtccacaattgtccttatgctcggctatatttgtctgtcgctccagtaaatacggctctttttctctagggtaaaaagagggagcgattttaaaagattgcatatttcgctatactacaaaatagatgcaattaggcgcatatatacaacttctaaaaaatatctagaagggattaaagattaggaaagactcgtgtttaaggcaaatcgtctttttttattttttcaaaaaaaatagtttgtatctactgtttaaaattgctcagagataagggattaagaaaaactccattgtttttgagttttttacttttatagggggtagattttccaagggaaaaacgtcagtagtccaaatccagcctttttgtccttcgtttgcattgaaggtaaatgcagggatcggaagacaaaagaacacgcttgcattgtttttaatttaacagccatttcctcttgttgttctttatgataattaagagcccgttcctcgcctgaaatatttggaacagataccaaggaatgaaaatagaagttagggagaagggaattataagagaagccaatatcttgctttggtgaaggagcttgaccaagatctgtgattttagtgaaagaaaacccttcttgtataagctcgttataggtttttccagaacgcactaaaatgtgtagcgcatgaattttctttaatgttgtaggagatggtaaaggaagactgaggttttcttggtcaggtgtaagtgtttttttccaaatcctccttcttaacatctnggattagaccacgatacttgangaataagataatncgtaaaacgatcttaataaagagagctagaatcagaggaagaattaaaatataggagagaatttttattattttttcagatttcgagattgggagggcatgatcaacagatagaaaggtagctccagaaactcctgtgatgataacagaagtgtctcctcccaaatgtaaatagtgttcaacgatattggaacatttttcaataatgccagagctttttcctaagtaaggaagaaaagataaggactgatccgagaagactataggatgaaaaaactgaagaaacatacgttagaatttttattttttttatattataacgtactagccttcaaaaagtaactattctttatggcttagtcttgtttctctcagaatttagataaacataaaatttgatcttcagttccataacagaacgactccaaataatctcttgtaattgtgcggccatagttggggggattcttggatcttcaatctcaaatgaattcagatattgaaaacgggacgtcccatagagaatatcggattgggtagcttctcgtttgcctagttgttggcgtaagcttattaaactactcttaatagaagtagttctcaatttgatttgaaattttttcaagagttcctgaccccctttcctaagcaaggaagaatcgagtagcattgggcgtaaaagtatataggagtaacaaaatcgcaacccatcgttcgtccttatatttagagcggcgaagaatctaatgtatctgaataaattaaaacaataaatgttttcatttctttcatttttatttgattaaaaggggtttgttggtatagtttatttttttatatcaaaaatcgacgcatgtacttctataagtatgttatcatagatacttctggatactatccattcttagcttgtgtggataatcaacaagtgctggagcattggtctttgccagtcggtccagatcttggaattgttttagagtttctttttaaaagtaaaaatctctcttttcagggagttgcggtggctctaggtccaggaacttttctgcaacacggatagggatttctttcgctcaaggattggcaatggcaaagaatgtgcctttgctaggatatagctctttggaaggatacttattatctaaagatgaaaaaaaagctttaatgcttcctttggggaaacgtggaggcgtcctgactttaagctctgagattcctgaagagggcttgaatgaaaaaaggagaggggtggggccgggagctttgctctcttatgaagaggcctctgattactgcgttgctcatggatattatcatgtgatttctcctaatccgcagctctttgcgagcagtttttctgataagatcaccgtagaagaagttgctccttcggtagaacagatccgcaggcacgtgatttctcaattcatgtttgtagaatatgacaagcagctctctcctgattaccgtagctattcatgtattttttgatttgtattttctaaatattttttacattgttgcttccgaatcgattcaactatcccttgaagcctaatagaagtagtggtacaatcgaggctcttctaaaagacatagtaaaaagattattattgtgtttatagaaggccagagatttgttatttattgcgtaataataaggtaatgcatgcccagtgttaaagttcgagttggagagcctgtagatcgtgctctgcgcatcttaaaaaagaaaatagataaagaagggattttaaaagctgctaaatcccatcgcttttatgacaagccttctgtcaagaaacgagctaaatctaaggctgcggctaagtatcgtagtcgttaattggcaatgtcgtattcgttggtagtgtttcaggtatggattattattcaattttaggcatttctaaaactgcttccgcagaagaaattaaaaaagcctatcgcaaattagctgttaaatatcatccggataaaaatcctggggatgctgcagcggaaaaacgcttcaaagaagtttccgaagcttatgaagttctcagtgatcctcagaagcgcgactcttacgatcgtttcggtaaggacggtccttttgctggagccggtggctttggtggcgctggaggcatggggaacatggaagatgccttgcgcactttcatgggagcctttggcggagagttcggaggtggaagcttctttgatggtctttttggtgggcttggtgaagcttttggaatgcgctcagatcctgcaggcgctcgtcaaggagccagtaagaaagttcatattaatttgacttttgaagaagcagctcatggtgttgagaaggaacttgtagtttctggatataaatcttgtgaaacctgttctggtcaaggagctgtaaaccctcaagggattaaatcctgcgaacgttgcaaaggttcgggacaagtggtacagagtcgtggatttttctccatggcctctacatgtccagaatgcggtggcgaaggccgtattatcacagacccttgttcttcatgtcgcggccaaggaagagttaaagataaacgtagtgtccatgtgcatatccccgcaggtgtggattctggaatgcgcttgaagatggaaggctatggagatgcaggccaaaatggagctccctccggagatctctatgtctttattgatgtagagtctcatcccgtatttgagcgtcgtggagatgacttgatcctagagcttcccattggttttgtagatgctgctctcggtatgaagaaagaaattcctacgttattgaagacagaaggatcgtgtcgtcttacggttcctgaaggaattcaaagtggaaccattttaaaagtaagaaatcagggctttcctaatgttcatgggaaaggtcgtggagatcttttagttcgcatttctgtagaaactcctcaaaatttatcagaagagcaaaaagaacttttacgtacttttgcttctacagaaaaagcagagaactttcctaagaagcgtagctttttagataaaatcaaaggttttttttctgacttcacagtataagaaggagaaaagaccgactttagctgagagagatccatgggagtagtacaaaatcaagttatttcttctataagagatgttttaaagctagtctgggaattgcggttcgcagagcataagatgcttctcctctctaggcagagcggctcgggcggcacatttcagttgtcttgtgcaggtcatgagcttgccggcgttcttgctggtaaaagtctcattcctggtaaagactggtccttcccttattatagagatcaagggttccctataggcttgggttgtgatctctctgagatctttgcttcgtttctagctcgtacaactccaaatcattcctctgcgaggatgatgccttatcactattctcataaaaaattgcgtatttgctgtcagtccagtgttgtaggaacacagtttttacaagccgcaggtcgtgcttgggctgtcaagcactcgtcagctgatgaagttgtctatgtttctggaggcgatggagctacatctcagggtgaattccatgaaatgttgaactttgtagcactacaccaactgcctttaatcactgtaatccaaaataatcattgggcaatttctgttccttttgaagaccaatgtggagccgaccttgccagcttgggtcgttgccatcaaggattagctgtctatgaggtagatggaggcaactatacttctcttacagaaactttttctcatgccgtagatcaagcgcgtcaacattcggtgcctgcattgattttaatcgatgtggttcgcttgagctctcatagcaattccgataatcaggaaaaataaccctccgctttagacctgaaactatccatggataaggatcccttaatccttctagagaaagaggctatcaatgtttttggtctgtctccctttgaaatcgaggagatcaaggctgaagctcaagaagaagttcgaaaatcttgtgagattgctgaagctcttccttttccctctaagggatctacaagccatgaagtcttctctccttataccgagactctcattgattatgagaattctgaaagcgctcagaatttgcgtaactctgaacctaaagtgatgcgtgatgctatctccgaagcccttgtagaagagatgactcgagattctggagtcattgtctttggtgaggatgtcgctggagataaaggaggagtcttcggtgtcaccaggaatttgacagaaaaattcggaccacaacggtgtttcaattctcccttagctgaagcaaccattataggaaccgccataggcatggccttagacgggattcataagcctgtcgttgagattcagttcgcagattatatttggccggggatcaatcagctattttctgaggcctctagcatctactatcgttcagctggcgaatgggaagttcctctggtaatacgagccccttcaggaggctatatccagggaggaccgtaccattcgcaaagtatagaagggttcctagcacactgtcctggaattaaagttgcctatccttctaatgctgctgatgctaaagctttgctaaaggcagcgattcgagacccgaatccagtagtgtttttggagcataaggccctctatcaaaggcgtatttttagtgcctgcccagttttttctcatgactatgttctgcctttccgcaaggccgctattgttcatcccgggaaagatctcacgatagtttcttggggaatgcctctggtattgagtttagaggttgctcaggaattagcctctcgggggatttccatagaagttatagatttgcgtactatggtgccttgtgacttcgctacggttctaaaatccttagagaaaaccggaaggttgttggtgattcacgaggcttcagagttttgtggctttggcagtgagcttgtcgctactatgtcggaacaaggatacgcttatttagatgctcctatccgtcgtcttggtgggcttcatgctcccgttccctactctaaggttcttgaaaacgaagtgcttcctcataaggagtctattttacaagccgcgaaaagtctcgcagaattctaggcgattctccagcttctttctaggccgggattttaattcaaaaagagagcccgacacgctgtttgtagaggtacttgggagatgctatttactgaaacattagagagtgcgtactcttctttggatgctaataaaatgcgcacggattctaaaagagcaagatggcaacaactctcccatgtagtaaattcctcttgatctgcgctgaggttatttaatccaaaaacttctaactgtacactttcaagattgtgctcaatacagatatcaaagcattgcaaataagccagtactaaattagtaaatgcctctttcatactaaaatctttcaatgtaattgcgcggcgcattttttccttaatgagagtttctaatgtagggggattgataacaatcagatgagaggtgtacagttgcgcgccctcttctacatcccaagggccagaaacgcatgaacctataggcaagtgtttttctggagtgggaatgttgtttttgatcttttcccagcagctcctttgtaaacatgttgtaacagcaaacgctcttcctaatgttgtggagaaatccatgctagaatgtgaagagataacaacagcccctgattttttatttagaattttatcatgagaaaaatgtcctttaaagcagtgaaaacggaatccagatttttctttagatctcaggagaatacttgctagcttgttggaatacttacgatcttcgggtctggtttctggatctagagagaatagctgcttgagtaacgaaaaacaagccttaggatcatacgtagagggataatgtatatcaggattgcaggtcagttttgttctatcgactttaggtagagttggaggtaagggtattcctggagctggcgcgggtatttctggagttagtgtgggtgctcttagagttggtgagggtggaggagtggggagtggctcaggaatcttaggtttttctaggtagtgtataaaatacaacaacgtaaaagcaataaagactgcggtaagtatgaatagaggcatggtgatctctagggaacaccctaggcaaatggcaaaaactccccctaggcaagataggaatgctaaaatggcaaaagcaattgcgttgactattgaagatggagtttctttcttgcgttgaggtttaaaaggtgcctgcgtggggattgtagggatatggtcaggagaagaatctggatccggaacaggcggtgtcttctgggatacaatagaggagtcgggtaaagatggagtcgatatttccgccataagaattcccctacaagttgttggcaataaaaaatttacttaattttaatataaaaacaaatcagaaaaacaaagattattttgatttgtcattagaatattgttgttttatagggtttcgatgaagcgataagaagtcgcagaagttgatgcatagggggagacgtttgtgcgtaaaattccaatgaagaataaaataagagaagctaaggtaagcatccaaggagggacaggagcaaaggaaagagtctttaggatattggggttgtgtagccaaggatgtgagaggaatccctggataagcgcttcggtgataggggagcaacatggcaagatgattgttgcaatgaggaaaacaatgatggggagaatggtaaaaggaacaatgagattatagaggagaccctcaaggggtaagctcccaaagtactgcatgattggcagaacaataaagagttgtgccgatagtgaaattgccaaagtcatggcaagatagcggataggatacaaccaaaatggagagagaaactgagtccaaggggtgtagagaaaggaaaagatcttcgggaaaaagagtagaatccccaacgtcgctaagaagcttaaaacaaaggtaggagagaagcgcgaaaaaaagatagaacataaaataaagcctgcgcctagacgatttagccccgaacaggacccagaaaaacaccatgaaaaacaaagtagggttacggagatccaagagcgccataccgagagagacatagggaaaatacaggatagagaagtcagaacaatgaagcttaagatttttttgatttttaaaggaagaagagcacagagcatccagagagtagtagcacacagagagaaatgccagcccgagatagcaaagagatgagataaccctttttgtctgaagaggtctctgagattttgaggaaggggagttcctagcagaagactcgaagcaaaggggcctacctcagaagagggaaacctatggttcaggaaatggcagctagattctcggcatttctctttcatgatatagaacctagacctaggaatttctttgtagcaagcattagacttaaaaacaatttgagatgtatgatgtagtgtcccttcgagctcgtaaacctttttaagctctaaacgggattctgatagaatttgacacnagaggtggtgggctcttttncccacagggcgtctgaatacaaagagcttctccgtagtagntccttgcccccctgcgtggtgaatcacaaaagtccctgatatagggccgtcatggaggaatggcgcaggagttaacatcaaagaaatgatccaagcacttgctaaagggagccattgtttagggttgcgaggaaggaacattcctaagaaaataagaatcagagcactacattctgggtagccacgggatgtgatgccagcaagccaatagagcccacataagaaaataggatgtctttgttggaagcactcacaagaggcgcgtaatcgaatgagccaagagcttatgggatagcgaaagaaaaaagatgaaaaaacctgacaacgattccacatttgatgttcgctctttctttcccttcgatgtgttatgtatagagcagttgcgcaaggaaatgtcttgggaagtggtttcagcgaagatcccgcgtcttcctcgagggtggtacgagctcatgggactatcaaaagaagatcgtatagatttttgcttagacttctggtgttccgtactagggattgagcataaagaatctccaagtatttgtcgttttttttctttactagagaccattgaagtttacatctatcgcttggaaaaagaaccttatcaactaaagatgttttatgtattccgtgatggtcgttgtgggtttcaaggagagcctcctcttctagattttttagggcatcataggctgcctcctttaggggaccgccattacgagaaatttttctctattcataatggattcgggaaatgggaggatgaggggattttccccatgaggtctttagcaaaggtacaacaaaaattacgtcagcagctcgttgtaatgaataagatgcaggcggaagataattgttattctttaggtatctttcctttttatggctatgaagagccttttgcttatcagagtttcttttttgatcctgaaatacgcagagaccttccttctccgaatgtgttgttaaatgaagagagcttggagcatcgaagcttagaaactattgagttgttgcatctgtctaagagctattatccttctttcctctcgtggttggagaactatctacatagtgaggaggtgtataatgaatgagcctactcgcacttatctagaaagtgagaaagatacacaagatcagatcgaagagctccaggcaacttgtatagttaagaatgcagcaggaatccatgtgcgtcctgcaggtgttattgttcgactctttgatggagagccttgtgatgtgcatttcacctacgcaggtaaaacgataaatgcaaagagtatcatgagtattcttatgttgggagctccacaaggaggagagattcttgtgactattagaagcaaagaagctcatcgtatcttacaaaagatacaagatgcgtttagttccggttttggagaactataaatggatacacagtcctctataggtaacgaagaatggcgtattgcaggaacctctgtagtttctgggatggccttaggtaaagtattttttttgggaacatcccccttgcatgttcgtgagctgactctacctcaagaagaagtcgaacatgaaatacatcgttattataaagctttgaatcgctcgaagtctgatatcgtagctttagaacaggaagttacgggacagcaaggccttcaagaggtttcctctatcctacaagcacacttggagattatgaaagaccctctccttacggaggaggtggtcaatactatccgtaaggatcgtaaaaatgcagaatatgtcttttcttcagtcatgggtaaaatagaagagtcgttaacagcagtccgcgggatgccttctgttgtagatcgtgttcaagatatccatgatatctccaatagagttatcggccatctgtgttgccaacataagagttctttaggagaatctgatcagaatttgatcatattctctgaggaattgaccccctcagaagtcgccagtgctaactctgcctatatccgagggtttgtctcattagtgggagcagccacatcacatacagctatcgtctcgcgagcaaagagcattccctatcttgctaatatctccgaggagctttggaacatcgcaaagcgatataatggcaagttagtcttaatcgacggttatcgtggagagctaatctttaatcctaaaccagcgactctacaaagctgctataaaaaagagctttccgtggttgcccatacctctcagagattagtaagaaagtccctacacccgattgtttcttcgcatgcaggcagtgataaggacgtagaagatctattagagaacttccctcaaacctccataggcctctttcgttctgagtttttagctgtaattttaggacgcctacctacactaagagagcaagtagatctttacgagaagctcgcacgttttcctggagattcgccctcagtactgcgcctctttgattttggtgaagacaaaccttgtcctggaataaaaaataagaaagaacgttctatacgatggttgctagactatagtgtgattcttgaggatcagctccaagcaattgctaaagcctctttgcaaggctccataaaggttctcattccaggagtgtctgacgtttctgagattatagaagtcaaaaagaaatgggagaccatccagacgaggttccctaaaaggccataaggtttcttgggggactatgatagaatttccttctgcagtttggatgattgaagagatccttcctgaatgtgattttctctctatagggacgaatgaccttgtccaatatactttgggaatttccagggaatccgctcttcctaaacatctaaatgtaactttgcccccagcagtgatccgcatgattcaccatgtacttcaagctgcgaacaaaatcaggttcctgttagcatttgtggagaggccgcagggcagctcagtctgactcctttatttataggcctgggagttcaagagctctcagtagctatgcctgtaatcaatagacttcgcaatcatatcgccctgctagagttgaactcctgccttgaaattacagaagcccttttacaagctaaaacatgctctgaagttgaagaacttttaaatagaaacaacaaaatcacatcataaaaattccattatactttttttatataaagatcttttatgatgtataaagtttgtaaaaactgtgttttctagtcgtgccaatgtgcaataggaaaaaataccaactccacggcggatctctagttctagaaaggcattgtggaacgcataagagacatttcttgatccatctgctcttttgcaagtttgaatgcagcacggaacaagtcttcaatgacttctggatcttcagggtctaagcacgtaggttgtacttttactgaaattaagtcacactttccgttgatgacaacagagacaagaccgttgccagcttgcccttcgtaacgcttttctaatagtgaggcctccatttctaggaattgctgttccataattttagcttctttttttttcttagcgtatccgctgcccatgcttatctatccttaggtgaaatattgatctttcctctcatgaaattttctaagaggttcttgcttattgtcttaaaattcctgaaaattctacaacagcaaactgtaataatgtgtctacagctgcagattttattgaagctgagcttttaacttctacagatataattttaccttccgcagcaggttgattttttttctctaaaaaactctgttctttgtaggtgggctgaggttgaggagctgatacttgctgcgtcaaggtgggctccttaatattgcgaagcccttcaaactgccgactcttaatagaagagatcaactctgataaaacaggcctttgataaatgcgaatgatatgaatgatgacggtttctaaaaatgtctgttcgaagatggtattttgtaggtgcttagcagattctccaaggaaatctattatttctagaagctgctccgtcttatactgagagctgaacttgcttgttgtagaattcgtaagaagaagattacgataaaataatgtaaggtcatggagaaatgtgacaggtgctaccccagaatttaagaagtccgttacgatccctaaggctgtcgcatagtccctttgaagaatcgcattgtctaaagtccggagagaatcttgggaagcaaagcctaaagcttgggcaaccgtgtcgggagagagagatttaggaaataaagatattacgtaggtcataaagagattctgcatcacgcaagcttccttgtgctgcacgggcgatcggcgccaatgcttcttgcgacgcctcaatatggtcatcttgagccataagcgatagcttctccaggatcgttttttcaggaatcctttgaagatgcattttttgacaacgacttaaaatagttccgggaattttatggatttctgtagttgcaaagaaaaattttacatgttgtggaggctcttctaaagtcttcaataaagcattgaaggcttccttagtgagcatatgaacttcatctatgatataaattttaaactttgcttttacaggagtgaataatacagtttcattaatttgacggatatcttcgataccacggtgggaggctccgtcaatttctaaaacgtctaaagaggatcctgaagcaatctctttacaagaaaaacactggttgcagggctcgccatcctcgctaagatgcacgcagttcagagcttttgctaaaatgcgagctagtgtggttttccctgtaccacgaattccagaaaatagataggcgtgggcggctcggttgaagaccaaggcattttttaatacagcgacaacagagctctgacctagaatttctcgaaagatttgtggacggtactttctagaggatgcttggtagggttgtagagtcattgtataaccaagagaatgtgtatagaaagctcattttctcatttaagagattttttcttgaagaccttttctgattttcataagaaaattcttttcgcagagatggaatgattttccttctaaaatagaatttgtgaattcttctttagaaggaaaatgaatctctttgaataaaatactatatattagtagcttagtgggtttaacttatgtgtttgatcgcgatggcaccacagattcataatgcaagtacctctatcaccacagctacccccctccccaacactctgtagggtcgatttcttctcgatataaacttcgcgttttagcgattacttttttagttcttggtgtgcttttactgatttcaggagctctctttttgacgttggggataccaggactcactgcaggggtctcttttggattaggtataggtctctctgcgttaggaggagtgcttgttgtctcaggactactatgccttctagtaaaacgagaggtttcgaaagtatgtcccgaggagattccggcagtacaaccagaagagactcctgaaggggttcctgtgactccatttgagaagccagctctagatgaagcccagaaggagcagaagactcagaaaattttagatcagctgcctcaagaattggatcagttagataggtatattcaggaagtgttcgcatgtttaggaccgctgaaagatcttaagtacgaagatcaaggttttttacaagacgtcaaggaggagtttcaagtttttgactttgttcaaaaagatatgattgcggagtttgtagagctacagcagattctatgtcaagaagggaggttgctagagttcgtaatcaatcagacacgatatataggaagagatctttttaaaagagaggatagtttatataaattatgggaatggcttgggtatttaccttctggggatgttcgaggggagcggttaaagaaatctgctcgtgaggttgtggatcgctttatgagaacgacttgtaacatacggaagatagccatgacttttgataggcatgtttatagtgtggcgaagacggcctttgaaaaggcatttggagccttggagacgtgtgtgtatgagagtatgagagagagttatagagaggcattttgtgagtatgagaaggcgaagctgcttggggatgaggagaagagtgcacatgccgagcaaaggtttcaggatataaagaaccgttgggaggatgtaaaggatgcattcttttgggtaaaagaagatggggaagattgaaattgatgatgcaattggaaacagttgtaaatggagtgagcgttatgaagagcacaggattactcgagcaagatggtataaggtcgcggagcatcagttgtttaatgcgactatgagagtgaaagattcgttacgagagcataatgaagcaagagtcgcttttgagaaggagagatctaaggagaatcagaggcaagtccaaaaaaagaaagaaaagaggttgcgagatttaaaggaattgcatgatcaggagcttccgagagcacaggagaggttgagagagctgcaagctttgtatcctgaaattgcagtctctgttgtagaggccaggagagaggtagcctctgatttagagaaagctcatgagagtattgacaagcactatcaaagctgtgttcgagagcaagagctctactgagaagaagaagagaaacaggaagcggagtttagggagaacggcacaaagattcgctctatggaggaggtgtctgagtatcttcagcaagtagaaaatcagttggaatcctgttccaagcgattaaccaagatggaaacttttgccttaggtgtgaggttggaagctaaagaagagatagagtctatcatactttctgatgtagtgaaccgttttgaggttttatgtagagatattgaagatatgctatctcgagtcgaggagatagagcggatgttacgtatggcggagcttcctgtacttcctataaaagaagcgcttaccaaggcttttgtacaacataacagctgtaaagagaagttaaccaaggtagagccttactttaaagagagccctgcatatctaactagtgaaaaccgattgcagagtttgaatcagactttacaacgtgcgtacaaagagtcccaaaaggtttcaggtttagaatcggaagtgagagcctgtcgagagcagcttaaagatcaagtaagacagtttgaaactcaaggagtgagcttgataaaagaagagattctctttgtgactagtacctttagaactaaatttagctatcattcatttcgattacatgttccttgcatgaggttgtatgaggagtattatgatgacattgatctagagagaactcgagctcgatggatggcgatgtctgagaggtatagagatgcttttcaggcattccaggagatgttgaaggaaggcctagttgaagaagctcaggctcttagagaaaccgagtactggttatatcgagaggagagaaagagtaaaaagaaacattgatttgcgctaagctaacagcagcgcagcagcgagttgcagcatttgaatccatagaagttcctgagattcctgaggccccagaagagaaaccgagtttgctggataaagcgcgttctttatttacccgagaagatcgttcttagaaccactctaggagtctctaggccctgtttttttaaattctttgaataaaatactatatattagtggctgagttagtttaacttatgtgtttgattccgatagcaccacagattcataatgcaagtacctctatcaccacagctacccccccccccccccccccccagaccaatctgtaggggcttctttttgtctgtctaaatttcgtgttttagcaatcacttttttagttcttggtgtgctcttactgatttcaggagctctctttctaacgttagggatttcaggagtctctcttggagttggtttggggctctctgcattaggaagtgtactcgttatttcgggatttctattgcttttagaaagacgagaggtttcgggagtgggtttagaggggattccgacaggtattcctgtgggtccttctgcagaaccttcttcagaggaaatacagaagaagcaaaaagcaaagcaaattttagatcaactgcctcaggaactagatcagttagatacggatatccagcacgtgctctcatgtttagggaaactgaaagatcttaagtgcaaagatcgaggtcttttaaaagatgccaaggagaaactgcaagtttttgactttgtttggaaagacatgatgatggagtttgtagagctacagcaggtcatggatcaagagagccggtatctagagggcctgatccatgaggtacaaagtatagcacacaaactttttgtagatgatgtaaatattagatcccatttaggggagtcgtgcgggtatttaccttccgaggatgttcgaggggaactgttaaagagattcgctaaagaggtcgtagctcgctttatgaaagtgactcgcgacatacggaagatagcaatggcttttaacaaaaatgcctatggggcagcaaaaaatgcctttgataaggcttttggaagcttggaaacgtgtctgtataagagtctgactaagagttatagagataccttttgtgactataagagagcaaagatccttccggatgagaataatagcgctcgtgccgagcaaaggtttagggaagtcaaggatcattgggaggacttaaacgaaacggtcttttgggtaaaagaagacggtcgtattgacatagaagtgctcactgcagtcggtgggtggccagatcgttatccagagcatcttattcttgaaaaaagaaaggataaggtaatgagccatcagttgtgggaggcgactatgcgtgtgaaagaagctgaagtaacgtatagtgtagcaagagtcgcctttgaaaaggatggatctcagcagaatcagaagaaattccaagaaaagacaaaagagaggctgcgatgtttaaaggatttgcgtgatcaggagtgtcatcgtgcacaagagagattagaaaaactgacggctttgtatcctgaggtttcagtctctgtagtagagacggagagagagaggaaatttaatttagagaaagcctatgggaatctcgaagagcgctatcagagcgttgtgcaagatcaagaggactactggacagaacaaaagaacagggaagcagaatttagggcgaaaggaactaaggttcgctctatggaggaggtggcagagcatcttcagatcttagaaaatctattggaagactgttataagagattatcaaaagcagaaacttttgccttaggggtggagagggaagctacagaagagatagagtataccatactctctgatgcagcgaaccgtcttaaggttttatgtgaagatattgaggacaccctgcctcgagtcgaagaaatagagatgatgctgcgtatggcagagcgtccactccatcctataaagcaagcatttaccaaggcttttgtacaatataacaggtgcaaagagaggttagcaaaggtagagccctattataaagagagccctgcatatgtaaatagcgaagagcgattgcagagtttggatcaggcttcacagtgcatacaaagagtcccaaaaggtttcaagtttagaaacggaagcatgtacatatagagagtatcttagagaacaagtacaacagtttgaaactcaaggagtgagcttgataaaagaagagcttctctttttaagcagtactctcaaaagtaaattgagctatgatccattaatagcaaacattccctgtatgaagttttattaccagtattatgatgacattgataaagcgagagctcaatcccgatggctggagaagtctgagaggtatagaaatgctaagaggagattccaagagatcgtgaagaaaggcctattcaaagaagctaagcccttgaaaaaagaggagtataggttacttcaagaggagagaagcaataaggagaagcgtttgatttacaataagatggcagtagctcggcaacgagttcaagaatttgaatcgatggagattccagaatagaaagtaagtcttatggataaagcgcgttctttatttactcgagaagatcgttcctagcacaactctagaaacctatgagttgtgttgctttaaaaatttttttgaataaaatgctatgtattagtagcttagttggttaaacttatgtatttggtcacgatggcatcacagattcataatgcaagtacacgtatcacccaccacagctaccccccgatcactcggtaggggctacttcttggcaacctaagcttcgtattttaaccattacttttttagttcttggtgtgcttttactgatttcaggagctctctttctaacgttgggagttccaggacttgctgcagggctctcttttggattaggcatcggtctctccgcattaggaggcgtactggttgtttcaggacttctattctttctcataagacgaggggtttcgaaagttcgtccagaagagattcctgtgactccttcccatgaagcccagaagattttatgtcagctacctcaggaactggatcagttagatacgtctattcaggaagtagtctcatgtttagggaaactgaaagatcttaagtacgaagatcaagggcttttaacagaggtacaggagaaacttcgagtttttgactttgtcaggaaagacatggtgacagagtttttagagctacagcaggttgtggctcaagaaggacaatttctagattacctaatcaatcaggtgcaaagcatatcacacaaactttttgtacctgatgtaaatattggagctcatttagcggagttgtgtgggtatttaccttctggtgatgttcgagtggagcgtttaaagagatctgctcgtcaggttgtagatcgctttcatgagggtgacttgtgacacgcggaaggtggcaatggcttttgacgagaatgctgtggagtggcaaaaaatgcctttgataaggcttttggggcattagaagagtgtgtgtataagagtctgacagagagttatagagaggcattttatgaatatgagaaggcgaagatccttaggaatgaagatgtagaatggctgcaggataagaataagagcgcacgtgctgagcagagatttagggaagtcaaggatcgttgggaggacttaaaggaaacggtcttttgggtaaaagaaaacggttgtattgacctagaagtgctcactgcagtgggtgggtggccggatcgtggtccagagcatcttattcctgaaaaaagaaggaataaggtaatgagccataaattatgggaggcgactatgcgaatgaagggagcagaaggaacgtatagtgtagcaagagtcgcctttgaaaaggatggatctagaaagaatcagaagaaattccaagaaaagacaaaagagtggttgcgatgtttaaaggatttgcatgatcaggagtgtcatcgtgcacgggagagattggcagaacttgaagctttgtatcctgaggtttcagtctctgtagtagagacggagagagagacaaaatttaaattagagactgcttatgggaatctcgaagagcgctatcagagcgttgtgcgagatcaggaggactactggaaagaagaagaaaacaaggaagcagagtttagggaaaaaggaacaaaggttcgctctccagaggaggtggtagagtatcttcagatcttagaaaatctgttggaagactgttctaagcaattaactatagcggaagtggttgtcttaggtgtagagctggaagctacagcagagttcgagtataccatactctctgatgcagcgaatcgtcttaaggttttatgtgaagatattgaggacatcctgcctcgagtcgaagaaatagaaatcatgctacgtatagcagagcttccattccttcctataaagcaagcatttactaaggcctttttacaatataacagctgtaaagataagttagcaaaggtggagccctactgtcaggagagcgtggactatagaagaaacaaagagcggtttcagagtttgaatcaggatttacaaaatgtataccaagagtgccagaaggctacaggtttagaatcggaagtgagtgcatatagagatcatcttagagagcagatcacagagtttgaaactcaagggctggacgtgataaaagaagaacttctttttgtgagtagtactctcaaaagtaaattgagctatgatccattaatagcagacattccctgtatgaagttttatgaggagtattatgatggcattgataaagcgagagttcaatcccgatggctggagaagtctgagaggtatagaaaggcgaagaagggattccaagagatgctgaaggaaggcctattcaaagaagatcaggctttgaaaaaagcagagtatagattacttcgagagaagagaatgaataaggagaagcttttgatttgcaataagatagaagcagctcagcagcgagtccaagaatttggaccctcggattcataatgaaaaatgacatatcggctcttctccctctgatatttcaggagtctcaagcaatgtttttcgcctagtgctctattttgtctaaattttagagaggaaggtcgcagctgaaggctttcatttgtagacattttatagaaaaatcagaaaaatacctttagaaaaaataagaacactttcatcttaaagtgactatagtgggattttttagatttgttttagaaggcattttaacgatgtatcattttcaaaagattcgcatgacacttacaactcagggatttgttcttaataaatctttaaggaaggattatgaactgtggtttgtctatggatcatgtccagaatctaaggtaaaactacagacttcctctcataaatggttgtgagacgaagttttctaagtgtgtggttagatagatgaaagaacttagacatgaatcctataaccgtgcattacataagctaagccatcaatgggttcgctactttctctatactttcgtatcgtgttccttcatagtcgccatatttacttttgcatggttaaaggtcctctatgttcccgaatgnaaggctggtgagatctcacgtatttctctgacagctcctatggattttnctttaagttggagcgctcataaattttataaacgtactgcccacatttcagaagcctttgggaaggtctatcatcttacactctctcccggtagtctcctcagcaaagaggggaacgccgatgaaaacactgactattggtttaaaaaagcagctgattttttgttgtctaccaactttgtcgatagttcaactcaaaaatgtcttaaggacttgtgtatatatcctcctttattggggaaagaaaagaaaaccttagaaatcaatatcaactcgaataaagggaatgttattgctcagtgcttctgccacttaaaaatttttcttatacaagaaaattgtccccagccctgttttgatgcaatcatggatattttgaagatcgccaacttcgaagtggccgtggataaggaaatgtcaggttgtgtgaaaggagagcttctcggaaaacgttgcattgagaaaattaccaagggcacacctatattagaaaagtatcagagaatcgatgatcgggatgctaaaattctaaagcagcttcgagcgcaactcctttcagtgcataccttattttcctgtagatccttatggggggctatttttgtagttttactcatacttctatggggctacggtgctttgaaagccctgtgtcctgagatgttgaaatctccccagcgctttatgctctatattgcgattctaactctttcgttgctgtggtgcagagggacagaaatcttttgcgcctattgggtttcctatctatcttacccaccgattttaccatttacagctgtactcctaggatattttctaggtcttcccatagcaggattttcctgtacgtttcttgcccttctctacaccttgggatccgatctttggaataatagttggtttctatctataaacctactttgttcttggagaatcttagtgagcttacatcgcgtcagtcgcctttcttcggtgttttgggcgtgtatgaaacttggaggcgtagctatgggaagcctgctcatgtttcggatatttacaaatacaatatcaagagaagccctatatgctgatgggatcgaaagcttcgtttatagtctgatcaccgcaatcagcgttgttgctttgatccctgtcttcgaggcttctttcggagcttctacaaacttttcgctcctcacctatttatctcccgaaaacgcattgctgaagcgtcttttcaaagaagctccaggtacctaccagcattccgtattagttggaagcttagcagaagctgcagctcaagctataggtgcagatagcctctattgcttggttgcagctcattaccatgatatcgggaaactgattaatccaggatttttcagtgaaaatcaaaaaatcttacaacaatctggtcattcgctatccccattagagtgcgctaagatgattatgcgccatattcctgaaggggtgaatcttgctaggcaggnagggcttcctgagtctgatatccaggtgatagaagagcatcacggaacctctgtgatccgctcagcatactacagccatatggtagagaacccttctacagggagctttgatgaggaattattccgatattctggaaataaaccctcctctaaagaaactacaatcattatgatcgcggattcttttgaagcagcctcgcgatctctaaaaaatgccagtcttccagatctccaaagactcatcgatcagattatccaagggaagttacaagacggtcagttttcttgttctccaattacgttagatgaactcgctttgattagcaagagcatggtgcaaaccctctacggagctctacattctcggatgaaataccctgaaatatcgtatcaaatttctatggattcctgccccaaaccctctataggaggaacttagttctctagattacgtggcgtttgatttccagcaaatgtgctttgaaatataattttttatgctctcatatgtagaaagagaaaaaagcattagaatgccaagaagcagtagcgacaaaacgaccaaaatgagaatagggactaaaattcccagtcctcctaggatggaaatgcaaattaggccgtatccgtttacgaaggcctcgacacactctttctgttcgcaagaaagcgaaggcgagtacccgatctgaactgtagtccgatctagggatttttttatttgataagcacggaccaaacccgcaattggtactagactcacaaatatcaaaaacacgttcgaaaagcagtctaaactaaagggtttttcatccacccaaatagcacggctttttttctggaatagtttgtttgagtccttgtgagtgtgacctgggatatatatcgtgtttcctgtcaatattttgtcatagtaaggttgatgtagcatagtaagccaaaaaatttcttgatagataactagcaggtaaacgatattccttcttttctctttcagtcaatggtattttttataagtcactaagaataaaaactcataaagatggtctagcttcgctttgcttatttttaacttctacagtgtctaaagggaaagaaatgtagtaaaagactacaaatgagacatgcaattacgccaaggtgttatttagcaacaataaatttgtaacagtatcagaggacactgattgacgcaaagcaaagcaacaaaggcgaaatggcaacatgattaactgaaaaagcacagaaataagtaggatagctaggagcagaagaaatatagggagaaggattccacatccaccaagaattccagcggtctttatagagcttgtcagtctagatgacatcctacatagcgcatttttgcagttagtatgaggggagatagcctaagttagccttgacattctcgtcattccagtttgtttgatgctttgcatatctcattgcatagaaatattccgagaatgggaaaccatgagacctatatacatccaggagtgctcccgagtagtcatgctcaggatgttagcagatctacagtttaccccagtcgaagttttatcatgagacgtatgctcatgggctggaatttcaatcgtgttccctcgaagagctccgagcagttaatggatggtcatcgcatacctcttatattttttgggaagcatcatcctactatatctattttaaatgtcaatagattttcttggctctccattttttacaatggagaaagggggttttgagaagaaaaccaaactcaccatacagattaaagtacaacaaaatctaaggaagaccagtttgtattttagcagcatcatagaaatacttgatggtttatgagagctatataggaggaccctctatccacatagtgtctccagattcaggtagtctctcctgcgattctatgaaaagcgaggggagagttatgaggagtggcagtgtataggggtaaataactgtttccatttacctgcgtgatccttggctgtaattgctaaggatccttgtagggcatggtatggaggaggaagttctatactataagcatgatgcaggtgaagtcttaaactcgcagctttcgcaagaacaatagcatcataatgaccacggtggagctgatccagcctctcttcaatagtgcctcgaatatccaagatctgtccttgaggaaacagttgttttagtactgcacttcgacgtagagaagaactccctagccggggactcaagggtaggggctcatgaacatagtggtcagcatacactaacaggtctgcaggatgtagacatcgtgttatggcaactacaggaagagagggagtctcaggaagatccttagcagagtgtatcgccagatcgcagactcctttatggactaaggcatcgacgccatcagtgaaaaaataagagttttctacaagatgtaaggggattttcttctcacgatccccagtagtctctgtagtgcttaactggaaccaaagtttgggataccacgagcgcanaaaagaaatacactcatgtacttgagctttcgctaaaatttgaatttctagaaagcaataacgaagggggcgcttgccctgacaggaaatcacttaaacaggggtcagagtaacagacggatagcatctttttattgttttcactccttgtaaacgaaagttttctcgaatttccttgggaagagatgaaatttgaccctcaggaagaattgcaccttcaaatcccatgagttttccctctttaatgcgtctctctaaatgagccacatgacggatttctcctccaagacctacctctccaattacaatggaattgttaggtaacaggcggttgtatagcgaggaagcaacggcaagtagagcccccaagtccgcagcaggctctataatctttaaaccccccgtaatggataggaagacatccatggtaaatagtttgacttgagcccttttttctaatacagctaaaagtaaagaaaagcgattcggatcgaatcccgcagtcttccttactggattagcaaagggagacgaagagaccaaagcctgcagctcgataagaagagccccagagccttctataataggaatgatcatagaccctgtcgttggccccgtcttttcctgaaggaaaagtcctgaagggttgctaacctctttgagaccatctgcatgcatcgagagaatcaatagttcatttgtagggccaaagcgatttttcacagagcgaatcatacggtaattcgcatgggaattcccctcaaagtaaagtacagtatctacaagatgttccaataccctaggacctgcgatctctccagattttgtcacgtggccgataataaatgtcgtgatctgcgcacttttagcaatctgcattagttcataagtaacttctcggacctgagctaccgatcctggtgcagagtttagcgtggggttaaatataatctgaatggaatcaataattaaaatatcaggttccaaagtcgctatttgctgcttgatattgtccaagtttgtttcaggaaataaataaatcaaaggtgatgagatattgagcgcttcgctctcaaagacgtctgcgttacagattcttcaccacaaacataaagaactttatacttttgcgatgccaatctctccgcagtttgaagaaggagtgtcgactttccaatgccgggatccccaccaagaagagtgaggcttccacgaacaacccctcctccaaggatgcgatcccaccccgcatgatcaataaatatccgagattcattctctaattcgatagagcttaatgcaatcgcactcgtagaagatcgcgacgaagtcccagatcgagcctgggggacatattcttcaaccaaagagttccagttgtggcagcctggacattgccctaaccatttaggagcagtagctccacattgattacacgtccattgtgttttggtttttgttgccatacgtatctagtgcctgttgtgctgcaattttttctgcttcctttttggatgacgcatttccctctccccaaacctcttgattcacaagaacctggatctggtaactgacatttccttgagcatccgtaactgccgtggattgatataccggaagaacgcgaaactgcttttgtgtgaactgctgaagaaggttcttaggattgccagacattaaaggaagaatttcttctctaggaggaaggaggggaacgtaagtttcctagctggagaaagacccccatccaaatacacagcacctaaaatagattcaaatagattggcataggcagaaagacgtcctcgctcactctggattttttccccttttcctataagaagataatccccaatccctagcatggttgtataacgacagcacgcttttgcattcactaaagaagcccgtgccgtggatagagttccctcatccatcgaaggaaagagaagaaaaagatgctcagtaacaatgagaccaaggacagcatctcctaaaaattctaaacgctcactatcttcaatttgcaccgccgactcgtttttatatgaggggtgagtcagcgctatttctaagagcttaggttgtgtaaatgtaaaatttaacttagcttcaatagccgtgatgtctatagggggatgcatagataggagggcgccgtccttaaacttagagttgggaatttttataggcggaaaaaagcttaaagtctatagtgcttttggatttgttatcttattcggatacgtatgaggtctgctctacacctccaacacttgcgccatttccataaccacggctctattttatttgaaaatcttctgactataaaagattgttttttattagaaacaaaattacaaaattttattgccaaagcatcaaaaactatagacactgtgcggtggagagagaatatatttcgctcaatgccagagatttatacagtcgttcgtaaacggcgtttggatttctttgcagcggaattggtgcaccgccccaagctttccctcgttcgagatctctgggtcttcccaggagaagagatccttgaaggagaagaagattgcatgcttttccttttactttcaggagatcgtgcaggaagcggtatattctttacaggaccctatccttcagatctttatgaattggagaagggaactacggggttgcttttagctttctcttctgtagggattccagtaatttaatctttcttctctcgctctagaaacagaaataagagacagggacttacagttcttattgcctccatgttttgattcagcatctttctgaaggaaaaatcaccatattctttacaaagagcttctcatgttttagttccccgcttgctttcaatacttaattacaaaaaccacaggccgaagtataacggctttgagtgatcaagtgtattctataggatttattttgaagggtggattcttaattaagaaaacctttctcaaacaatggattataccagaccaagcttgaagaatccctggactttatgcaaaaagggtgttaagagttcctgaaactatccttacataggatttctttaatgaaagaagtagaacaacgtatccggtcattatacgatgcagtaacagctgaaaatatttgtagatggttgtccaatgattgtacccaacaagatgcaaagactatcctaggatggttagatacagatcctgcacagcttgaagatctattcggagcgactcttacctttggtaccggaggactccgtagtcttatgggtatcggaacaaataggatcaacctgtttactatacgtcgaacgacgcaagggctggttcaggtgctccgcgctcatcttccccatcccggagatcctatgcgtgtagttgtcggttgtgatacccgccataactctatagaatttgctcaagaaactgcaaaagtcctcgcaggtaatggctgcgaagttttcttgtttcagtatcccgaacctttggctttagtctcctttacggtgagatacgaaagggccatcggcggagtgatgatcaccgcctctcataatcctcccaattacaatgggtataaagtttatatggcttcgggaggccaagttctccctcccttagatcaagagattgttgccgcctgtagtgcagtgaacgaaattttatcagtgccctcgatagatcatcccaatattcacctcattggaaaagaatacgaagccctttacagagacactttgaagcaactgcaactctatcccgaagcaaaccggatttcaggaaggtctttatctatttcctattcgccattgcatggaacaggaatttctctcgttcctcatgttctcaaagactggggatttttatccgtacatcttgtggaaaaacaggccataggtgacggcgatttcccaaccgtgcagctgccaaatcctgaggatccagaggctctgactctgggcactgagcaaatgctcgctaatgacgatgatctttttatagctaccgacccagatgccgatcgcgtgggcgtggtttgtctagaagacggccaaccctaccgatttaacggaaatcaaatggcgagccttttagcagaccacatcttaggagcttggagcaaaacaagacacttaggagaacatgataaattggtcaagagcttggtgactacagaaatgctctctgctatcgcaaagcactatcatgtggatcttattaatgtcggaacaggatttaaatacatcggagagaaaattgaatcctggcgcaattccacaaacaaattcgtatttggagccgaggaatcttacggttgtctctacggcactcacgtagaagataaagacgctattattgcgtcagcattgattgcagaagccgcactacaacaaaaattacaaggaaaaactctatgcgacgcactcctttctctttacgaaacatacggatactttgctaacaaaacggagtctgtggttttttccgcaaaaactgacgaacaagaaataagaaaaaaactttcacaccttgaggaaatcagttctgcgaattttttctcagggaaataccaagtagagaaatttgaaaactataagcaagggataggtttcaatcttctatcgaaggattcctacgccctcaccctgcctaaaacatctatgctctgttattattttagtgggggaggtcgggtaatcatacgaccctcaggaacagaacctaaaatcaagttctacttcgaaatgtcaactcattatccagagcgcgttaccgataaagaaatacaaaaacacgtgaagcagagagttttcaacatttagacgattttatttttgattttaaagagaaattttccaatttgtgagtggaaaaatcatcttggagaatatcctaaagctatttacacttgggctaaatctccttcagaataaggccttctttcaaggccattgttgtatccgaaacaaggttgagtagagtacttgctttcctagcaaaactttctgaacttaaatcaaggaggttaaatactaaaaaggtatgttgttatgagttttgttccttattctttaccagagttaccctatgattatgacgctttggagcctgtaatttcttctgaaattatgattttacaccaccaaaagcatcatcagatctacattaataatcttaacgcggctttgaagagattagatgctgcagaaacacaacaaaaccttaatgaactcattgctttagaacccgctctccgctttaacgggggaggacacatcaaccactctctattctgggaaactcttgctcctatcgatcaagggggaggacagcctccaaatcatgagctcctttctcttattgaaagattttggggtacgatggacaactttttaaaaaaattaatcgaagttgctgcaggagttcaaggctccggttgggcctggctaggattttgtcccgcaaaacaagaacttgtcttacaagcaacagcaaatcaggatcctctagagcctctcacagggaaactccctctgcttggcgtggatgtttgggagcacgcctattacctgcaatataaaaatgttcgtatggattatttaaaagcctttcctcaaataattaattggggacatatagaaaatagattttctgaaataatatcatctaaataatttgaatttggtgattttaattgcagtgttaataacattaatttaaaattgcttcctaacagaacctagattaggtggcttgtgcgtctattttcttacgacaaacccaagattaaagtgcaaaaaatcaaggcagatggttttagtggttggctcaagtgtaatcattgtcacgagatgattcacgcaaatgagctaggacaaaattataattgttgtcctaagtgctcctatcattaccgtattactgcgatcgaaagagtcaagctgcttgcagacaaagattcttggcgtcctctttatacggatctgaaatcccaagatcccttggaatttatagataccgatacctacgcaaatcgcctagaaaaagctcgaaagaatactacagaaagcgaaggcgtcattgtaggtatatgtactataggcctccaccccgtagccctcgccgttatggatttcaattttatggcaggatctatgggtgctgttgtagggganaaactgaccagacttatagaggaagccattgaaaccaggctccctgtaattattgtcagcgcttctggaggcgcacgtatgcaggaatctgtattttctttaatgcagatggtgaagacctcagcagctcttgctaagcttcatgaagcaggtctaccctatatttcagtcctcaccaacccaacttcaggtggagtgacagcctctttcgctgccctcggtgatattataatagcagaacctaaagcactgatttgtttcgcaggacctcgagtcgtcgctcaggtgataggagaagatctccccgaaggcttcaaaaatctgaattcctactagaacatggcatgattgataaaatcgttgagcgtaaagaattgaaaaccacccttcagactttacttgattactttttagcccaagaatacactggcgggaaaagtaaagctcctagagatctttcgaaaaggcttaaagagatttttttgttgacagatgacagtgaataaaacatcataccgcatcttgcaatgataacattatctgtaacgctatccttatgactgtattttgtgaattggattcaggaggagaacttcctgaatatactacgccaggagccgctggtgcggatcttagggcaaacatcgaagaacccatcgctctgctgcctggacaacgtgctttgatccctaccggaatcaaagcagaaattcccgaagtacgagctacaggtccgtcctcggagcggtttggctttaaagcacggcattactgttttaaattccccagggactatcgattcagattataggggagagattcgtgtaatcttaatcaacttcggtgatagtacattcattattgaacctaagatgcggatagctcaagttgttttatctcctgtagtacaggcaacgtttgttgttaagcaaganagtttagcggaaactgcccgaggaagtggaggttttggtcatactggagcaagctaagatgccatcctattgtcaaaatcaacaagatttttctttattctctcttttgtctcctagacttgtaatgtttttaggcaaacactcccgagatgaaatcctccaagatcttacagatcttgtggatgctgcaggcctacttgaagacaaacaagccttttttgatgctcttgtccgtcgtgaaaacatcatgtccacaggaatcggaatgggcgtggctattcctcacggaaaactcgaaagctgctctaatttttttattgctataggcatccatacgcaaggcattttatgggacgctattgacggagccctcgtacgcctcgtcttcttgatcggaggtccagaaaatgctcaagccgaatatctcaagttattatctactttgactttatctttgagagaagagtctcgtcgtcaacagttgttacaggtgaatacgattgaagaagtcatgaatgtatttgtggggatgtaaaaatggatttaaagttagatgaagtcgcctctttgttagatgtttccgaacatacagttctgcaatggcttaaagaaggagccattccaagctatagtatgaataatgaataccgctttagtcgtgaagaaatcgaagactggctattgcataaccaagcactcatgatccaagaacgcggcgaagataaagaagcacttaaagatctttctttgaaatatagtctctacaaagcaattcatcgtggcggcgtgctttgcgatgttgtggttcatagtaaagaagaagctctccaatacgcctctaaatacatcgcccaaaagtttcaattagacgaaagcgtactttttgaaatgctctcccacagagaaaatcttatgtccacaggtataggagaaggaattgccctgccccatgccaaagactttttaattaatgcctactatgacattgtggttcctatgtttcttgcagagcccatagaatacggggctctagatggaaaacctgtaggcattcttttcttcctttttgcttgccaggataaaagtcacttaaacttagtaaataaaatagtccatctcgggatgtctttaaatgcccgaagcttttttaaaaattatcctaacaaagatcaacttttagcgtacgttaaggaatgggagtcccaaactcattaatagctagagtttaaaaagatttttaagtccaagttgtgaaaaaaatccttttgttgctatggtgatcctcataggcttccaggagattgtagtcgcatgatgagctctaagcgtacctcgaaaatagcggtgctttcaattttattaacatttactcactctatagggttcgcaaatgcgaattcgtccgtaggtcttggcacggtctacattacatccgaggttgtaaagaagcctcagaaaggatcagaaaggaaacaagccaaaaaagaacctcgtgctcgtaaaggatacttagtcccttcttcaaggactctttcagctcgagcccaaaagatgaaaaactcctctcgtaaagagtcttcaggtggttgtaacgaaatttctgcaaattctacacccagatctgtaaaattacgaagaaacaaacgtgcagaacaaaaggcagctaaacaaggattttcagctttttctaacctaactttgaaaagcctacttcctaaacttccttcaaaacaaaaaacttcaattcacgagagagaaaaagcaacctcaagatttgttaatgagtctcagcttagttccgcacgaaaacgctactgcacaccatcttcagccgctccttccctatttttagaaacagaaatcgttcgagctcctgtagaaagaactaaagaacttcaagataatgaaattcatattcctgtagtgcaagtccaaacgaaccccaaagaacaaaatacaaagacaactaaacagttggcatcccaagcctcgattcaacaatctgaaggaaccgagcaatcattgcgagagctcgcccaaggtgctagcctacctgtcttagtgcgctctaatcctgaagtgtctgtacaaagacaaaaagaagagttattaaaagaactcgtagctgaacgtagacaatgtaaaagaaagtctgtaagacaagctcttgaagctcgttctttaactaagaaagttgctagaggcggttctgtgacctcgactttacgatacgatccagaaaaagcggcggaaatcaaaagtagacgcaattgcaaagtaagtcctgaagcacgtgaacaaaaatattcatcttgcaaaagagatgctcgcgctaatgggaaacaagacaagacaactcctagtgaagatgcttctcaagaagaacaacaaactggggcaggactcgtacgcaagactcctaaatctcaggttgcaagtaatgctcagaacttctaccgaaattctaaaaatacaaacatagatagctatcttacagctaaccaatacagctgtagttctgaagaaacagattggccatgttcttcctgcgtctctaaacgcagaactcacaacagtatatctgtatgtaccatggtagttactgtcattgcgatgatcgtaggggctttgattatagctaatgctacagaatctcaaacaacatcagatccaactcctccaactcctactccatagttgtatagcccttgctggacgtgtagctctacccaaaatcttagatagccttcttatctatgattttagtgggtagagctttccctcccgactcgtcttcttttcaattttctctttgtaattacactttatctctctttctatctttttcgggagtaccttcttattttagatagagaaagcttagtttttcttttgtttaagaaataattataagctcgttaatataatcaatttgcctttaagtaaaatgataaaactatctaatctatagtgatttgtgttgtatagcattattatattgcatcgtgtcagatttgcgtgttcattctaggggaacaccgacccagactcatagtgagatctgtgatgcccatcctaccaacagatttttgaaaaaacaccctacacttgacctatgtatgcgaattgtaagcacaattgtctctgtctttatgattttagcagacatcgttctcctcctgggctccctcttacttttacccctccttatagttttactttgggaatcttcttaggaagatgcctttctacgtctaatattgttttattataattttaaaaatgattataatttcttattaacttcatgaatatttacatttaataaaagtataatgtataattagttatgactaaaattcaatgtagtgctcagtattatagatctcgaccggccgagagggcccaaactcctccgcaacctttccttgctagggatcgcgcggatttttgggagagacatcctagattcagtgcatgttgtcgtgtcttattactcgttgcttgggtggttctcgctctactgtttctctttgttatgcttcttcctctagccgctgggtcgtatttacttgctttttaaggtattcttcacctaaaaacttgtgttttgggtgcctgtagctatttcaaaggcatgtttttatcgatcggagcttctctttgtttgggcgagtccgttcgtatctttgtaattcttctacgatttagttttatccttatcttagaccaacctcttcataggtggatcctgtagaggaactattcgactcaggagtcgtagacctaaggtattcgtgtttaaagataaaagttttattttctaagagttttttaattattaagatttttatttaaaaatatatcttttgattagatctctaatacgattattataaatataatatgtttttcaaaaaaaattatatgacagattttcctactcacttcaaaggacccaaacttaaccccattaaagtaaatccaaacttttttgagaggaatcctaaagtcgcaagggtactgcaaattacagccgtagtcttaggaatcattgccctcttatccggtatagtactcattataggcacccctctcggagctcctataagtatgatcctcggcggatgtcttttagcttctggaggcgccttatttgttggtggtacgattgctacgatattgcaagctagaaatagttataagaaggccgtgaaccaaaagaaactctcagagcctttgatggaacgccccgaattgaaagccttagattattccctagatctgaaagaggtatgggacctacatcattcttgttgtcaacatcttaaaaaaatagacctgaatctttccgaaacccaaagggaagttctaaatcaaatcaaaattgatgatgagggaccctccctaggggaatgcgccgctatgatttcagaaaactacgacgcatgcttaaagatgctcgcgtatcgtgaggagctcctgaaagaacaaacccaataccaagagacacgattcaatcagaacctcactcatagaaataaagttttgctctccatcctctcaaggatcacggacaatatttctaaagcgggcggggtcttttctttgaaattttccacgctaagctcgcggatgtcacgaattcataccaccaccactgtgattctggctttaagtgccgttgtttctgtcatggtcgtagcagctctaattccaggtggcattttagcactacctatacttttggctgttgctatttctgcaggagtgattgtcaccggactttcctatctagttcgtcagattttaagtaacaccaagcgtaatcgtcaggatttttataaagattttgtaaaaaatgtagatatagagcttcttaaccaaacggtaactttacagcgattcctctttgaaatgctcaaaggtgttctgaaagaagaagaagaagtctccttagaaggtcaagattggtatacacaatacataaccaatgcacccatagaaaaaagattgatcgaagagatcagagttacctacaaagagatcgatgctcagaccaaaaaaatgaagacagacttggagttcttagaaaatgaggtgcgttccgggagactgtctgtagcgtccccgtcggaagatccaagtgaaactcctatttttactcaaggtaaggagtttgcaaagttacgtcgccaaacctctcagaatatatccacgatttatggtccggacaatgaaaatattgatcccgaattttccttaccctggatgcctaaaaaagaagaagaaatagaccatagcttagaacctgttacaaagttggaacccggttcaagagaagagttgttgttggtagagggggtcaacccaaccttaagagaactcaatatgagaattgcacttctacaacaacaactatcaagtgtccgaaaatggagacaccctcgaggggaacattacgggaatgttatctattcagatacagaactcgatcgtattcagatgctagaaggcgcattttataatcacctcagggaagctcaagaggaaatcacccagtctctcggagaccttgttgacattcaaaaccgtattttagggatcatagttgaaggggactcagattcaagaacagaagaagagcctcaggaataggattctcatataaataacaacaaactaagagctgtttttttctcttacagctctttctagacaggatctctaaggtcctaaattcatgttttccattatcatccttgcctacgacctaggctgcatccggattctataagtacgtactctcagttgctttttctacaagttgggctagcccacaggctgcaaacagaaattttatttcttgaaatctattttcttatttacaaatttatttccctaaaatgaataaactaaggagtttatatggcaaatcccacacaatcgcgaccaccgagtccggagataagtatagaagaactagagcttcaagaacttgcaggatcctcgaatactgagactatttctaatacacctcccccgtcatgcgctgctactgccgaagaagtatctctttttattgagggaggccgtagaaactcagaagatgaggagggacctctaggatcttgtgaggtgtacgatgttgtctgtataacaaaccaaggagatcctgaggttagagatcacgaagtcagagttatgtacattaacggcagcggtcgaacacaacatgagggtattcttgatgctatgaacatctgtgatctcagaggagaacccgtcaggttcatacacaatagtgggtatggtttagggagctgcttcttagggattcgaaatcgtattcctcctagagataatgttattagccaagcaatacaagcacgatggaatgagttttttattttcgcagaaaatgcaaatcgagattacatcgttcttttctctggtaatggaggtctctatcttcaagtcgctttagataactccatatactcacatcatattctttgtgttggcattggaagcagttattatatccaaggaaattatcgtgttcacaactaccgtgtgacaggggattggacgaccctcctggatcgtcggggggcaacagcagtaaatactacaacgttgccttatgcagattctgctgaaggactctttttaccctcagtacgctgtccctcataccaatgggcattgcgttgtggagaacagtgcctgatcatggataacaaccaacaagttgggtttcgcccccaagattcctcttcagaaatcgccttagtagtaaatttaaatcaggaccacagcacctggactcgtctgattgaatggatagatcggggggattctcaggctgttctagaattgaatcctcaaccgagtcattgtcgtgatattgcattgactgcactatacgctacaacaaggatttcttctttacttcaagagtgcctaatgatttctgtgacttatgctccagaggttttcgtcacctatgctatcgttacaggatactctataatgaccttgcgctattttattctattattaacaaatcgtccaggctgccggcggcattttcgtgttttaagattagcggctttagggttgcagtccttaggatttttgactgtattgcttgatcatatcaatgtaacacggagagtcaatcgccgcccccccttaatatcagtaatcttctgtactgctagttttgccacaggaagtttcatttatgtagacttaacacgcatgtttttcacgagcttacgttcgcgcttgcaattgtttgttcaaagaagattaacaggaagaggtctaccactgagaagggtttttgtaaatcacctagactctttgagattttctcaaaatgctttgataacctttcatgggggactttttatgcctctcataataggtttttttaatcagctggtcattcaggttcctcgagttgtcatcagaccaaataccactgccgtttatgatctcaaccagacctcacaggaagcgtgggactctggagacgtattagctataggacagaccataaacttcttgctttgcatgattctattggtcatcaatacctttttcttcgtgagatccgtacgaaggaatttgcatcgtagacctcatcgatagcaactgtgcagaaccctactctttagatttcaaaaataactgataccgaaatgcccctgtactataggtgccattgttccttagaaatctaaagagatcggcctctttcctttatatctgaaatcatgactaggaataaggagtttactgtctttaaacgcatctcgttgacattaaaaccaaataaaaacatgtttttatttggtctattctgttaaaatagataggttttttttaactctgatcctaaagtgtcattgaaaaggttcagggtattcttatagaggtccccctatggcagtagaaggaagagtaaatagttctcaagccttaaatcaagattgtcaagaagtcttagcaaataaacaatcgaaaggcctcctaaggtgcagaattctatctatagtagtagctgttatcacctttatcgccggggttgtgttgatagctttaacattagcctctattttaacttctgttccctacttagcgttaggagtgtttttactgattgtcactctgggatgtataatatttgctctttgctctgagaaaataaaaaaggttcccccgactcctatttcacataaagaggagatcattgcctggttcgaagaaagaaaaaatattgatatggaaaaggaaaaagaagatccggagcattttggaagaaccgctacggatatcccaatgagatctgcattagatcagtttaaccactcttgtcaccatattcacgagagccccgcgttaacagaaacttatagaagccatcaagatgttctcctctttaaggactggtgtcctgttacgttgcctgatgtaacctcagaagaagaagtcttaatacgcagtgtggttggtagctatttattaatggaggcgtgcgttccaaaagtatccatgcttatcgacgaactccataataagcttatntctccttccgaaagagagtgcctctttatagataaaaaaacattgcagcgaaaagctagttttcttttcactcagaaagatctcgcaacattctttcttgacctatacgcgggtgaatgatggtcatttagcaccgtttcgagcaggagcaaaatggatcttaatacattacgttaggttaagacgtcaacacaatcagaacgacttttttactccaggacattcttgttactatgctcgtctagcctttaaccaaacccaacgactctatcatcaattattcaatgtagaaaagcttcgtagtatctatgcgaacatggataaagaccctctatgtcacccatgggctntcattcctatctatgatttattgaaaacagaggaccatggagatggttttctagaacaacaagaagatcgggaatatccaagtagagctgctcaagatcaattttggggctaatgtttaaaggatcagttttttaaaacacggattctaaattgtaattcaggattactatttttcttcagaaagcttagacctactgcttgtgaggcaggggagtagtcttacaccccaaaggaaatataccgaataaaaatatctagaagaggctctagatacatctttggaaatagactctccgttcttagatactctagattatctaaatttcatgaggagagatcaaaagaaaatgttccaagatgttatggaacattttctctctagtttatttttttaatagcataagagtttgtttaatatcttgttcacgttgaaatgctagctcgcggcttactttttctttattccaatctaaaatggactttttaaactctaaatccttctctcggagctctaattcgcgatttttcaactccaattcgcggttccgaatgtcaaattcacgattaaaacaatcgataatttgggcaacttgtccagattgacacatcttagaaatgccctctaatctttgaaccatgctatcgaaaaaatctaagacatattcattagaagactctttatcagtcttttcagaaagaccttctgagtcagaagtaccacaactttcctcaatctcttccgaacttttttgcccgtcggaaattgcttgtagttcattacgtatctctttgccctcttcgattggggtttcaatcagctcattgagttgtgttattaaaacttcaggatcctcctcaattctggactgagaagagacatcctcattgcaaatgccttttaggggagcggagaaactgcaggagaaaattaaactataaataaaaaatttcttaatcataaaactttaaagtaattaatttaataaatcgattttaatggtattatagaaatataaaaatcaaaatacaaaagaaatttgtgaataaaaaaaagaatagcaaattattttttgttcatgatttgtgaattttaaaaaatattatttattaaatacaaacctgttaacaataggttgtgaaaggagattacgatttttttgagatatccttattaactacaaaatggtcttacctatattaggttaattaaaataatataaattatttatgtgttattgatttataattaaattttctttatgtttatctactcatatttaatcttggtataatgacaanncccccaccatcccgatcctcctctcctcctccctatgattggatagaacttcaagatctggggaatacgaataacaatagcagtcgagctacccccccccgaagtaggcggtgagctgcccccgtatttttcagctagcaactttgttgtaatagagcggggcgctcctagtctgccttctccacagcaacttttatctcttccagaatattctaggcagccgccaccaggatattttgatgaaacagcaagcataactagcagaacgagtgaagagatgtttggtaccttggtctctaccttgtgttgtcctgccaactcggaaagggattgggaagatcacgaggtaaattgtatttatattgctagtaccagtgacactcaacttgaagctgttcaaggtgggatgcatatcactgagttacgtggtgaacccgtaagagttctttatgagacgggtcacttatacgcatttgctagagaaaatacatgtcattcccgtttagaagttagccatacagttagagctatgacgtacttttgggaccgattttttagtcgccactggaacgtggggcgacgtttcctagtattttaccagggaaacggaggcgcctatgttcaggcagccctcgattcatccatgcatactcaggatatctatgttctagggctctctccgactgtctatattagagggaactatcacgtacagcactaccgtgttcgaggattttggccctcttgcctggattctctagcggcctgtgcggaaaatacatcagtacttcctacggggaatcgagtgacggaatcttttacccctctctattcagccacacatttgataacgcgatacggtatggtgagagatgcctgttggtttgttctgagggcatgggaatgcttccagaaacgcaacaacaaacatctcctttaacttcactagaagggggacatgaggtagctctagttctcaatccccagcagaacccagaggctctaagtattgcctctagattgatgcatgaagaaagaggtgggagattagaatctaactatatgcctggacgttctagtaatcctttcatgacaagtatgtatgttctcgtacggctgaatacacttgctcagatctacctgatgtctccttattattctttccaaagcaacgacattgtatgccttatctttataagcagtgctgctgtagagacagtaagctacatattcctgactgtaactgactcaacttgtgggcgtcggtacctgcgtgtcccacggctagtttgtacagggttacgtaacctggcgttacccacaactctactagagctacttattttgtcataccctcgatcagtagagggggtacctttcaatgttagattcattcttggatatatgtgcactactagagttgtattttttgcatggaacttgatcctccactggcctttccgatgtctacgccatggaatccaattgtttgttcatagaagtataataggacatacgttgggagcaagaattactgatttaaccctagcaagtatgcgatacgcaatagtgtttccatctatagtaagttcatgcttgttaactgctcttgctcatgcaaatactaacatacttgccttggacccttatagattgatcgaatctggagatttaagacgtcccgcatttaatgatgatgaaatgcaacaagcagataatccttgggatgcttactctatcggcttagttataaacacgtgtatctacatgttaattttattcgcaaacctaattttcatggtgtactctgtacgaagataccatagatcccgccgctaagagtagcttgccttaagtttcgtactatctattcttcggcaatgcaagataagaaaacattgattaagagcgaatagaaccctaaaaaactgtgtttattttttattacagttttttagatataaagatctctttttagttccgtatctctaaatgaaatcaaagggttccttgtgaagaaaaccctacagattgcaaccgaagaatagactcgaaatgaggggacacctttgggaatctctgttcgtaggtgcgtgactgattagaaaaaaagttttgatttttcaaatgaaataagcctactttgtattagaggctgattcataaactttcctaagaaatatatgataagaaaaacttggggcggacaggatttgaacctgtgacctacgggttatgagtccgcagctctaaccactgagctaccgccccccaaggtaagagagcaatgctaacacataattttctaatgatcaagggatatccacgcctgaacggaatgtagttatgtttgaggcggctttaagtattgtaccgctatttgcttcatacgcatgtacagagattctccaccattcaacctaccaaaagaaagatagggagtcaggcgctgaaaaaaaattggcttgcatgtcaaaattgtagaaggagtttctccagaatatacctcagtaaataaagaggcgattcctgaagacactaaagctttcgtataagtgaaaaaaaataaaattccatcttgatatacctcgtaaagatataaatcactctgacaacctacaaccaagttctccttcaacatgcgcttcttgtcaaaagcatcccttgaagaactattttccatcaacttaagatacagatgatctttttgaaaaggttctggaaatagctcctcaataattttatgctgtttttttaaacacctagcgtgttgcagaggacagataaattccaaaatacttctcaatgatttgattcaatgatacgatcaggctcttttttgatttgttgcaaagtctgagataaggtcataatacattggtcagctcttgcaataatatcatcaggactgttgttattcaagtcaaggtatgagctagttacaccacattctggcatcgaaaaacaatagggcataggctgatttaagtttagtttcaaagaagctaaaagattcgctgtggcaggatccgtttggttgttgcgatttatctctataagcgcattcaactgcttttgattgatcatttggtgcttgatgatttgatgctggttgatcgcttgctcaatgttctctattcgttttttgtgggccttgcgatcaatagcataagtagcctcatctcctaagcgcgccccataaacagtattaatacttaattgatttccaatggaaaaacctataacaagaccaacagcctgaggaaccgcataaatcaacgctgaaatagaggctatcatcgtggctaaaagaatttgtcgtgttccgttcggatctaattgcaaaattccatggtttatcaaattccatagactgtttacatgcctatgcttgttctctttatctaaacatgtcgctgtaaaaatgccaaaaacaacgccaatccctagacccacccctaaccaaattgttagagttaaagcaaccgtatgatgacatactaaaattaatgcccaagctaaaatataaagtaatatatatttccaattcctttggaggaataaaccaattttttcaaccgcgttttttaaacgagttgtccaagaaaatgaattttgattataaggaactaatttcagatcagttaatgcaactaacgctgaaataggagggctgactataggagagtcccctgaagcatttgaatcaggagagttcgatctagaagagctcagtctgtcacaaaatagttcttgaggaacgtattggtcagaaggcgaaattcctccagaagatagtggagtagacattcgatagtgaaaaaaataaaacaataagcactatattaaaataaggactttttctttgtaaacagaggtttttgtgcttctatagcccctctagtttactcaatattttattggtagtattcgcaaggttttgtgaaagggatttgactttttctaaataacaaatataatcctaatgcgtttatagaataggggaaatgaagagcaccgttctatttttagggctgaatctacccactaggccagccagtcacaggcttaggcttaaaagattttgttaaggataattgatcaatggcgaaaaaagaagatactcttgtactcgaaggtaaggtagaagagctccttccaggaatgcattttcgtgtaatactagaaaacggtatgccagttaccgcccatttgtgcggaaaaatgcgtatgagtaatattcggattgcttgttggagaccgcgttactgtcgagatgtccgcctatgacttaacaaaagctagggttgtctacagacatcgttaattatattttctattgatgttttaaaataagtgacatagactaggcggtttttcaagaccgggaagcaatgcataagtaagcccagatagctcagtggtagagcacttgcatggtaagcaagcggtcgtaggttcaattcctattctgggcagaaagaatggttggagtaatcaataatttttaagaggattttgagatgtcaaaagaaacttttcaacgtaataagccccatatcaatattgggacgatcgggcacgttgaccatggtaaaactacgctaacagcggcaattacacgcgcgctatcaggggatggattggcgtctttccgtgactatagttcaattgacaatactccagaagaaaaggctcgtggaattactatcaacgcttctcacgttgaatacgaaaccccaaatcgtcactacgctcacgtagactgccctggtcacgctgactatgttaaaaatatgattacaggcgccgctcaaatggacggagctatcctagtcgtttcagctacagacggagctatgccacaaactaaagaacatatcttgctagctcgccaggttggagttccttatatcgttgttttcttgaataaagtagatatgatctctcaagaagatgctgaacttattgaccttgttgagatggaacttagtgagcttcttgaagaaaaaggctacaaaggatgccctattatccgtggttctgctttgaaagctcttgaaggtgatgcaaattatatcgaaaaagttcgagaacttatgcaagctgtggatgacancatccctacaccagaaagagaaattgataagcctttcttaatgcctatcgaagacgtattctcaatctctggtcgtggtactgtggttacaggaagaatcgagcgtggaatcgttaaagtttctgataaagttcagctcgtgggattaggagagactaaagaaacaatcgttactggagtcgaaatgttcaggaaagaacttcctgaaggtcgtgcaggagaaaacgttggtttactcctcagaggtattggaaagaacgatgttgaaagaggtatggtggtttgtcagcctaacagcgtgaagcctcatacgaaatttaagtcagctgtttacgttcttcagaaagaagaaggcggacgtcataagcctttcttcagcggatacagacctcagttcttcttccgtactacagacgtgacaggagtcgtaactcttcctgaaggaactgaaatggtaatgcctggagataacgttgagcttgatgttgagctcattggaacagttgctcttgaagaaggaatgagatttgcaattcgtgaaggtggtcgtactatcggcgctggaacgatttcaaagatcaatgcttaaaaatgaatttcgcgatgattttcatcatcgcgattttctgggtgtgtagcttagctggtagagcagtggcctccaaagccgccggtcgggggttcgattcccttcgcacccgtagatttaatttttaatctagaagttggtttatgaaacaacaacacaatcgtaaggctttatctcgcaagattggcacagtgaaaaaacaagccaaatttgcaggaagctttttagatgagattaaaaaaattgaatgggtaagcaagcacgatcttaagaaatacataaaagtagttcttatcagtatttttggttttggatttgctatttatttcgtagatcttgtgttgcgtaagtcaatcacatgtttagatggtataacaacctttttgttcggttaattgcatgtataaatggtatgtcgttcaagtttttacagctcaagaaaagaaagtaaaaaaggctttagaagattttaaagagtcttcaggaatgactgattttatacaggaaattatcttgcctattgaaaatgtcatggaagtgaaaaaaggagaacataaggtcgttgaaaaatacatctggcctggatacctcttagttaaaatgcatctgactgacgagtcttggctctatgttaaaagtacagcaggtatagtcgagtttcttggaggcggagtccctgtagctctttctgaagatgaagtaagaagtatcttaacagatatagaagagaagaaatcgggagtggtgcaaaaacatcagttcgaggttggttctagagtgaaaattaatgacggagtctttgtcaattttatcggcacggtttccgaagttttccatgataaaggacgcctgagtgttatggtttctatctttggaagagaaactagggtagatgatttagaattttggcaagtggaagaggtagccccagggcaagaaagtgagtagataggttaaaatcagtgtattcttattccttatcttcttataattttagtttttcgtttcttaccctctgtttgtagaggtgtctcagtgcaaagtaaggtttagtatgtcggtaaaaaaggtaatcaaaataattaagttgcaaatccctgggggtaaagcaaatcctgcgccacccataggaccagctttaggtgctgctggagtcaatattatgggcttctgtaaggagtttaatgctgcaactcaagataagcctggagacttacttccagtagtcatcactgtttatgctgataaaacttttacttttataaccaaacagcctccagtctcctctttaataaagaaaactttgaatctggaatcaggatctaaaattcctaatcgtaataaagtaggaaaacttactcaggctcaagttgaagcaattgctgaacaaaaaatgaaagatatggatattgtccttctagaatctgcgaaacgtatggtggaaggaactgcccgtagtatgggtatagacgtagaataaattgttacttgtagagctgtagaattatgacaaaacatggaaaacgtatacgaggcatcttaaagaactatgatttctcaaaatcatattctttgcgggaggctatagatattttaaaacaatgtcctccagtacgcttcgatcaaactgtagatgtatctatcaagttagggatagatcctaaaaagagcgaccaacaaattcgtggagccgtttttttacctaatggtacaggaaaaactttaagaattttggtttttgcttcagggaacaaagtcaaagaagctgttgaagcgggcgcagactttatgggaagcgacgatcttgttgaaaaaattaaatccgggtggctggaattcgatgttgctgtcgctaccccagatatgatgcgtgaagtaggaaaattaggaaaagtcttaggacctagaaatctaatgcctacacctaaaacaggaacggtaaccacagacgttgctaaagcaatctccgaattgcgtaaaggaaaaattgaatttaaagcagaccgcgcaggcgtatgtaatgtaggcgtaggtaagttgtcttttgaaagcagtcaaatcaaagaaaatattgaagctctaagttctgctttaattaaggccaaacctcctgcagctaaaggtcaatatttagtctcattcactatttcttccactatggggcctggtatttctatagatactagagaattaatggcatcttaatcttaaagagggaaaatgaaacaagaaaaaacattacttcttcaagaggtagaagacaaaatttccgcagcacagggattcattttattaagataccttagatttaccgccgcgtattctagagaattcagaaactcactttctggagtttctgcagaatttgaagttttaaagaagagaatcttctttaaagctatagaagctgcaggtttagaggtagattgtagtgatacagatgggcatctcggtgtagtcttttcctgtggagatcctgtttctgccgcaaagcaggtactggactttaataaacaacataaagactctttagttttcctcgctggaaggatggacaatgcgtctctgtctggtgcagaggtagaagctgtcgccaaattgccatctcttaaagaacttagacagcaggttgttggtttattcgctgctccaatgtcccaagttgtaggaattatgaattctgtcctttctggagtgatctcctgtgtggatcaaaaggcaggaaagaactaaagaattaaaattaaaactctcaaaataagtaagggtgacaaaagtgacaacagaaagtttggaaactttagtagagaagttaagtaatttaactgtactagaactctctcaattgaaaaaattattagaagagaagtgggatgttactgcttctgctcccgtagttgctgttgctgctggtggtggcggagaagctcctgttgctgccgaacctacagaatttgcagtaaccctcgaagatgttcctgcagataaaaaaatcggcgtcttaaaagtcgttagggaagtaactggattagctttaaaagaagctaaagaaatgacagaaggtttacctaaaactgttaaagaaaaaacttctaaaagtgatgctgaagatactgttaagaagttacaagatgctggcgcaaaagcctcatttaagggactgtaatttgtagaaaagaaaaatcgaaagatttttcttttctttttcttttcatgtataaaaaaccgaatgctccctttagaagcatacgtaggcttaatttagggaaattttgtcgcatcaaaatagcaggagaactcgcacgttgaagtgccctgaacgggtcagtgttaaaaaaaaggaagatatcccagaccttccaaatcttatcgaaatccaaattaagtcttataagcagtttcttcaaattggaaaattagcagaagaaagagaaaatatcggtttagaagaggttttcagggaaatttttcccattaaatcctataacgaagctaccgttcttgagtacctttcatataatttgggtgtgccaaaatattctccagaagaatgtatccgtagaggaattacctatagcgtcactttgaaagtccgttttcgtttaaccgatgaaacgggaatcaaagaagaagaagtctatatgggaacgatccctctaatgactgataaagggacatttatcattaatggagctgaaagagtcgttgtttcccaagttcatcgttctccaggaattaactttgaacaagaaaaacattccaaaggtaatattttattctccttcagaatcattccttatcgtggaagttggctcgaagctattttcgatattaatgacttaatttatatccatattgatagaaaaaaacgtagaagaaaaattctagcaatcacctttatccgagctcttggatactcttcagatgcagatatcatcgaagaattcttcacaataggagaaagttctcttagaagtgagaaagactttgctcttcttgttggaaggattttagcagacaatattattgatgaagcctcctctctagtttatggaaaagccggagaaaagttaagtacagcaatgttaaaacggatgctcgatgctggaatcgcttctgttaagattgctgtagatgctgatgaaaatcatcctattatcaaaatgctcgctaaggatcctacagattcatacgaagccgctttaaaagatttttatcgtagactacgtccaggagaacctgcaactctagctaatgcacgttctactatcatgaggctcttctttgaccccaaacgttataatctaggacgtgtagggcgttataagctcaatcgcaaactaggcttctctatagatgatgaagctctgtctcaagttactttgagaaaagaagatgtgatcggagccttaaagtatctgattcgtttgaaaatgggagatgaaaaagcttgtgtagacgatattgatcatcttgctaatcgacgtgtccgctctgtcggagaactcattcaaaatcaatgtcgttcaggacttgctagaatggagaaaattgttagagagagaatgaatttattcgatttctcctcagatacgttgactccaggaaaagttgtctctgctaaaggtctcgctagcgtgttaaaagatttctttggccgctcccagctttcgcagtttatggaccaaaccaaccctgtagctgagttaactcacaaacgacgtctttctgcattaggtccaggaggactaaatagagaacgcgcaggatttgaagttcgtgacgtgcacgcaagtcattatggacgtatttgtcctattgaaactcctgaaggtccaaatattggtctgatcacctctctttcctcttttgctaaaattaacgaatttggattcattgaaactccttatagaattgtaagagatggaatcgtaacagatgaaatcgaatacatgacagccgatgttgaagaagaatgtgtgattgcacaggcttcagcaagcctagatgagtacaatatgtttacggaacccgtctgttgggtacgttatgctggagaagctttcgaagcagatacaagcaccgtaacccatatggatgtttctccgaaacagctcgtttctattgttacaggattgattcctttcttagagcacgacgatgcgaaccgcgccttgatgggctccaatatgcaacgtcaagcggttcccttacttaaaaccgaagctcctgttgttggcactggattagaatgtcgtgctgctaaagattctggagctattgttgttgcagaagaagatggtgttgttgattttgttgatggttacaaagtagttgttgctgcaaaacataatcctacaattaaacgtacctatcatctgaaaaagttccttagatctaattcaggaacttgcattaaccaacagcccttgtgtgcagtcggtgatgtcataactaagggtgatgtgattgctgatggacccgcaactgatcgtggagaacttgctttaggtaaaaatgtactcgttgcctttatgccttggtatggatacaactttgaggatgcgatcattatctctgaaaaattgatcagagaagatgcctatacctctatttatattgaggaattcgaactaacagcccgagatacaaaattaggaaaagaagagatcactcgtgacattcctaacgtatctgatgaagtattggccaatctcggtgaggatgggatcattcgtatcggtgctgaggttaaacctggggatattcttgttggtaagatcacaccaaaatcagaaacagaattagctccagaagagcgtctgctccgtgctatttttggtgaaaaagctgctgacgttaaagatgcatctttaacagtgcctccaggaactgaaggcgtcgttatggatgttaaagtcttcagtagaaaggatagattgtcaaagagtgatgacgaacttgtagaagaagctgttcatcttaaagatttgcaaaaaggatataaaaaccaagttgcaactttaaaaacagaatatcgtgagaaattaggagctctcttattaaatgagaaagcacctgcagccattattcaccgtcgtacagcagaaatcgttgttcatgaaggcctactctttgatcaagagacaatagaacggatagaacaagaagatttagtggatcttttaatgcctaactgtgaaatgtatgaagtgttgaaaggacttctatcagattacgaaacggcattacaacggctagaaatcaattataagactgaagttgagcatattcgtgagggagatgcagatttagatcatggtgtcattcgccaagttaaagtctacgttgcctctaagagaaaacttcaagttggagataaaatggctggacgacacggaaataaaggtgttgtttccaaaatcgttcccgaagcggatatgccatatctctctaacggagaaactgtacaaatgatcctgaaccccctcggggtgccttcaaggatgaaccttggacaggtattagaaacacacctaggttatgcagcaaaaactgcaggcatttacgtgaaaacccctgtttttgaaggattccctgaacaacgtatctgggatatgatgatagaacagggattaccagaagatgggaagtccttcttatatgatgggaagacaggtgaacgctttgataacaaggtagtgataggctatatctatatgctaaagctcagtcacttgatcgctgataagattcacgcaagatctatagggccatattctttagtcacgcaacaacctctcggtggtaaagctcagatgggaggacaaagattcggggaaatggaagtttgggctctagaagcatatggggttgctcatatgctccaagaaattctaaccgtgaaatctgatgatgtctcaggaagaacaaggatttacgaatctatcgttaagggggaaaacctcttgcgatcaggaacgcctgagtcgttcaatgtgctaattaaagagatgcagggtctaggacttgatgttcgtcctatggtcgtagacgcttaaaaaatgacgttttggagaaaataatgttcggagaaaattctcgagacattggagttctttctaaagaaggactatttgataaattagagataggcatagcttcagatattacaattcgtgataaatggtcttgtggagaaatcaaaaagccagaaactataaattaccgtacgtttaaacctgaaaagggcggtctattttgtgaaaaaatccttggtcctactaaagattgggaatgttgctgcggaaaatataaaaaaataaaacataaaggaattgtctgcgatcgatgcggagttgaagttactctttcaaaagtccgtcgtgaacgtatggctcatatcgagttagcagttcctattgtccatatttggtttttcaaaacaactccatcacgcattggtaatgttcttggaatgacagcttcggatctggaacgtgtcatttattatgaagaatatgtagttattgacccaggtaagacagacctaactaaaaaacaacttcttaatgatgcgcaatatcgtgaagttgttgagaagtggggtaaggacgctttcgttgctaaaatgggtggcgaagctatctatgatttgcttaaatccgaagatctccaaagcttgcttaaagatcttaaagagcgtttacgcaaaacaaaatctcagcaagcgagaatgaagttagccaaacgtcttaaaatcattgagggatttgtttcttcatccaaccacccggagtggatggtattaaaaaatatcccagtagttccacctgatctccgtcctcttgttcctttagatggcggtcgttttgcgacttctgatttaaacgatctctaccgccgtgtaattaatcgtaacaatcgtcttaaagcgatcttacgtttaaaaacaccagaggttattgttcgtaatgaaaagcgtatgcttcaagaagctgttgatgctctttttgataacggtcgacatggtcatccggtcatgggagctggaaaccgaccattgaaatccttgtcagaaatgttaaagggaaaaaatggacgcttccgtcaaaatcttttaggaaaacgtgttgactactctggacgttctgtaattattgttggtcctgaattgaagtttaatcaatgcggattgcctaaggaaatggctttagagctattcgaaccctttattattaanagactaaaagatcaaggcagcgtttataccattcgttctgctaagaaaatgattcaacgaggagccccagaagtttgggacgttctcgaagagatcattaagggacatccagtacttcttaaccgagcacctacattgcaccgtttaggaattcaagctttcgaacctgtattgatagaaggtaaagcgattcgtatacaccccctagtttgcgcagcgtttaacgctgacttcgacggagaccaaatggccgtgcacgttcctctatctgtagaggcacaactggaagctaaagttttaatgatggctccagacaacatcttccttccttcctcaggaaagcctgtggctattccttcgaaagatatgactttaggattatattatctgatggcagatcctacctattttcctgaagaacatggaggaaaaactaagatatttaaagatgaaatcgaagtattgcgtgctttaaataacggtggattcattgatgatgttttcggagatcgtcgtgatgaaacaggacgcggtatccatattcatgaaaagattaaagtgcgtattgatggacaaattattgagacaaccccaggaagggtattgttcaacagaattgttcctaaagaactcggcttccaaaattacagcatgccaagtaagcgtataagtgagcttattttacagtgctataagaaagtcggtttagaagctactgtacgtttcttagatgaccttaaagatcttggatttattcaagctacaaaagccgcaatctctatgggattgaaggatgttcgtattcctgatatcaagagtcatatcctcaaagatgcctacgataaggttgctatcgtcaaaaaacaatatgatgatgggatcattactgaaggggagcgtcattccaaaactattagtatttggactgaagtttccgaacagctttcagatgccctctatgttgaaattagcaaacaaacacgtagcaagcataaccccttgttcctgatgattgattctggagcccgaggtaataaatcccagttgaaacagttgggagcgttacgaggattaatggcgaagccaaacggagcaattattgaatctccaattacttcgaactttagagaaggattgacagttttagagtactccatctcctcacacggtgcgagaaaaggtttagccgatacagctctaaaaactgccgactccggatacttaacacgtagacttgtagacgtagcccaagacgtgatcattaccgaaaaagattgcggtacgttaaatcacattgagatttctgcaataggtcaaggttctgaagaactcttgcctcttaaagatcgtatctatggacgtactgtagctgaagatgtctatcaaccaggtgataaaagtcgactacttgctcaatcgggtgatgtactcaactccgtacaagcagaagcaattgatgatgccggtattgagacaattaagattcgttctacattaacgtgcgaaagtcctcgcggagtttgtgcaaagtgttacggcctcaatttagctaatggtagactcattggcatgggtgaagctgttggtattattgctgctcagtcgattggggaacctggaactcagttaacaatgagaacgttccacctagggggtattgctgctacgtcttcaactcctgagattattacgaatagtgatggtatcttagtctacatggatctccgtgttgttctggggcaagaaggtcacaatcttgtcttgaataagaagggagctttacatgttgtaggtgatgaaggtcgtactctcaatgagtataaaaagctgctttcaaccaagtctatagaaagcctagaggtatttcctgtagaactaggagtgaaaattcttgttgctgacggaactcctgtttctcaaggacaaagaatcgcagaagttgaactacacaatattcctatcatttgcgataagcctggctttattaaatatgaagatttggttgagggaatctctacagagaaagttgtgaacaagaacacaggacttgttgaacttattgtgaaacagcaccgaggggagttacatcctcagattgctatctatgatgatgctgacttgtcagaacttgtcggaacctatgcgattccttcaggagcgattatctctgtagaagaaggacaacgggttgatccaggtatgttgttagctagacttcctcgcggagctatcaaaacaaaagatattactggcggtttgcctcgtgttgctgaattagtagaagctcgtaaacctgaagatgctgctgacatcgccaaaattgatggtgttgttgacttcaaaggaattcaaaagaacaaacgtattcttgttgtctgtgatgaaatgacaggtatggaagaagaacatctgattccattaaccaaacatttgattgtacaacgtggagatagtgtgattaagggcagcagcttaccgatggtttagttgttcctcatgaaatcctagaaatttgcggagttcgtgaacttcagaagtacctggtaaatgaggtgcaggaagtttaccgtctgcagggcgttgacattaacgataagcatattgaaattattgttcgtcagatgttacaaaaagtacgaattactgacccaggtgatacgactctgctctttggcgaagacgtgaataagaaagagttttatgaagaaaatcgtcgtaccgaagaagacggtggtaagccagctcaagctgttcccgtcttattgggaattacgaaagcttctttgggtacggaatcgtttatatcagcagcttctttccaagacacaactcgagtcttaacagatgcagcttgttgtagcaaaaccgactaccttcttggatttaaggaaaatgtgatcatgggtcatatgattcctggtggtacaggctttgaaacgcataagcgtattaagcagtatctagaaaaagaacaagaagatctcgtttttgattttgttagtgaaacngagtgtgtttnntaactaggtgacacagtcttttatcaaggaggttatgtttacaacctccttgataggaatgtttttttttgttaacgttgcctagagatcaacagtgatgccaaggtgcctatgtctaaccaatttgatcaattaaagaagttgagcactatcgtttgtgatagcggagacccagagctagttaaagcctcgggatctcaagacgctacaacaaacccttctttgatcttaaaagtggcccaagaacccaaatttcaagagctattaaacgaagctgtagtttggggaatccgacagaacggtgatgatcttcagactctttcttttattttagacaaaattcaggttaactttgctctagaaattatcaaaaatatccctggtagaatttctcttgaaattgacgctaggctttctttcaacgttgaagctatggtacagcgtgccgtattcctttcgcagcttttcgaagctatgggaggagataaaaagcgcctgttagtaaagattcctggaacttgggaaggtattcgagctgttgaatttttagaagcaaagggcatagcatgtaatgtcactttgatttttaatttagttcaagcgattgcagctgctaaagctaaagcaactttaatttctccttttgttggccgtatttatgattggtggatcgcggcttatggtgatgaaggttactctatagatgcagatccaggtgtcgcttcagtatcaaatatttacgcgtattacaaaaaattcggtattcctacgcaaattatggcagcatcttttcgtacaaaagagcaggtactagcattagctggttgcgatcttttaacgatatctccaaagctgctggatgagctaaagaaatctcaacacccagtaaaaaaagaattagatcctgcagaagctaaaaagttagatgtgcagccaatagaactcacagaaagcttttttcgctttttaatgaatgaggatgctatggctacaganaaacttgctgaaggaattcggatatttgcaggagatactcaaattcttgagactgcaattacagagtttataaagcaaattgctgcagaaggtgcgtaattgcttactaaattaagccgatttggggataccaccttaaagcgaaatgaaaaataagatggactataaatcgcaactagtattttcttgcccttgttgttgcaaaggcaatgtttgtttctcagtttttaacttagacgttattttaacatgtaacgtttgctcatctacttatacattcgattctgtcatacgtaatgagattcgtcagtttgtagcactatgtaaaaggatacatgatgctaattctatacttggaaatgctactgtgtcggtatcggtagaagacaaccaaatggatattccctttcaattgctgttttctcgtttccctgtagtattaaatctctctttagatggaaagaaaatagctattcgtttcctctttgatgctttaaatacaagtatcttacaccaagaaagcgatcttatttcttaatcctaagtttatttgttttcgttttgcagagcttccaaagctttttcaaggattgcatctcctgaagtagcctctttaccaccgcgaatttggaaagaagagactacttttaaaaaggtaaatgaaagttctgcatagtcatccaaagttgcagtgcttgtaaaaatataagcagtatggtcaatgactgttgtcgcttgtaaacaaaatacacgtccccatgaagagtttttctctgttttgataatagtaaactctccgctaggagattgaatttgggtaaatattccagattctaaagtcatctcattggctttatgataggctaagatttcctcaatatactcttttgaagatttggaagtgatttcctgagcaatgttgatggtaggagtgagatttcctttccccttgcctataaggagaacatctaatttttctgggagctgtgttttatcgtcaatacactgccaaagagagggtgtctgtatgctatagtttttccctgaatagcgaacccattggacgggggagagcgagggttttttctcaaattttcctatttttttccgcgcagtgctcttgttttatagcgagaaacactcgcattcgttgctgccgaagatcgtatcctagaggtccttcttgcttttgcttgctttgagtgagatgcagagacttgagttcttggctgagcagagaaagcagggaattgagctacaatcaaaataaaaagaataaaaaatttcatagaaaattatgtagttagttgtacattaagatagattcaaagcacatagcatagctctctaccttatacaagattgtatcgttttcagaaaaatattcccaatagggaatctttggatctagaagaaggcctactttcaaacaaacatagaaaggcaattcttcttttttgaattctatgtttataggaattttttcttagagagttagaggagagcatgggatttatcttgaagatatcaaagcaattttcttctagaacatctctgcaacccgtttcttatttgtggatcagttgaattaaatgctagaatgacataaactgttagattagtggaatcataataacatcttttttaaagaaaattcttttctaaaagaataagcggtaaaatattatggcgaatcttaatgccgatggtaagcttaagcaaatctgcgatgctttgcgtttagacactctaaagcctgcagaagacgaggctgcggcgttattgcataatgctaaagaacaagcgaaaagaattattcaagaagctcaagaagaagccagaaaaatcttagagacggcagaagagagagctcatcaaaagataaaacaaggcgaagttgctctaagccaagcagggaagcgcgctttggaagccttaaaacaggctgtagaaaacaaaatatttagagagtctttagtagagtggctggagcatgtaaccaccgatcctgaggtttctacaaagttaattcaagctttagtgcaggctttggaagctcaaggggtttcaggaaatctgaccgcctatataggaaaacatgtgagtcctagagctgttaatgagctcctaaggaaaggctgtaacaacaaaaactacgaaagaaaagtgtagttgttggaagttttgttggtggtgttcaattaaaagttgaagaaaagaactgggttctggatcttagttcctcagctcttcttgagattttcacacgttatttgcagaaagattttcgtgaaatgatttttcaaggatcttgactttaataaagtcatgaaaagatcttctcaatatttaaagttgtcgtcatgactcaatattattttttatcttcatttttacctactcagctaccagaatccgtacctctattttctatttcggacttagacgatctactttatttaaacctatcagaaaacgatctttgcaattacggacttcttaaacgtttttttgatttcgaaaatttcgctttcttttgggctggtaaaccgattcccttctcttttggggaggtgactcaggaaaatgtagaaagaatgctttcctctcagcagtggtctgatgacaatgattttgaagatttctttaaggattttttaatgaatcataagtcttctcaagatcgtttgaatcacttttcagatttatttagagagtttctttcctatcatcaaacgaattcttcaaagtttcttcaagattatttcagatttcaacaacaacttcgtgttgtactcgcgggattccgtgcaagagtcttgaatatggatgtttcctatgttttgcgcgacgaagatagttccgatccagttgtgctcgaggtgctcatgcagaaagattctcctaattatgagcntcctgaagagtttncggatttacagggcgttttggatgactaanggccttctngcctnanacactgaatnggngcgcntngccnntataccaatttcataaactcgagggattttgttccngactcctactttgatgggaatgtcattttagcaagatgtgctacatatatgtttgctattcgtacagcttagcaagtgttgaaaaaggaagagaaattattaatcatatagaaaaggcaatcaaatggtaacagtttcagaaccaaacttgctcagggacatgttatagaagcttatggaaacttgttacgtgtacgctttgacggatatgttagacaaggtgaagttgcatatgtcaacgtagataatacctggttaaaagcagaagtgattgaagttgctgatcaagaagtcaaggttcaggtatttgaagatacacaaggcgcgtgtcgaggagctcttgttacgttttcaggacatcttttagaagccgagttagggcctggcttgcttcagggcattttcgatggacttcaaaatcgtcttgaggtgctagctgaagatagttctttcttgcagagaggcaagcatgttaatgctatttctgatcataatttatggaattatactcccgtagcttctgttggggatactttaagacgaggagatcttctaggaacagtacctgaaggacgatttactcataagattatggttcctttttcttgctttcaagaggttaccctgacttgggtaatttctgaaggaacctataatgctcatactgtggtcgcaaaagctcgagatgctcagggtaaagaatgtgcctttactatggtgcaaagatggccgatcaaacaagcttttattgaaggagagaagatccctgcgcataagattatggatgtgggtttgcgaatcttagatacgcaaattccagtattgaaggggggaactttctgtaccccaggaccttttggtgcagggaaaacagtcttacaacaccatctttctaagtacgctgctgtagatattgtgattttgtgtgcgtgcggagagcgtgctggtgaagttgttgaggtattacaagagttccctcatcttatcgacccccataccggaaagtctttaatgcacagaacatgtattatttgtaacacatcatccatgcctgtggctgcccgagagtcttcgatctatttaggagtgacgattgcagaatactatcgccagatgggactagatattctgcttttagctgattctacatcccgatgggcacaagcccttagagagatttcgggacgtcttgaagaaatccctggagaggaagcatttcctgcatacctgtcttctagaatagctgctttttatgagcgaggaggagctatcaccacgaaagatggttctgaaggatctttaactatatgtggtgcggtgtctcctgcaggaggaaactttgaagaaccagtcactcaatctacattagctgtagtcggagcgttctgtggtctttcaaaagcacgactgacgcacgtaggtatccttcaatagaccctttgatttcttggtcaaaatatttgaaccaggtaggacaaattttagaagagaaggtttcaggctggggtggtgctgtgaaaaaagcagcacagtttctagagaaaggttcagaaatcggcaagcgtatggaagttgtcggtgaagaaggggtttctatggaagacatggaaatctacttaaaggcagaactttatgatttttgttatctccagcagaacgcattcgatcctgtggactgttattgtccttttgagagacagatagagttattttcattaatcagtcgtatttttgatgctaaatttgtttttgatagtcctgatgatgcaagaagctttttccttgagctgcagagcaagattaagacattaaatggcctgaaatttctttcagaggaatatcatgagagtaaagaggtcatagttagactgttggaaaaaacaatggtacaaatggcgtaaggatatgcaaacaatctacacaaaaataactgatattaaaggcaatttaatcactgtagaagcagagggagctcgtttaggggagcttgctacaatcacaagatccgacggaagatcttcgtatgcttcggtattgcgttttgaccttaagaaagtaactctccaggtttttggtggcacatcgggcttatccactggagatcatgtcacgttcttagggagacccatggaggtcacatttgggagctcattattaggcagacgattgaatggtatagggaaacccattgataatgagggggagtgttttggagaacctatagagattgctactccaacatttaaccctgtctgtcgtattgttcctaggagtatggtacggacaaatattcctatgattgatgttttcaactgtttagtgaaatctcagaaaattcctattttttcttcttctggagaacatcataatgctttgttaatgcggattgctgcacagacagacgcggatatagttgtgattggtgggatggggcttacattcgtagattacagcttttttgttgaagagtctaagaagctaggatttgcagataagtgtgtgatgtttattcataaagctgtagatgctcctgtagaatgtgttttggttcctgatatggccctagcttgtgctgaaaaatttgctgtagaagagaaaaagaacgtcttggttttgcttacagacatgacagcgtttgctgatgctcttaaggaaatttctatcactatggatcaaattcctgccaatcgtgggtaccccggttccctatattctgatctagctttacgctatgaaaaagctgtagaaattgccgatggggggtcgatcaccttaattactgtaactacgatgcctagtgacgacattacacatcctgttcctgataacacaggatacattacagagggacaattctacttgaggaataatcgtatagatccgtttggttctctttcaagattgaagcagctggtcattggtaaggtgactcgagaggatcatggagatcttgcgaatgctttaattcgtctttatgcggattcccgtaaagctacagaaagaatggctatgggattcaagttatcgaattgggataagaaattacttgcgttttccgagctttttgaaactcgtttgatgagtttagaggtaaatattcctttagaagaagctttagatattggttggaaaattctagctcaaagtttcacttctgaagaagtgggaattaaagcccagttaataaataagtattggccaaaagcatgtctgtccaagtaaagctaacaaagaactcctttcgactagaaaaacaaaaactagcacgattacaaacgtaccttccgacattaaaacttaagaaagctttattgcaggctgaggtacaaaacgctgttaaagatgctgcagagtgtgacaaggactatgtacaggcttatgagcggatttatgcttttgcggaattgtttagtattcctctctgtacagattgtgtagagaagagttttgagattcagagtatagataacgactttgaaaacatagctggtgttgaggtccctatagtccgtgaggtaacactatttccagcttcgtattctcttttagggaccccgatatggttagatacgatgctctcagcatcaaaagaacttgtggtcaaaaaagtcatggccgaagtctcgaaagaacgtctaaagatcttagaagaagaattacgagccgtttcaattcgagtcaatttatttgagaagaagctcattcctgaaactacgaagatactcaagaagattgcggttttcttaagtgatcgtagcatcaccgatgtaggtcaagttaaaatggcaaaaaagaagatagaactccggaaagcaaggggggatgagtgcgtttaaatatacataagtatctctttataggacgcaataaggcggattttttttctgcaagtagagagcttggtgttgtagagtttatttctaaaaagtgtttcattaccacagaacagggccatcgttttgtagaatgcttaaaagtttttgatcatttagaagccgaatactccttagaagctttagagtttgttaaagatgagagtgtttcagtcgaagatattgtctccgaggtccttactttaaataaggaaatcaagggacttttagaaactgtaaaggcattaaggaaagagattgttagagtcaagcccctaggggcattttcttcttcagagattgcagagctgtctagaaagacaggaatatctctacgatttttctataggacgcataaagataatgaggatttagaggaggactctcctaacgttttttatctttctacagcgtataattttgattattatctagttcttggagttgtggatcttcctagagatcgctacacagagattgaagctccacgttctgtaaatgagttgcaagtagaccttgcaaatcttcagcgcgagattagaaacagatccgaccgtctttgtgatctctatgcctatcgtagagaagtcctgcgagggctttgtaattatgacaatgaacaaaggcttcatcaagcaaaagagtgttgcgaggacttgttcgatgggaaagtctttgctgttgcgggttgggtcatcgtcgatagaatcaaagaattacaaagtctttgcaatcgttatcaaatttatatggaaagggttcctgttgatcctgatgagacgatccctacctaccttgagaataaaggtgtaggtgtgatgggagaggatcttgtacagatttatgatactccagcatattccgataaagatccttccacttgggtattttttgcttttgtgctcttcttctctatgattgtcaatgatgctggctacggcctgctatttctaatgtcttcgcttctattctcttggaaattccgtcgtaagatgaagttctctaaacatctctcacgcatgctgaagatgaccgctattttaggtcttggttgtatatgttggggaacgacaacaacttcattttttggaatgagttttagtaaaacgagtgtgtttagagaatactctatgacgcatgtcttggctttgaaaaaggccgaatactacctgcaaatgcgtcctaaagcctataaggaactcacgaatgagtacccctcgttaaaagcgattcgtgatcccaaggccttcttgctagcaactgaaataggaagtgcaggtatagaatctcgttatgtagtctacgataagtttatcgataatatccttatggaattagcgctgtttattggagtcgtacacctttccttaggtatgttgcgctatcttcgttatcgttattctggcattgggtggattctctttatggttagcgcctatctttatgtgcctatttatcttggtactgtatctttgattcattatcttttccatgttccctatgaattaggaggacaaataggatattatggcatgtttggtggaattgggcttgctgttgtactggcaatgatacagaggagttggcgtggagttgaggaaatcatttctgtgatccaagtgttctctgatgttctctcgtatctccgtatatatgctttaggacttgctggtgctatgatgggagccacgtttaatcaaatgggagcaagattgcctatgcttcttggttctatagttattcttcttggtcactccgtgaatatcattctttctattatgggaggagtgattcatggacttaggttaaattttatagagtggtaccactacagttttgatgggggaggtcgtcccttacgtcctctgagaaagattgtctgtagcgaagatgctgaggcttcggggattcacttagataataattcaatagtttgataaacttcccttgcctttaagagaggaacatgaaagaaatcttgtcaagttcgtaattatttaaaggtatttgaagggagcacatgaggtaagtatgattgatatgtctgttgttgggcctgctttggttttaggcttagctatgattggaagtgctataggatgtggcatggctggagtcgcttcacatgcagtaatgtctcggatagatgaaggacatgggaagttgataggaatgtcagcgatgccctcatctcagtctatctatgggtttattttgatgttgctgatgcaagcagcaataaaaaatggaaccctatcgccagtaggagggatcgctataggtttatctgtgggagccgcccttttagtatcttccgtgatgcaaggcaagtgttgtgtcagcggaattcaagcttatgctcgatcttcgtcaatatatgggaagtgttatgcagcgattgggattgtcgaatctttttcattgtttgctgttgtttttgcgctactactactctaaacttgtatttgggcttacagttctgttagccgcaataagtgtgatttgcttattgggttgttcagaaccttcattatcttcttttacagaatacgtaggtccagagtatagtgcagcagcccaactcagtatcgagcagagttgtcatgatgaggtgtatggacagcaggttgtagtgacctggagtcttccctcacgtatgaggaaatgccttcccgtgactttgtatctctgggtatattatggtaatggcaaggtagagaaattgacctatgaggtcaatcaaagtgcggggtatcgagtgtattgcctcaagggactagaatacaaagaactccagggcattatctcctatccgttgcgttatgtagcgggaatcaagagattgtgagtaggcgtcaccatctttggatggaggttatctctctggattctccttaataaaaaatatcaaatcataaacatgccctatttttagaaaaagcagcataaagataataaaatagaactatgctacttgctctaagtttacagggtatttcttagtagagatcacaaatttggattaagaattatgacaacagaagattttccaaaagcatataactttcaggatacagaacccgagttgtatgtgttttgggaaaagaatgggatgtttaaggctgaagcttcgagtgataagcctccatattctgtaatcatgccgcccccaaatgttactggggttttgcatatgggccatgctttggtcaatacccttcaagatgttcttgttcgttacaaacgcatgtcaggatttgaagtttgttggattccaggaactgaccatgcaggaattgctacccaggctgtagtggaaaggcatctccaagcttctgaaggcaagcgtcgtacggactatagccgagaagactttttgaagcatatttgggcatggaaagaaaagagcgaaaaagtcgttctctcccaactgcgacagctggggtgttcctgtgattgggataggaaacgctttactatggagccgcttgcgaatcgtgcggtcaaaaaagctttcaaaaccctatttgaaaatgggtatatttatcgtgggtactaccttgtaaactgggatcctgttctccaaaccgccctggcggatgatgaggtggaatacgaagagaaagatggatggctctattatattcgctatcgtatggtaggttctcaagagtctattgttgtagcaacaacaagacccgaaacttcattaggagacactgggatcgcagtgtctcctaacgacgagcgctatgcatcatggattggtgcgagcgttgaagtgccttttgtaaatcgtcagattcctatcattggagatgcttctgtagatcctactttcggaacaggagctgtaaaagtgactcctgctcatgataaggacgattatcttatggggaccaaccatcatcttcctatgattaacattctcaccccctcaggaggaatcaatgagaatggtggaccttttgctgggatggctaaagagaaagcacgcgaggagatcctcattgcactagaagaacaggggttatttgtaaggaaagagccttataagcttcgtgtcggtgtttcttatcgatctggagctgtaattgagccttatctttctaaacagtggtttgtctctgtgtcagagttccgtggagctttgcgagagtttgtagaaagtcaagatattaagattttccctaaagactttgtcaaaaattacttgtcctgggtcaaccaccttagagattggtgtattagtaggcagctgtggtggggacatcgtattcctgtttggtatcataaaaatcatgacgaacgggtcctttgttatgatggagagggcattcctgaagaagtcgctcaagatcctgattcttggtaccaggatcccgatgttctagatacctggttctcttcaggcttatggccactgacctgcttggggtggcctgatgaaaattctccagatttgaagaaattttaccccaccgctctattagttacagggcacgacatcttgtttttctgggtaactcggatggtgttactatgttcttcaatgtcaggggaaaagcctttttcagaagttttccttcatggattgatatttgggaagtcttataagcgttataacgactttggtgaatggtcctatatttctgggaaagagaagctagcttatgatatgggagaagcgcttcccgatggtgttgttgccaaatgggaaaagctctctaaatccaaagggaacgttatcgatcctttagagatgatcgctacttatggtaccgatgcggtacgcttgactttgtgttcttgtgcaaatcgcggagagcagatagatcttgattacaggctatttgaagaatacaagcactttgcaaataaggtttggaacggagctaggtttatctttggtcatatctcagatcttcagggcaaggatttgcttgcaggtattgatgaagactctttagggcttgaagatttttatattttagatggttttaaccaactgattcatcagcttgaggaggcttatgctacctatgcttttgataaagtggcaactttagcttatgaatttttccgtaatgatctctgttccacgtatattgagattattaaacccacactctttggtaagcagggaaacgaggcttcgcaatctacgaagcggaccttacttgctgttcttcttattaatgtattaggagttcttcatcctgtagctcctttcattacagaatctttatttttaagaattcaggataccttaggagcccttcctgaaggagatggggatgcatttacaggtcatgctttacgtatgctacgttctcgtgcttgtatggaagctccctatccaaaagcttttgatgttaagataccccaagatcttagagaatcttttactttagctcaaaggctcgtttatactattaggaatatccgtggggagatgcaactggatccgcgtttacatctgaaagcttttgttgtttgttctgatactaccgagattcagagctgtatccccatacttcaggcattaggagggttagaatctatacagctcctagataaagagcctgaaaagggcctctatagctttggtgttgttgatactatacgcctggggatttttgtccctgaagagcatcttcttaaagagaaagggcgtttagaaaaagaaagagttaggttagaacgagctgtggagaacttagagcgcttattaggagatgagagtttttgccaaaaggcaaacccgaatcttgtagttgcgaagcaagaagctttaaagaataatcgtatagaattacaaggcattcttgataagcttgcatcgtttgcttagacagagaggaccaacgatctttggagcgctatgatattgttagaattattggaaagggaggcatgggtgaagtctatcttgcctacgatcctgtatgttctcgtaaagtagctcttaaaaaaattcgtgaagatcttgcagaaaatcctcttttgaaaaggaggtttttacgagaggcaagaattgccgctgaccttattcatcctggtgttgttcctgtctatactatttacagcgagaaagatcctgtatactacacgatgccctacatagagggatatacactaaaaaccttactgaagagtgtatggcaaaaggaatccctgtctaaggaattagcagagaaaacttctgtaggggcatttctttctatctttcataagatctgctgcactatagaatatgtccattctcggggcattcttcatcgcgaccttaaacccgataacatcttattaggtctttttagtgaggctgtaatcttagattggggagcagcagttgcctgtggagaagaagaggatcttcttgatatagatgtcagcaaagaggaggtgctctcttcaagaatgacaattccaggaagaatagtagggactccagattatatggctcctgagaggctcctgggccatccagcttctaaaagtacagacatttatgctttaggagtggttctttatcagatgctcactctctcttttccttatagaagaaaaaaaggaaagaaaatagttcttgacggtcagagaattccaagtcctcaagaggtagctccttatcgagaaatccctccgtttctttccgctgtagtgatgagaatgttggctgtagatcctcaagagcgctattcttcggtaacagagcttaaggaagatatcgagagtcatctgaaagggagtcctaaatggactttaaccacagccctgccacctaaaaaatcttctagttggaagctaaacgaacctattttactttctaagtattttccaatgttggaggtctctccagcgtcatggtacagtttagcaatctctaatattgagagtttttctgagatgcgcttggagtatactctttctaaaaaaggcttgaacgaaggctttggtattttacttcccacgtcagaaaatgctttagggggagatttttaccaggggtatggcttttggctgcatattaaggagagaaccttatccgtgtctctggtgaaaaatagcctagaaatccagaggtgctctcaagatttggaatctgataaagagaccttcttgatagctttagagcagcataatcatagtttatctttgtttgtcgatggtacgacttggcttatccatatgaattatctgccaagtcgtagtgggcgagtcgctatcatagttcgcgatatggaagatatcctggaagatataggcatttttgaaagtagtggctctttgagggtcagttgtcttgctgttcctgacgcttttcttgctgagaagttatatgatcgcgctttagtgctttaccgaaggatcgcagaatctttcccaggacgtaaagaaggttatgaagcaaggttcagagcaggaattacagttttagagaaggcctctacagataataatgaacaggaatttgctctagccattgaagaattctcaaaattacatgacggggttgctgctcccttagaataccttggtaaggctttagtatatcagagactccaagagtataatgaagaaattaagagtttgctattagcattgaaacgttattcgcagcatcctgaaatctttaggcttaaagaccatgtggtttaccgactccatgagagcttttataaacgggatcgccttgctctggtgttcatgattttagtattggaaatagctccccaggcaatcactccagggcaggaagaaaaaatcctggtttggttaaaggacaaatctcgggctaccttattttgcctcctggatcccacggtcttagagctgcgctcttctaaaatggaattatttttaagttattggtctgggtttattccccatctcaatagtctatttcatagagcttgggatcaaagcgatgtgcgagctttgatcgagattttctatgttgcttgtgatcttcataaatggcagtttctctcttcttgtatcgacatatttaaagagtctcttgaggatcagaaagccacagaagagattgttgagttctctttcgaggatttaggggcatttctttttgctattcagagcatctttaacaaggaagatgcagagaagatctttgtttctaatgatcaattatcgccaatccttcttgtttatatattcgatctttttgcaaatcgtgctcttctggaatctcaaggagaggctatttttcaggctttggatctcatccgaagtaaagttcctgaaaatttttatcatgattacttgcggaatcatgaaatccgagcgcatctttggtgccgcaatgagaaggctctaagcacgatttttgaaaactatacagagaaacagctaaaggatgagcaacatgaactgttcgttctctatggatgttaccttgctcttatacaaggtgctgaggcggcaaagcagcattttgatgtatgtcgtgaagatcgcattttccctgcttcattattagctagaaattacaatcgtttaggtcttcccaaagatgctcttagctatcaagagcggcgtttgttattgcgacaaaagtttctctatttccattgtcttggtaaccacgacgagcgtgacttatgccagactatgtatcacctcttaaccgaagaatttcagctttaaatgatttgtgtatggtctcaggatcttagattctaagttcttaagaatcgagttcttcattgcagatatactttttcagcaacgagtccttacttgcatagatatctttgggagatcctgaaaaaagaagctttcctccttgtttcccagatcccgggcctatctctatgaggtagtccgcagattttaacaacttcacatcgtgatctatgtagattaccgagtggccgctatttatgagggagcgaagtttttctggaagatgttgttttttgattggatctagagaagaaaagagctcatcaatgagaaatagggtgggagtctctggagtttgatagagaaaataagcagttttcagtgctgttttttcacttacagataaggaagagagtttttggccgataggaagatagccgagtcctatgtcaagaagtgcttttagaggtttttgtatctttttaataaagggaaatcggagggctacagtttcaatcggagtatgcaaaagttctccgaaatgcttgccttcataaaggacttcctgagcaagaggttggatacgaaatcctgagcaggtagggcagggacgcttttctaaagcgtaaaaagcccgatctatccattggtacccaagtccttggcaatccgagcattgtccttgttttgtatttgtactgaacatcgtagatgaaatattcagggctttggcttgtgttagcgaagcataaaaagctctcaaggaaggagcaatatcgaaataggtgctgatatcagagcgttgcgatgaagctattggatgagagtcgatcactacaaggtcggaaaatgttgtagttccttttgctatcaggagctcagcttgttttttaaatccttctaaaagtagagaggttttcccagatcctgaaactcctccaatggcaaccaaagcatggagaggagccgatactttcaaattctgaatatggtgtatcgatagatttacctttaatgtacgatcggatcctcgggtatggtttgccttacttatagaaagtggagccttgggacaaacctcagtttggggaacgttagcgtgtaggtctacagatgggcaaacctcagtatcagaatccatgagaaatcctccttgaggtccagatcctggacccaagaagatcgcgtgatcggcatgggggattaaagaacaggaccgatcggtagcaattactgtgttgttatttgctacgagctctttaagtagctgaactatggtaggaagatcctgggggtgcagtccagaaagaggctcttcgaataagtagacgatgttggtaagatttatagagatctttttggcaaggtgtaaacggtagttctcaccatcactgagagtgtcttgcctttgcccaagggtaatatagctcaggcctactttactaatgaaggtaaggcgattcatcaaatcttggattatgcttcttgtatcatcggttcctatagtgtttaggaaagattctaagaatgtggcatcttcctgataaatatccaaaagcgaggtattgttgattcgcacatagttggcataatcgtttagtcctgagcctttgcaggcaggacaggaggtaagagcaagcagaggttttatcaggggagagtcagattcagtatctagctgctccataagtagtgcgttcattcctggaaactctgaggaacctcggcaaaaatttaggaactctttcgtagttagcaactttagtggttgagaggcattctcatctttaagcagcttttgtacaggcttcatatagctctttggaaagaataaactaaaaaactctaaaggagtgtagtgagcaattttttctttatgctcttctagggagatttttaggatttcgccacgacctccacatgtaaggcaacgaccctcgggatggtcagaagnaagtagttgatgtgtaatctcgggatagagtctccctttcttatctttccaccctaaggaatacgagagttttcgttgctttttctgagagatatagatccagatttctgaggatagagaaaaagctaccgagattgcggataataaagaggaactatttttcggggatacttttgtatgttgtatgactatagcaggttctatgagatttagaggcagcctctcatctaaatcatagaggttcccctcagaatataactttatgaatccctctttttgtttttcttgaaggaagatttccagatcagaaccaagaggaatcggagaggttatagtgacgtaatcgtctttatagcttttgagtaggctatcgatgatggtctgaggtgtagttttagagagtttttcttctgtaaggggagaaaaaggttctcctaagatggcaaagagcttttccagaccattgcttaatccgagagccgaggctattgtatggtacgagcgattggaggagctacattttcttaccgaaatgactggagagagtccttttacctctcctacagagggtagaggagtctccttaagcagaccctgtctaatgtagggagggaagagctcggcataagcgatatttcctgatgcatagagtatatcaaagactaaagaatgtttccctgaggctccaggacccgcaattgctattagggagtttctcggaagagcaagatctatgtgtttgagattattttgataggcatccttgataaggatatcacaagatttaggagaggatggcggttcagattttactaccggtatgtctagagaaccttcaatatagggggccaacgcttttgctgttggagtatttagttggataagatccttaggggtgcaggatgccaggaggtatcctccgagatctcctccttcaggacctaattccaaaacataatcacaaactttgacaacgtgcatgttatgttcgataacaaggactgtgtgccctagatatgtgagggatagaaggacctcgatcagtgcttggatatcatgagtatgaaggcctgtcgtaggttcatctaggacatagagtgtttgcttaggagaagcaaagagaagctcgtgagcgagttttagcctttgaatttcccctccggataatgtggaaagaggtcttcctaagggcaggtaatctaggcgtagggaacatagagcatggattttttcatgaattttaggatgtgaaatgaaaaatttttctgcttcgtacgctgtcatatctaaaatatcagcgatgttcttcccttcatagaggatttccaatacttctgagtgataacgcttcccttggcattcagaacaggggatgggtgtatcatcatcggagatggtcatcgttcctaacccctgacactgaatacaagctccttgaggttggttgaagctaaaatgagcttttgtcagtccttgacgtaggctgcgaggttgagaggcgaagagttcccggatatcatcaaaggctttaatataggtcaaaggtatcgaacgctgtgagcgtcctggaagatctcgggtaatgtgaatcaagcggcctatgcatccccactcaaaatgcagatttttagggttctcttgtttcaagaagctttctatagcaggcactaacgtattattaattaaagaggatttccccgatccagagactcctgtaactccgattagccgagctaacggcagacgaatagaaagatttttaaggttgtggatcgttgcttctgttagcaagagccaagatgtgggagcttcccgggattctggaatgggaatggtaagctcttgacgcaagtattttgctgtcagagatgaggagttcatgaggaagtcctcaggctttccattaaagaggacctcgcctccgaaaattcctgctccagggccgatgtcaataatcctatccgcaagagaaatcatccgttcttcatgctcaacaagaatcaccgtattgccttgatctcgtagctttttaatgacaccgatgagcttttcagtgtcttgtggatgcaagcctatggagggctcatctaggatataggtaattccaaaaagttctcctcctaggtgttttgctattgctgtacgttcttgttctcctccagaaagggtagctaatgcgcgatttggagtgaggtagcctagccctaagtcaataagaaaagagagcctttgctttagtccctgcaggatttcttgaatagagagagaaggagattttaccttagaaaaaaatacgtgccagttatttagagacatctgttggaattcagtgaatgtttttccttcccaagtagctacggaagcgtagtctcctaggcctgtacctttacatagggaacaggaatgtgctgacatgcctttggagagataacgtgagggcttcgtggtataacgaactttatctcctatatcgttaagtacacctctccatactttataggtgagattcttttttcctaaagtttgatcgaagagtcgtacaggaagaaccaagttattttttcccctaagaaaaatattttggatttctggggaaagatctttccatggagtttctagattgaaatttaaggcatcagcaagagcttggtatatagtatgatagagataggaagaacaatttccagcaaagctacagcaattctctttaatcgaaagattttcatcgataagaaggggattatctatggaaataaagatcccggatccttgacaaagagagcaacggctctccagggcatgaggagaaaataattgttgagttagaggggtataggtgacgtcatcgatctgttgctttgtggagaatgtcatgagctcttcgtcactaagaactgagcaatgaccctctccgaattccaaagctgtgaataggctaactttgagccttgcaatattattttcacttttgattagagtatcaataacaatatcaacagagcagtcttcaggaatccctgaagttaggaaggagtaaatggggtggatcgtgccgttacaacgtacttttgtaaatccctgttgtgcatactcatggattgcagcaatatctttacgtagcagaggagctaaaatagagatctgtacaccttcagagagctccataatggtactaagaactttctccttgctgtagagatctaagacttctttagtcttaggatctcgagcctgtccttctagcgtgaagagaagagcaaggtgcgaaaaaagttcagtagtgctcccgacagtcgcatgactatagtgtgaaaagtggttctgttttattgctattgttggtgagagaccatgaatttcttctactttaggattgggcagcgtcgttatcgtagtagcgaagaatgtcggaagtgttgaaatatagcgttttcttccagcagcatatagggtatcaaaggctatcgaggattttcctgatcccgaaactcctgtgagtagaacgatttcctcggagttaaaatggatagaaacgttttttagatttctaactttgatcccagaaacatatacaggaagtgatttcataaagaattctcgtaatatacttagaaaggtctcttacctaaccttgagaaaagagtcatatccgcactgatatcttgggatttcaagtacaaattaaaccgcaatattgtatattcctgcaagtatcctccctctcaagagtttgagttaataaagagaattttttaatattttttcaaaaaagaatataaaatatttcattataccatgagtttttcattgaatagacaataggacagtatgatcacacgcactaaaattatttgcactatagggccagcaacgaatagtccagagatgttagcaaaacttctagatgctgggatgaacgtagcaagattaaatttcagtcatgggagtcacgaaactcatggacaggctattggatttctcaaggagttaagggagcagaagcgggttcctttagcaattatgctagatactaaggggcctgaaattcgtttagggaatattcctcagccaatttcggtttctcagggacaaaagcttcgtctggtaagtagtgatatcgatgggagtgctgaagggggagtgtctctctatcctaaggggatatttccctttgttcctgagggtgctgatgttttaatagatgatggctacattcatgctgttgttgtctcttcagaggctgattctttagaattagagtttatgaacagtggccttctcaagtctcataaatctttgagtatccgaggtgttgatgttgctcttccctttatgacagagaaagatattgcggatcttaagtttggggtagagcagaatatggatgtggttgctgcatcttttgtgcgctacggtgaagatattgaaactatgcgcaagtgtttagcagacttaggcaatcctaagatgcccatcattgcaaaaatagaaaatcgtttaggggtagaaaatttctctaagattgccaagcttgcggatggaattatgattgctagaggagatttaggaatcgagctttctgtcgttgaagtcccaaatttgcaaaagatgatggctaaggtttctagagaaacaggtcacttctgtgtgactgcaacgcagatgctagaatctatgattcgcaatgtcttacctacacgagctgaagtctctgatattgccaatgcaatttatgatggttcttcagcagtgatgttgtcaggggaaactgcatctggagcccatcccgtggctgccgtgaaaatcatgcgttctgtgattttagaaacagaaaagaatctctcccatgattcattcttaaaattagacgaaagcaatagcgctcttcaggtgtccccctatctctcagccattggattggcaggcattcagattgcagaaagggcagacgccaaagctcttattgtttatacagaatcaggaagttctccgatgtttctctctaaatatcgtccgaaattccctatcattgccgtgactccaagcacttctgtttactatcgcctagctttggaatggggggtctatcctatgcttacccaggaaagtgatcgcgctgtatggagacatcaggcctgtatttatggcatagaacagggcattctctctaattatgatcggattcttgtgcttagcagaggagcctgtatggaagaaacaaataatcttaccctgacaatagtgaatgatattttgactgggtcggaatttcctgaaacctagaatttttgctttaaaatccaggacttcgcaaatttttcgagaatatacagatgttttcgtaaatatgaattagggcttttactccactgtaagtcagggccccttcgacttcaccttgaagttttttctctctttatctttaagatttttagaatagaagatcctcaaagagttttttagaggagcttgggggtggtctagagatttttctaggaatcttttagagtacacagcacaagaacctgtttttctaaaatgcttgtataaatgctgtagattgttagtgagatcaaaaatagcaggatagcaattcggtagagctagaatgtcttgatcatttcggagttggatcaaggagtactctgggaattgttcttgaagttcttcaagatgatccgcatttcctagtgttagatgaagagtggttcctgaaaagcattctgctagagctttcagaaaagaaaagtgtgaggagacttgatctacaaaaactagaatatggctatagcggtacttcttttttattacgttagagatctttctcttccaccttttatgaatccacatccattgttcaggctgactggcgatccctttttctaaaaatcccatcatctgatccataaggatagccacggattctttcatagggaggcttttattagcatacagcttggcactcggaatcacttcgaagcctttagcttggcgagaaacattaacagcaatcacaggaaaacctgttttataagctaatagtgctggagatgtcgttgtgaatgctggagagccaaagagaggatacgtgtatgaagacatcaacaaggcttgatctccaacaatccccacgagtttcccttgattcagagcttctatgccctgttggattccgttttttgggggtacaatcttacctttgaaaacttctctaagagcaaagattttcttgctgagcctttgattttttatagccttagcaaaggcgattccaggatagtttttagtgatataaagaaaaggaagttcccagtttgcctggtggccacaaaataaaataaggccctgcttctcttgtagattcttaaaagtttcctctaaatcttcattggaaatgacctcttcagaagaaaaacctttggggtttcgtgaggatgtcacgattgtaatgagtttgtctatatttccgacaagttgctcgattgcgagtaattctaagagtgtaattataagatgctgcaaagattgacgagctattttataacgctcatcaaatgttttttctggaaacgctaatgctaagtttgtgagggctgtttttcgataatcgctgatgatataaaaggctagaaatccaaaaccttttcctaatcctgttaaaaaagatcttggggtatgcctgcataaagcaataataccagagactaggtaatacagaggggcttctaggattgttctcttgatctgatggaattttttgcccacaagctaatttgactttcgcaaatcactttaaataatactattgtgcttcttactatctcaagatttctcgttttgcagcgaagacgctccagaaaggaacatgcttaacagtatcgtaactaagagaactaggacagcagcaacattactcattccgaaagtcatcccagaagctccaagcactccagtacaaatcaaaatgatcagtataaaagaaacaatagcagtaagagctaaaagtcctgcagacactgtcgctacatttgctttggattctgagctatcagaacaacaacaaactgtgttgattgcagcttcaaagccctggcccaagcaatctattaagcacataaagtttcccctaactaaattttagtgagtctgcactaccactcttttttatataatttagttgtttcctttgtttttgtctggatcacaactttattatttttgatttctgcaataagatttaaaggttcaccgtctgctgtaaaaagtgcaagctttcttaaatattctcggaatctatgacgaattccagcctcatcaataagggctatatcgtgtaaaattccatgttcttgggctataatagtctgaagaaaagtattttctaaagttttttcatctaaaaattctatagcccagttgatcgaagaagggtcttgtggtgagggcatcacaattgttaagaccatgttgttctttacgacatctaaaaactgtctacttacatccttaacatataaaggaatatttatttgatgaattccatgattcagaataatgggagggacaggatctaagctgtactctagaggattcatcgtttgaatgaaggttacaggaaagaatagaaagaccggtaaatttaaatttaggggaatgcattccctttttaaaaataaaaggcgaagaaaatctgcttgagggtcattgagatccatgaaggtattttcaaagggaatcaaaattttcttccattctttaggaatggggaaaataatttcgtcatgacttccctgagcaatgcgatttctttctaactcttcgaacgaaattttattcaaattaaaggttagctcaagaccttgctctttcaaagcattgatatattctttggggccactgactttttgattcaagtacttcggccagacatccaaatactcatatcctttcgggggactccctataggtttcgttatagttaataaaatgtcttcggttacatattgtgtaagtcggacaaaaatatcgttagcgtcaacgctatggatgtctttgcgtatgttgatctcatgatctacagagacaaggttatgcttatctatagtggcaatccaactttccgtatggtttgctgcactgatcactacctctaaatttgaaggacggaggtcttgaacggtatttttattcccagtgattgttaaagagacttttttattcaggaatccgcttttttgtagtccaagaacggtttggtctggatgtaggtctacgatgcgcacagggacatttgtgagtgttcgcgtgatggtaacactttgtcctacgaggatccaaatgatgatggcaaaacctaaggaaacaacttttctaggccaatgccgaataaagagttgagataaaaattttatcatcgtttccaaatccaagagaataaaggttttcttttgtgttctttaggggaaagaatactgcggagtaccgctttgaatctatctatttttactccgcgtgttagaaggccgtctctagacaaagagacacttccattttcttcagatactgtgataattagagcatcagatcgttggctagctcctagagctgcgcgatgccttgtccccatggatcgggaaagctgcgtcgtatcatgagctagtgggagaacgacgcgagcataggctagaatgtctcctcttagaatgacggcaccatcgtgcaatggagatgaaggttcgaaaatcgtctctaaaagttcttcagagaaagttgcattgattttcaccgaagaaaaacttaggtattcatcgaaagaatctttgttttctaaaacaacaagagccccgatttggcgttctgatagctgataaatactggcagctaattgctctacgaactgctcttgagtatctatgaagaattttttcccatgaaatcgtatacgagagagagccaaacgaatttctggttggaaaataataaagaccacgatggcagcgatattgactacgtggagcatcaatctacggatgatagggaggtggagtttatcggctaggacaaatagaaagagaaacgcaagcaagccaaagacaacatccatagctcgggtgccccagaaaaattttaataggtagtttaacattacccaaattaaaatgatttctagcaaaggtgttgtataataagtaatatcaaagggcatagttttactaggtccttgggtagtatactgagaaaagttgcacaaagtgctcggctattgtcctaggaaaggtaacctattatcttagcatacgaacaaaaaggttaacagcaaagtattttgtagttgcaatactttgtttcatcgttcacattacagtttctaattttatatacaattctggaagtttatggatgcgcttatcttatctagaatacaatttggattgtttataacttttcattacctttttgtgcctctgagtatgggtttgagcatgatgcttgtgatcatggaaggcctctacttggttacaaaaaagcaaatttataagcaaatgacatggttttgggttgggatttttgccctaacatttgttcttggagtcgttactggaatcatgcagatattttctttcggttctaactgggcaaatttctcagaatatacaggaaatattttcggcaccttattaggtagtgaaggtgtttttgcttttttcttggaatcaggatttttaggaattttgttatttggtcgccacaaggtctctaagaaaatgcatttcttttctacgtgcatggtagctttaggagctcatatgagtgccttttggattatttgtgcgaattcttggatgcagactccttcaggttacgagatggtgatgcataaaggaaaactcatccctgctttaacctccttctggggagtggtcttctctccaacaactatagatcgctttattcatgcagtcttaggaacttggctgtcaggagtttttcttgttataagtgtatcagcatattatttatggaaaaaacgtcatcatgagtttgctaaacaaggaatgaagatagggacgatttgtgcagttatagtcttagttttacaattgtggtctgcagatgtaacggctaggggagttgctaaaaatcagcctgcgaagttagcagcttttgaaggtatcttcaaaaccgaagaatatactcctatatgggcttttggttatgtagacatggaaaaagaacgggttatagggctgcctattccaggagcactttcttttcttgttcatagaaatataaaaaccccagtcactggtttagatcaaattcctagagatgaatggcctaatgtacaggctgtctttcagctgtatcacctgatgatcatgttgtggggggttatggtcgctttaactttgatttcctggtctgcatataagggatggcgatgggcgttaaaaccctttttcttagtcattttaactttttctgtcttattaccagaaatttgtaacgagtgtggttggtgcgctgctgaaatgggaagacaaccttgggtagttcaaggattattaaaaaccaaagatgcggtgtctcctatagtgcaggcgaataaaattgtacaatctttggtaatatttagcttagtattcattgctcttctgactctctttattactgtactttgtaaaaaaataaagcatggtcctgaagaggaaaatgatcttacagaatttgaagtgaaatagaggtatttttatggaactttctctaacaagccttttaccacttgcgtggtatgtaattcttggagttgctgtctttgcgtattcttttggcgacggttttgatcttgggctcggagctgtttatcttaaagctaaggaggataaagaacgtcggattcttcttaattccataggacctgtatgggacggcaatgaggtctggttagtgatcattgtcggtgggttatttgcaggatttcctgcatgctatgccacacttctctcgattttctatatgcctatctggactttggtactcctttatatttttaggggatgttctttagaattccgaagtaaatcggaatcagtgtcttggaaaatattttgggatattatctttatttgttctgggactgccatcagctttttcttaggcacgattgttgggaatctgatccttggattgcctttgtctccagacacctcttatgcttctttatcctggattttatttttccgtccttatgcagccttatgtggcgctgtagttgccagtgcgtttgctactcacggttccttcttcgcattaatgaagacttcggattctttaaatgctaggattgctcagcaatttccttatattctttcgtccttccttgtcttctatgttctcttcttaggagcaagtttaatctctattcccaagcgttttgatgctttccctacgtatccactcttgattttgctcattgctttaacgagctgctgctgtgttgctgctaagacgagcgtgtctaagaaacattatggtacgcatttatttattctacactgaacttgttgtctctcattctgtcggcagctaccctaacgttccctaatattcttctctctactgtagatccacagtatagttatactatctacaatagcgctgttgaaactaaaacgttaaaaagccttttgattatagtgcttataggccttcctttcatcattacttatacgtgttatatttatcgtgtgtttagaggaaaaactaattttccctctatatattgagtttcatttaaagagtccgaagccttcattccatgagggtcggatttagattaaagagactgtgattgcgtatagatccaagaatgaatcgaagaacagaggatctagaaaatgaagagcttccattggaatcctttggaagctatcattatacttcgttatgaagcttctttaattccaactacataataagcaggaaaagcaaaatggttgttaggacgtgggagacattccacagtgacacgctttcctaaccattgctctaagttgatacttgtaccgtaaagaaaagcaatcgtgttttcctgagcttttagtaggtaatccccgggattgttctttactacatgaggatacacttctaatacacccgcaagcacttgttttttcttctgttcagcgcgataaaacgcttcttgtgttagtgcttcagagtggtcattgccttgctgcatactggcccagattctgaagagagaatactctaggttttctcttccttgggtaagaggagctgtttttaatgcagtttgcttacgaatatgacgtgaaagtaatgaagttgtaacttcagaagaagaaaccttaggagtggaacattgtgagcttgcaatcgaagtattttgagattctagagatttagaaagataggcatcttggatttcttctaaagctttttgtataagcccttgaattcctggaacatctttaaactcttcggattgtacaaggttgatctttttataaattgcttccagatcaatctcattgaggcttttctcaagctctatatgagcaaagtttaaagcagaattgataaggtccatggcaatctttttttgtccctcgcgttgcgtatacagctcgatgggtcctttgttagcaacaaagttttttgcaacatagaatacgcattgtgagggcaagaccacctctaaccatttcccatgtggctcttgagaagctggctgtatttgtgtgcctcgggagagtctcacaagtactggagctgatgttgagggttctaaacgaacattgacttgttcaccttcaacgacattatctaaaacaaatgagcggaacacataacctgtaattcctggaggcgcagaaattacgtagtagtctttgctttctccgataacagcaacaagatctcctttagaaaattccctaatgatggtcccatcagtatgaggtgctagacgcatccgtacgtggtttcccttaatttctccagtaaatgaagagggaagttgttctggaaaggatacggattgggaatcggcagcatagattgctggtgagttgattgcagttcctaaagctaaaagaagcatagaaatctggagcattctcatgcttttctcctacaaatatatttcgtctaaccgttggttgaaaacatcgcttacagcaaaaaggagattaacccctagaaaaagaattatattgacttcaaggaaaaagtcaatcggcttaccaaaagcttaattatgaatgcagttctactaagtatataaaacagcttttatatgttcacagttgggttcgccacaagtacagcctatggggggtcccaagtagacgctaaactgatcactaggatttaagggattcgttacaatatacaactttatccccactttgcataatgtcccaagtgcggaaagtcagatctttatcagaaaccgccagggtatcttcttcattcatgacccttccaatttggcagtgcatacaattgcaatggggttctggtctgggtaaaagcgttgcattattccctgaaagtacccgaatgacatcagccattttctctaagacgtcggtaggagcatcaggatgatctttatgttctggagtatgttgtagtattgcttcgatgggatttgttccagaaaagagaggggaaattagatttttaggtaatacttgaatgtcgtttcccttagttatctgctgcaatacattcataaggacccctacacctagtttatcatcatcacgagaatcctctttccccgattgagaagtttctaggtagagaaggtgctcttgaaaagcaatgtcaataatcgactgatctaaattaggaatagaaatgattttgccatcaataaggtggagccttagtgttccttggtctttgttttctccttcctgggattcaataaatgcaatttggctccatcttgcagagatgaatgggggaatacaaatcagttgatcattaattttgactttcatagcgatcttgggggtgaatctaatcttagcagtttgaggccattgtaaatgtatctctttttttttacaataaattagcagcatagggttttgattgctaaattttctaaaaggcacgtatcatgtaaatggattttttattatgaatatattttttgcaatagttcctgatagaaaaacgaaagtatggtagttggaccttaacaacacaatacgtcttttaatgaaaagaagggttttctttggaagttatgttagagttgttttaggcaaaaatttgtatctgataaagaataaaaggttcagtaagagaaggtgaggacgcaaatgaagaaaacaatggtcattgatacaagtgtgttcatctatgatccagaagcccttttttcttttgaaaatactcgaattatcattcctttcccagtcattgaagagctagaagccttcggaaaatttagagatgagtctgctaaaaacgcgtctcgagcattaagtaatattcgtttgcttttagagaatgcaaaaactaaagttacagatggtgtgctcttacctagtggtagtgagttgcgtatcgaggtggcgcccctttctaatgatgataggcgagggaaacttcttaccttggagttgctcaagattattgctaaacgagaacccatggtttttgtgactaagagcttgggacgcagggtgcgtgctgaagcactacaaattgagtctcgagactatgaaagtaaacgcttttcttttcgttccttataccgtggatttagagaactgcaagtttctcaggaggatattgaaaacttctataagaatggctacttagatcttcctctagacgtggtctcttcgccaaacgagtattttttcatgtccgcaggagaaaaccattttgctttgggtagatactacgtaagcgaaggaaagattatcgcattaaaggcaatggataagagtgtttggggaatcaagcctttaaatacagaacagcgatgtgccttggatttgttgcttagggatgatgtcaagttagtcaccctaatcgggcaagcaggatctggaaagaccattttggctttagcagctgctatgcataaagtttttgataaggaaacctataataaagttttggtaagccgtcccatagtccctatgggaagagatatagggtttcttccaggattaaaggaagataaactgatgcattggatgcaacctatatatgataatatggaagtgttatttagcattaaccagatggggaattcttcagaggctctccaagctcttatggatgctaaaaaattggaaatggaagctcttacctatatccgagggcgctctctacccaaagcttttattattattgatgaagctcaaaacctcactccccatgaaatcaagacaattatctcaagagctgggaaaggaacgaaaattgttcttacaggagatcctacacaaatcgatagtttgtattttgatgaaaattctaacggactcacctatctagttgggaagttccatcacttggccttatatggacacatgtttatgacacgtacagaacgttccgaacttgcagctgcggccgcaactatcctatagaaccttcgatgttataagtgacttttcttcttcggatctgtaatagcaggagttttcaagtctgtaaggacaatcaacattcttctgtctgtatttccgggttcatttccaaattcttgcatagcggcaacaagagcgcattttacagcgtgtatccatctcatgcggactttattctcttcactattaggcttttttctattttcaggaggcgcgtagatcccagaagaaattagagggatttgtaggaaggttacacctaaagtttgagctaagctgaagcagtttaggtaggcgtttttgcagcgatcaaaggctgcttgagacttgttatgatgatccactgctttaggcccaagaagttgtgctaggtagtgtggtttaccttgttttcctgtgtggttggatccatcggcatttctccacatgcctgcccgacattcaccctcattaagaggagtcccctggcgttcaggatttagaggtcgttgcgacagccccaagaatcgacactgactgctgccgatagaacttgatttgtacccgccccatctcgactcattgttctattggctgcgtttacaatcatcatagacatactatcagtgacaagacgaggttgtgcaatatttcctgacgtcgagacaaaaatcagctttgattgatttagtgcccaggcaaagattttctggtttttttctgctggtggccatgggaacggctcctctacaggagtccaattctccaagagcatcttatgaaacagagatagaggagaaaccatagagtctggtgacggtttcttgcctaggatgggggaagcttctatacttccaggtacaatgtgatctgtaggtgtaggggagacctctggtctctgaggtatgggtggcttaggttgtgtcggtatttctttaggtgttacaggtggggggctttttttttatcttcttgtaacagatcatccaggaacggatctttgaatcctgttggagaggtaggagtagaaaatatggcgtctatttgctgccccatgtcaaggggagtaggtgttaaggggttttgaggttctcttggctctggaggacggcagcaaggacaaagataccgaacgatcaactttataatcttaatgactcctaagaccaggtaatacagagctttaatgccgaaaatttctagccaagcttcttttctaactttaggaagttcctcatagatctcaggacagggtaatgttttacacactgaagagaagttccctgtcattagaaccatagaatattgaagagaactaattccttttaaggttttgatacctataaatgtactaaatatcggaatatagcttgcaatacgttgtaaatttgtgcggtgtaagggattcactaaaggagtatttcttagtgcggttgaggtttgacccagaggcgtgtgccgatggctaattataaagacttcttcattaaaaatgctcataagaatcgccttataatgaaataaattttttcattaagaattataaaacaacttatctttcttttctatttctatgaaatctagaagggttttttaatggatatttgatttctttaaagactttaggaagacattgtctaaatttggtaaaaaagacagattctcctcgttaagaggggatgagtagcattttaaaataatttttttaaataatggaggtggagagactcgaactctcgtccttgacaaactccctgctaacctctacatgcttatcttctagaattgtttacattggactcccttagctagaagcctctatagcagccaatgactctcaaaaatctcgaacgaacttccttgagaattagagaaagtaagttccaaccagataaatgacggtattttgcaagcctctggtggagctcgcagataccgggttacctagagattatctagctaacaacttttgctaattaagcagctagtctttcctctactgagtcaaacaagctaataatttcgcattcagccttaggttcggcatttattgttttgttggctttttaggaggccagccaacgccctccgcatgcaattaacacttcattttcaagtcgaaacctatacacccccacaacaattttagaagctggttagcttttattcaatcatcgtattttggtcaagttctaagaacttcttagagatctctagagaggtgggctatggacgaaaacctaaaaaacctctattgtaaatatgttttcatatcaaaatgttcctaaaggcaaaagatgacagcagatgaggtagggaaaaatagctttgcaaaaaaagaagaacaggttttgaagttttggaaagacaatcaaatttttgaaaagtctttgcaaaatcgtcagggaaaaaccctatattctttctatgacggccctccttttgctacaggtcttccacattacggtcacttattagcaagtaccattaaggatgttgttggacgctatgctaccatggacgggtactatgtgccgcgacgttttggctgggattgccatggggttcctgtggaatatgaggtggaaaagtctctgagtttaacagcacccggacccatcgaagattttggtatagcatcctttaacgaagagtgtcgtaaaatcgtatttagatacgttcacgagtgggaatactatatcaatcgtataggacgttgggtagatttttcttctacttggaaaactatggacgcttcttttatggaaagtgtctggtgggttttccaatctctatataaccaaggattagtgtacgaaggtacaaaagttgtccctttttcaacagcattaggaacacctctctctaattttgaagcaagccaaaattataaagaagtcgatgacccgtctcttgttgtaagaatgcctcttcagaatgattccgcatccttgcttgtatggacaacgactccatggacattgccttctaatatggctatagctgtaggggaaactctggtttatgtccgtattcaagataaaaaaagtggagagcagtggatcctaagtcagggatgtgtttctcgttggttttcaaatccagaagaatttgtaattttagagagtttttctgggaaagatcttgttggtaggacttatgagcccccttttacttttttccaatctaagcgagaggaaggagcttttcgtgtcattgcagcttcgtttgttgaggaaagtgaaggaacaggagtcgtacatatggctccagcgtttggtgaaggagactttttagtttgtaaggagaaccatgttcctttagtctgtcctgtagatgctcacggaagttttacagaagaaatacctcaatatcaagggcaatacattaaacatgctgacaaggaaatcatcaagttcttgaagaaagaaggaaggattttttaccacggaacagtaaaacaccggtatcctttctgttggagaacggatactcctttgatttataaagccgtgaattcttggttcgtcgctgtagaaaagattaaagataagatgcttcgtgctaacagctcgatccattgggttcctgaacatatccaagaagggcgttttggaaaatggttggaaggcgctcgtgattgggctatcagtagaaatcgttattggggaacgccaattccgatttggaaaagtgctgatggcgagattcttgttgtaggatctatccgagagctagaagaacttacaggaactcagatcacagatattcataggcattttattgatgatttgaacattgtcaaagatggcaagccctttcatcgaattccctacgtttttgattgctggttcgactctggagcgatgccttatgcccaaaatcattatccttttgaaaatcaaaaggaaaccgaagaggcatttcctgcagactttattgctgaagggttggatcagacgcgaggatggttttatactctcacagtgatttctgcaattttatttgatcgtcctgcatttcgtaatgccattgtgaatgggattattcttgcagaagacggcaataaaatgtcaaaacgtctaaataattaccctagtcctaaatacgttttagatacttatggagctgacgcgcttcgtctatatttgcttcatagtgttgtcgtaaaggctgaagatcttcgcttttctgataaaggaatcgagggtgttttgaagcaaatccttcttcctctaacgaacgtactttccttttttaatacctatgccgagctgtatggttttgatccgaaatcacaagatatagaaccagcttatacagagattgatcaatggattttatccaatttgtatagtgttgtaggtaaagttcgtgagagcatgagtcagtatcatttaaactttgctgtagaaccctttgtgacctttattgatgatctgactaactggtatatacgtcgctgtcgtagacgtttttgggaagctgaagatactcctgaccgtagagctgcattttctactttatatgaagttctcacagttttttgtaaggtaattgctcccttcgttccttttcttgccgaagatatctatcagaagttgaagttagaaaaggaacctgaatctgttcatctctgtgattttcctcaagtcgagatggataaaattctccctgatctagaaaagcgtatgcacgatattcgggaaatcgtaggtttaggccattctttaagaaaagaacacaagttaaaagttcgtcagcctttagcaaacttttatgttgtcgggtctaaagatagattgtcgcttctaaaaacatttgaagggttgattgctgaagagctgaatgtgaaaaatgtgattttctatgaagaagctccgagtttcatttatactaccgtcaaacctaattttcgtatgcttgggaaaaaagttggatctaagatgaaagaggtccaaaaagctctcagtgaactgccaaacaatgctatagataagctgattcaggaagaaacatgggttttaaccattgatgatagagaaatagctttggatggtgatgacgtcgtgatttgtcgtcacacagatcctggatatattgcccgtagttccgctctatttagtgtgattttagattgccagttaagagaacctcttatagtcgaaggtatagcaagagagctagtcaataagattaatactatgcgtcgaaatcaacaacttcatgtttctgaccgcatcgcattaagaataaaaaccacagaggctgttcatcgcgctttcttggattatgaaaactatatttgcgaagaaacgttaattatagcctatgattttactcaggattctgatttccaaggggaaaactgggatattaatggacatgcaacgcaaattgaaattacagttagttctatagattcttagagattttctagaaacaactgaaaaaccataagaatggttatttcttgtggtttttctcctctttcttaggaaagagtctgcgtcgtttttgatagtagacatatccaatgagagagagacccgtcgctaatgctatcccactaacaagataacctgagagtgttgttggagcagaaactccagttaaccgtcccatgcgtccaataggccagaatgtacatagaggagatcctaagagattttccataggaacaaagccaaattctcgactatccgcactcatagggtagttatctcccaagacgagaacatgacctttaggaacttgaataccaaaattatgtataaactccacgaattctttaaaatcttctggagggagtcccttgtcaacaaaagctatatagggttgtgtctctgaagacccctcttgcttttccgtttcagaagtcacaaatttttgcagagttggatcattctttataaatacaggagaatccatgatataaagattcccttggttaaagaatgcataacggttaggtaaaggtgcttgcagcggattcacaggattataaatagaactaaagttgatcccgcagttaaaaagttcaatcacttgcttatcattgagctgagtaagggggtgagaagattttagcttataacgaatctctccaaagccaatttgatacgcttcgcctttagaatattcataacaaccatcagggaccttgggcaggagaattgcataggctttggcaattcctgaagtgttaatcttgaattgatggtatttatacgcacatccttgagcaacaataaaacgagaggtagtaagattgttccgaattaagtgcaaatgttccttacgcaaaggaagtaaagtcttcataggttgaatcgcaggcgagagctgatgctcatagtgacgcaacagaggctttgggtaggaaaggttcgctgtatggcaaatttctaagtagactttagttggacttcctggattcggaagtagatgggatgttcgtgcctgatgttctgttaagatgcgcaccatagcatagttacccataccaaaaagatcggcatagctgactggcgaaagatgaggatcttttaatttattaggctcgtcttgatgccattctttatggtcaaagaattgtccatacatggaggtttgagggaaaatcagccgaccataactttgattgaactgcttaaaatctataattgttttctgcccttctgtatggctgctggtagtgccatcaaaggatatataggggacgtgatataagttttctaaaccatggacagaaggaaactctatgcgtttacctgcatcatcaagaccataaatttttcctccatagaaatataagaagtccccaggtcttcccatgcaacgtttaatgtaacgcttttttcctggaatcaatccgaagtactttgtatcagcatctgggatagggaggtcgcctacagtgaaaacaacaagacccccgcgagttacggattcaggattgaaggcaagtggtttcttagcaaaagggcaatggagaccaaatgttgttttggatacaagaatccgatcctgttctaaaattgtaggcctcatggatcctgtaggcacttcataaagttcaaaccaaaattgccgaactaagaaggctacaacaccagcaaaaagaagggccttgataagctcataggttttgcgtccgaaggaattaggataacggttggaaaatgctaatgcttgctgagctaagtcgcttgcagtttcttgatcatgttcaaagatagcctcttctagttgttctagtagttcttgcagttgctttttatctgcaggggaatgggcgagttttttactttttaaaagcttataagtactgcggaggatatgacgacttttatttagagaatagtgttgtttcataaagatactggggtaagaaagtcagattctatctctttagattgattatagaacggctgcattggatactttagagctaatggagactgaagacctaaatgaaaaatcaaaacaatcctcgagctaaattcgtaagtacattctagcgtattagatttttcgatccaaaattattttgctatattgttagatcttttcattgtgtcttagagtcaggaagagaatagacatagggagaagttgccccgtgtcctatatccacagctcttactatagaagtccctttaggagtctcgatactcacccataaaggaaacacagaaatgtcaggttgggtgaaatacataaggattcctgtttctgataaggggcctcgatctttaggccagagcccctgccatgcattcacagagattgacgtgagtggagccccttcaaaagaaactttgggagaccagggcttgttttcttttcctttagtcttgattacgtttgcgggagctggagataaaggaagatcaaagatttgcaagaaggcaggaactgtagtggattttcctacaggctctaggctcttggttcgagtgtttaaagagaaaaactgagaaccttcagaagagagcgaaacaacaaagacttgtgaaggtgattccagttgatgaatgaccgttttccaagaagcttgttctaaagaagggcgttctttatgggcgatacagggaaaatggatgatctctatccaaacggttttaggggttgttgatttgactaaaacaaacgttctttgagaccctcgacttaaaacagtatagtctccagtcttagcaagaaaaatattttcttgaattgttcgtaaagaactagtttgagaggcaaaaagaccagaaaaagccgtcgagaagaggaaagatagaaagaggaataagaagagtgtttttccttgctttttcataagatatttctgtagaatcctctcgaagtatgtcgagctatcatttggcataataggatagcgattttggagttgtcaatatgaaaaaaaatacccaccctgaatatagacaggttttatttgtagattnttcaacagggtataaatttgtttgtggatntacctatcaaagtgaaaaaactgaagtttttgaaggtaaagagtatcctgtatgttatgtcagcgtatcctcttcttctcatccttttttcactggaagtaagaagtttgttgatgctgaaggtagggtagataagttcttaaaacgttatagtaatgtaagacagcctgcacagcaacctcagcctgaagaagacgcactacctgctgctaaaggaaagaaaaaagttgtaactaagaaaaagaaataaaacttcttttagatttcccatttataaaacccattctcaggctctcaagcccgagaatgggtttttttgtgagggctttctctcttgcaatagcttgtataatacgttatgctttcctaggtcacgataattttgaaatagataacgttagatgcctgtatcagtataccaaggtgttttagagaattttttatctgattccatttgatactgatttttcaccactttttagggattcatgaagaaaaaagttgccgagtatttaaaccgtttagcagaagtcgaaataaaaatttcaaatcctgaaattttttctaattctaaagaatatagcgctcttagcaaggaacattcttatcttctagaattgaaaaacgcctacgataaaatcttaaatttagaaaaagtccttgctgatgataagcaagctttagctattgagaaagatccagagatggtcgttatgcttgaagaggggattaacgaaaataaagtagagctagagaaattaaataaaatattagaaagcttattagtccccccagatcctgatgatgatctaaatgtcattatggaactacgagccggtacaggaggcgaggaagccgctctctttgttggagattgtgtccgcatgtatcacctgtacgcctcctctaagggatggaaatacgaggtactctctgcgtcagaatccgatcttaagggatataaggaatacgtcatggggatctcaggaactggggtgaagcgtttacttcagtatgaggctggtacacatcgagttcagagagttcctgaaacagaaactcaaggacgtgtacatacatctgcaattacaatcgctgtccttccagaaccttcagaagaagatacagagcttcttattaatgagaaggatttaaaaattgatacattcagagcctctggtgctggaggacagcacgtaaacgttactgattctgcggtgagaatcacacacctgcctacaggtgttgtagttacatgccaggatgagcgcagtcaacataaaaataaagataaggccatgcggattcttaaagcccggattcgtgatgcagaaatgcaaaaacgccataacgaggcgtctgctatgcgttctgctcaggtaggaagtggggatcgttccgagagaattcgcacctataatttttctcaaaatcgcgtgactgatcatagaatcggattaactttatataacttagataaagttatggaaggagacctagatccaattacgactgcaatggtgagtcatgcctaccaccagttactcgaacatggaaattaaaaaggcgattcaagagggaaccgcttacctagattattatggggtgcctctttctgattgcgaagccctgtatattctcatggatttattagaagtcagttcaagggcaaagttattcgatcttgttggaattagcgaaacgatgcttatggagtatcgaaagaggctagctttaagggggcaacggtgtcctactgcatatctcaatggtgccgtgagttttttgggattaagattgagagtggattctagggttttaattcccaggacagagactgagctgcttgctgagtatattatcaactatcttttatctcattctgagattcaaactttttatgatatttgttgtggtagcgggtgtttagggctagctatcaagaaatcctgtcctcatgtggaagtggtgctttcagatgtttgtccgcaagcagttgccgtcgcaaatgaaaatgctaaaagtaatggtttggatgtaaagattcttctaggcgatttgtcagccccctacactcgtcctgcagatgcttttgtttgtaatcccccctatttgtcttttaatgaaattattcatatagatcccgaagtgcgttgttacgagccttggaaggctcttgttggaggttctacgggtttggagttttatcagcgtatcgcccaagaattgcctaagattgtaacttctacaggagtcggttggttggagattggatccagtcaaggagaaagtataaagaatattttttcgaagcacggaatttatggccgtctccatcaagatttgtctggacgcgatagaattttttttcttgaaatggatgggagagatcctgtatcctcgggggcttattcttgattttttctggataaatgattaattctttatcgcaaaagctatcttctattttttcttttttggtttcttctcgtagaattaatgaagaaaatatttccgaatctattagagaagttcgtctggctctcttggatgccgatgtaaattatcatgtagttaaggattttatttctaaagttaaaganaaaatccttggagaagagatctggaagcatgtttccccagggaaacagtttatacgttgtttgcatgaggaattagtagcatttttaagcgatggaagagaagagtttactattcagaagacgccttcgatcatccttctttgcggactccagggggcaggaaaaacaacaacagctgctaagcttgctgattatgtaattaagaataagaaagcaaaaaaagtccttgtggttccttgtgatctcaaaagattcgctgctgtagatcaattaaaaattttggttgctcaaacgaaagctgaattttaccaaagtcaagagaacaagcctattgatgttgttgttaaagcgcttgcatatgctaaagaaaatggtcatgattttgtgattctggatactgcagggcgtctcaatatagataacgagcttatggaagagctgacggcgatacaaaaagtttctcaagctaatgagcgtctttttgtgatgaatgtagctatggggcaagatgttttagcaacagtgcaagcttttgatcagtctttagatcttacaggcgtgattctttccatgactgatggagatgctcgagcaggcgctgttttctcaattaagcacgtccttggtaagcccattaaatttgaaggatgcggagaacgcattcaagatcttcgttcattcgatcctcaatctatggcggaacgcattcttggaatgggggataccataaattttgttaaagaaatgcgcgagtatatttctgaggaagaagacgctgagctaggtaaaaaactagttactgcggcttttacttatgaagactattataaacagatgaaagcatttcgtcgcatgggacctctaagaaaacttttgggaatgatgcctggttttaataatgcgaaacctagccaaaaggaaatcgaggattctgaacaacagatgaaaagaacggaggcgattatcctgtccatgactcctgaagagagaaaggagttggtggaattggatatgagccgtatgaagaggattgcttctggttgtggtttaactttaggcgacgtgaaccagtttcgaaaacagatgtcgcaatcgaaaaaattttttaaaggaatgtctaaaggcaagatggaacaagttaggaaaaaaatgtcaggaggaaatcagtggcgttaaaaattcgtttaagacagcaagggcgtagaaatcatgttgtttatagattagtgctcgcagatgtcgagtctcctcgtgatggtaaatacatagaattattaggttggtacgatccacatagctctataaattatcagctgaaaagtgaacgaattttttattggttagagaggggagcccaactttcttcgaaagctgaagctttagtaaagcagggagctccaggagtgtatagtgcgctattgtctaaacaagaagctcgtaagttagttgttcgtaagaagcgacgtgcttatagacagcgtcggtctacacaaagagaagaggctgcaaaagatgcaactaagtaggtagtgaactgggatgaagatcgatatactttctttatccccaggttattttgatggtccattgcaaacgagtattcttggtagggccataaagcagagactcttagatgtccagcttacaaatcttcgtgactttggactcggaaagtggaaacaagttgatgatactccgtttagtggtggtgggatgcttttaatggcagagcctgtcacttcagctattaggagtgtaagaaaggagaattctaaggtaatttacctctctcctcaaggagctttgttgacagctgaaaagagtcgagaattggctgctgcttcgcatttgatattactttgcggtcactacgaaggtattgatgagcgtgctatagagagcgaagtggatgaagagattagtataggggactatgtcctgactaatggtggaattgctgctctggtccttatcgatgcagtttctcgttttattcccggtgtattggggaatcaagagagtgctgagagagattctttagaaaatggtttgctagaaggacctcagtatacacgccctagagagtttgaagggaaagaagttccagaagtattgttgcaaggggatcacaaagccatttcatcagtggagattggagcaaagtgagcgtagaacttatgagagacgtcctgatttgtatctgaactatctctataaacgctcgattgatcacaaatttgatgaggagactacaacaaatagggatcatttcaagtgtgacaagatctctgtagtactagaggtaaataagttaaagcgcgcaaaaaatttttactgtaaggtattcggtctggatgccatgagctgcgagaataaattttgtcttcctcatgaaggcaaaaccatattctggttacgagaagttcaagctgagaaaaaaaacatagtgactctctccctttccttagattgtgcatgcgaagaggacttttgttatcttcttagaagatgggagttatttggtggaaagttgttagaaaagcaagctgatgagcatgctgtatgggccctagcacaagatttagatgggcatgcatggatattctcgtggcataggatgaaatagaagaaagagaattttaggtggtatattatggtgaatttactcaaagaattagaacaagaacagtgtaggaatgatcttcccgagtttcatgttggcgatacaattcggttagctacaaagatttcagaaggcggtaaagaacgagttcaggtatttcaaggtactgtgatggctcgtcgaggcggcggctctggagagactgtatccttgcatcgtgttgcttatggtgaaggcatggaaaagagtttcttgcttaatagtcctaggattgtaagtattgaaattgttaagcgcggtaaagttgctcgagctcgtctgtattatctgagaggaaaaactggtaaggctgctaaagttaaagagtttgtaggacctagatcttcaaagaaatagtctgtagcaagacttcatattgtcttattttgatttttataatctatagtagcttatgaatacttctatttctgaaattcagcgttttctttctatgattgcttttgagaaagagctcgtctcagaagattttagtgtcgtcgctggaatagatgaagctggaagagggccactggcaggtcccgtagttgctagtgcctgtattttacctaagggaaaggtatttcctggagtaaatgatagtaagaagctatctcctaaacaacgagcccaagttcgggatgctttgatgcaagatcctgaggtctgttttggtataggcgtaatttctgtagagaggatagatcaagttaacattttagaagccactaaagaggctatgcttcaagcaatatcttctttaccgatatctccagatattcttcttgtggatggtctttatttaccccatgacattccttgtaagaaaatcattcaaggagatgctaaatctgcatccatagcggcggcttctattttagcaaaagaacatcgtgatgatttgatgttacaactacacaggctctatcctgaatatggatttgatagacataagggatacggaacttccttgcatgtagaagcaatacgacgttatggtcccagtccctgccataggaagagcttttctccaataaagcaaatgtgtgctattgtatgaataagatcctagttgactctcctttttctccagatcaccagaagtgctgtcctaagctttttacaattagtgctcctgctggagttggaaagacaacacttgtccgtatgttagagcaagagttttcttctgcttttgctgagactatatcggtaacaacaaggaaacctcgagagggtgaagtcccaggtaaagattatcattttgtttcccacgaagaatttcaaagacttttggatcgtcaggctctcttagaatgggtgttcttattcggagagtgttacggaacaagtatgttagagattgaaagaatttggagcctagggaagcacgctgttgctgttattgatatccaaggagccttgtttattcgctctcggatgcctagtgtatctatttttattgctccaccttcacaggaggagttagaaagaaggttagcttcacggggatctgaagagggctctcaaagaaaagaacggctggagcacagtcttattgagctagcagctgcaaatcagtttgattatgtcattattaacgacgacttaaatcaagcgtacagggttttaaaaagcatttttatagctgaagaacataggaacatattatgattaaaaaagatcgtttcactaatgaaaagttaaataagcttttcgatagtccttttagcctagtgaactacgcgattaaacaagcaaagatcaaaattgccaaaggcgatgttcgctcctctaatgttgcgatcgaaacactcgtcttgttagatagagaagggatacagcctgagtttactgaagagattgtagtaactgctagccctactgtggaaagaaagagatcagaacatacaaattctagaaaaaaagatccctcagcatatacttggagtgatgtaaagtaatgccacaaaaagtcctgattacttcagctttaccctatgctaatggtccgctacattttggacatattgcaggagtctatcttcctgcagatgtgtatgcaagattccgtagattgttaggagacgatgtcctttatatttgtggttccgatgaatttggcatagcgatcaccttaaatgcggatcgtgaggggttggggtatcaagagtacgtggatatgtaccataagttacataaagatacttttgagaagttagggtttgctttggatttcttttctaggacgacgaacccttttcatgctgagcttgtccaagatttttattcccaacttaaagcgtctggattgattgaaaatcgcatatctgaacaactgtattcagaacaagaacaacgttttcttgcggatcgttatgtagaagggacgtgtcctcggtgcggttttgatcatgctcgaggagacgagtgtcagagctgtggtgcggattatgaggctatagatttaatcgaccctaagtctaagatttctggggttgagttagtaaaaaaagagactgagcactcatattttcttttggaccgtatgaaagacgctctactttcttttattcagggatgctatttacctgatcatgtccgtaaatttgttgttgattacatagaacatgtcaggtctcgagccattactcgagatttatcttgggggattcctgttccagactttcctggaaaggtgttttatgtatggtttgacgctcctataggatatatcagtggaactatggaatgggcagcttctcaaggaaaccctgacgaatggaagcgtttctggcttgaagacggtgtagagtatgtccagtttataggtaaagataatcttcctttccattctgtagttttcccagctatggaattgggtcagaaacttgactataaaaaagttgatgccctcgtagtttcagagttttatcttttagaaggacggcaattcagtaaatccgagggcaattatgtggatatggacaagtttttgagttcctattccttagacaaattgcgctatgtattggcggctacagctcctgaaacttcggatagtgagtttactttccttgattttaagactcgttgtaattctgagttggtaggaaagtttgggaattttataaaccgagttcttgcttttgcagaaaagaatcactatgacaagctttcttatcattctgtggttttagaagatagtgacagggcatttcttgaagaagtgcgtcaacttgttcgagatgctgagaagtgctacagagagtatagtttacgtaaggctacgagtgtgattatgtcactggcagctttagggaatgtctattttaaccaacaagcaccttggaagctattgaaagaagggactcgtgagcgtgttgaggccattttattctgcgcatgttattgtcagaagttgttagctttaatttcttatcctattattcccgaaagcgctgtagctatttgggagatgatctcaccaaaatctttagaaaattgcaatttggatacgatgtatgctagggatctatggaaagaagaaattcttgatgttataaacgaagaatttcatttgaagtcccccaggttattatttactactgtagagtagagctcgaggtcttttctttttagaatcctgatctgtaggtgtaattacagatctgcataatttttcttagtatcgagctctttaagaacttctgctagtcctgtacatcggtgttgcactcgattatttcttgttgcaatagcaaatggctttttttgtcccaactagaatcaccaattttttcccccgcgtaatagcagtatagagaagatttctatagagcatcataaagtgcgaggtatgaataggaatgataatgcaggggctttcacttccctggtacttatgtactgaggtagcataggctaagactagatcgtcaagctctgagaaagaatagccgacatgctttccttccatacggacaacaacagctttatcttcgaagttgattgtagagacatagcctatatcgccgttaaagacttctttattatagttgttgcggatttgcattaccttatcgccaacggcataggattgaaatctaccgtgaagatttgcttttttagggtttaatgcatgtttgagtgctttatttagattatagattcctagggttccttttttcatgggagctagtacttggatatcttgaggatagatatggtatttttgtgggacgaattttgtcacaagatgaatgatatgattgagagcctcttcttgatcatccttttggaaaaataagaaatcacgacgccctgtttctgaatataatatggggagttccccttcatttaccctatgggcattcgtaacgattcccgaatcatgaacttggcggaagatcttatttaatctgatgactgtcattttattcgaagtaatcaagtctttaaggatatttcctgggcccacgctgggtagctggtgaatgtctccaataaagacaagagttgtgtagtcaggaagtgctttcaggaagtggtgcagcaagtgcgtgtccatcattccggattcgtcaacaatgatcagatcacagtctataggattgtcatggttcttgcggaaagatttcgttttaaaatcatactgtagcagagcatgaatggtgacggagtgtttttgtgtaatttcggtcatccgtttagcggcttttcctgtaggagctgcgaggatgattttatgagtcacctgttcaaaaattttcagtattgcttgggtaatggtactttttccagttccagggcccccagtaatgatgagaagtttttcagaaaaacaggctttaattgcttctcgttgttgttctgcgagatctatacttagttttcctctacccaagcaattgctttttctccgtctatagaacggattctcctcgaagaaaataaaatgcgcttgagatcagaaacaatagttttctctgcgagatggagataacgtgtccagacatggagtgtcccagaaatgtcttgaatatgtaaaagttacgcttttgcatattgaggatttgcgtatcgatttcttcgagagtaataggagtatcaaagacatcttgatttaatagtttggcgacgacatctatcaggagctctatcggatagcaagtatgaccttcttcttgaagttcttctaaggagtgctggataccagcacataggcgactttcagaatttctggggacgcctagtttcatagctatgaaatcagcagttttgaatccgatgccctccatttctctggctagaaggaagggatcttcgcaaattttttctatggatttctcttggtattttttaaaaattctcactccataatgaatcgggatattgtattcttggagaaagagaagagttttccttaacattttttgctcgcagagttgtttgcaaatagagacacatcgtgtttcgctaattccagaaacctcacttaagcgttctggagtgatatcgaggacataacatgttttctcttgaaatttctcgatgatcttttctgcgattttagggccgattcctttgatgagttttgaggtgaggtaatggaatacgccacgatattcataaagaagaggagagtcgtaactatggatttggaaatacttagtatttgaaggggaatggctccagacaccatagatttggatcggggatcctagttccaaaggttggggaagtttgcctttaattaggataggagtcgttttattgggtattttgatataagcagtaatgtccccagagtctttgttttcaacaagtatttgctctaagtatccgcagattttctccatagaattctaaaatcttgttttcctggaagatgaagtagcttaaggaatctttataaaaagcttctaaaaagtatggattataaactttttgagataaaaacgagacatcccaaggcttttaattttgggataaacttatcaaagaattattttatatagtaattatttcctcgtatattgttttttgccataggacacaaaatctatcctaccgaagaacctttgttattacaacaatttttataacaatagattgattaggaaagatcgatgttcccttgtgcaataggttcatgttttatcagaacacgagtttcttttttaattcttttttcttttgctattgcattcagctccatgaggagagcttgagtacgattttatacaaactgggatagggattgcctctatccgtgttggacaaatacctaagaagattttgattccggctttccgactatatagagaagaaattcctaaggcactttaattaaaaggtttattgccatattcttgccttgaaaatttttgattatagattttggtattgaacaatgactagtgcagtaaaaacctcatcactcatccaagtgactcaaccttaaatcagaagtaaacaacgtacagttgcaattacgctccttgtgcttggcattcttttgattgcttctgggattatttttctagctgtcgctattcctggattgagttcagcagttgccttaggattgggctgtggtatgactgctttaggaactgttttgttgattacaggacttgtcttgctgatcaggagtgagaagctcgctctagaacaagtagaaataaagcaagctaggaccagggtgaataatgagttagatcaactcagtcagtatgttttctacacagaaaatgttttagataatttgaagcgttggtcgtatcgagatttaggttttgtgagacaggcgcaagaggaggttacaaatttagagcaagacattgaagaaattttcttgacgttgcgagatattagaaatgctcttgataacgaagagttttttatgactcatgcgaaacagtgtttagcccaagtcggagaaagcttatttcaggatgctagtatagatgagtttattaatttggctcatctatccgaaatacgtcagcatttggatatcaatgatccgagatggtctatgattacaaagaaagttaaaggcactgtggttcggtttatctatgtctctacaatgtataaacaaataaaatctaattttgaaaaaagtgacttcggacaacttaggaagatgctactgaacaattacaaaacaatagaagaggtcttgtatcagagttttcaaaggggctacaatagagccgctttgttgagtgaaaagacaagaattattcatacgagttctcttttgcattgggaaaaggacgaagataagcatcttaatattaagaacgagtgtgcaagtcgtcttgagaatttcaagaagtttagaacactatttcttggattatcagaggaagacgttattgactttactggagcgtctggttgggattgttccaaactgcctcggaaagaggtcccgcttgatggtggcaagaagaaactgaggtttaaaagaacctttgcagatgaacaagtcggagattgggatcgcactacgtctcttgagcatatgacacctcaagaggaagatcctttagacaggttaatggatcaggttgaacaagaggctacttcagtcttaaaagatcaggatcgttattggaaagagatcgagacaagcgaagcaaagtttaggtccctgccacgggaagatgattttgaaaagcagtcacagattgatagttatattcgggatttggacgaccatttatcggtttgggcgaatcagttatctgctgcagaagatgctttgatagaggttacagatgtgcaggaacatggaaatagagaaatgcttaagaatatacaacagggactggagcttattgaagatgctgtaaaagctactctacctagagttgactttatacaagagcttttagagaaggaagagcttccgttggttgctgctaggatgagtttagagaatagttagaagataagcagctgtgcagagattatgtcagaagtgaagcctttgtttttaaagaatgactcttttgatttggcaactcagagattccagaatctaattaacatgctacaagagcaagccgagatatataacgagtatgaagaaaagaatgctagggttcagaatgagattaaggagcaaaaggactttgtgaaaagatgcatagaggactttgaagccagaggactgggggtgctaaaagaagagcttgcatctttgacgcgtgatttccatgataaagcaaaagcagagacttctatgctcattgaatgtccttgtattggtttttattatagtattcatcaggaggaacaaaggcaaaggcaagaaaggcttcaaaagatggctgagcgctatagggactgtaaacaagtcttggaggctgtccaggtggagcaaaaagatatgatatcttctagagtcgttgtcgatgacagctactttgaagaagaaaaagaagaacaaaaggtggataacagaaagaaagaacaggactaggtctatttttctacagcttttcccgtagggggaggggagttctagaattttttctgtcgcctatncaagataacactgttgttttgtggtatcaaatttagacattacactagctttaaagtttgagccctcccccgctttaagatcgctttctgaagctgagtctaaggtacaaacttttgctataggattattagttattggtattctcatactattgcatgggattattttttttctctggagctatttctagttgtggtcttttagtgtctctaggagttggtttaggacttagtgttttaggagtacttttacttctcttagcaggtcttttgctttttaagatccaaagtatgcttcgagaggtgcctaaggctcctgatctattagatttagaagatgcaagtgaacggcttagagtaaaggctagccgttctttagcaagcctcccgaagaaatcagtcagctagagagctacattcgttctgcagctaatgatctaaatacaattaagacttggccgcataaagatcaaagactcgtcgagaccgtgtcacgaaaattagagcgtctggcagctgctcaaaactatatgatttctgaactctgcgagattagtgagattcttgaggaagaggagcatcatctaattttggctcaggaatctctagaatggataggtaagagtctattttctacctttctggacatggaatcttttttaaatttgagccatctatctgaagtgcgtccgtacttagctgtaaatgatcctagattattagaaattaccgaagaatcttgggaagtagtgagtcatttcataaatgtaacgtctgcttttaagaaagctcagattctttttaagaacaacgaacattctcggatgaagaagaagttagaaagtgttcaagagttactggaaacatttatttataagagtttaaagagaagttatcgagaattaggatgcttaagtgaaaagatgagaatcattcacgacaatcctctcttcccttgggtgcaagatcagcagaagtatgctcatgctaagaatgaatttggagagattgcgcggtgtttagaggagtttgaaaagacgttcttctggttggatgaggagtgtgctatttcttacatggactgttgggattttctaaatgagtctattcagaataagaagtccagagtagatcgagattatatatccacgaagaaaattgcattaaaggatagagcccgcacttatgctaaggttcttttagaagagaatccgactacagagggtaaaatagatttgcaagacgctcaaagagcctttgagcgtcaaagtcaggagttttatacactagagcatacggaaacaaaggtgagactagaagcacttcaacagtgcttctcggatcttagggaggcgacgaacgtaaggcaagttaggtttacaaattctgaaaatgcgaatgatttaaaggagagtttcgagaagatagataaagagcgtgtgcgatatcaaaaagagcaaaggctctattgggaaacaatagatcgcaatgagcaagagcttagggaagagattggggagtcgcttcgtttacaaaatcggagaaaagggtatagggctggatatgatgctgggcgtttaaaaggtttgttgcgtcagtggaagaaaaatctccgcgatgtggaagcccaccttgaagatgcaactatggattttgagcatgaagtaagcaagagcgaattgtgcagtgttcgggcgaggctcgaggttctagaagaagagctgatggatatgtctcctaaagttgcggatatagaagagttgttgtcctatgaagagcgttgtattcttcctattagggaaaatttagaaagggcatacctccaatataataagtgttctgaaattttatccaaggcaaagtttcttctttccggaagacgagcaattgctagtttcggaagcgaatctaagagaggtgggtgcccagttaaaacaagtacagggaaaatgtcaagagagggcccaaaagttcgcaatatttgaaaagcatattcaggagcagaaaagccttattaaagagcaagtgcggagttttgatctagcgggagttgggtttttaaagagtgagcttcttagtattgcttgtaacctttatataaaggcggttgttaaggagtctataccagttgatgtgccttgtatgcagttatattatagttattacgaagataatgaagctgtagtgcgaaaccgccttttaaatatgacggagaggtatcaaaattttaaaaggagtttgaattccatacaatttaatggtgacgttcttttacgggatccggtctatcaacctgaaggtcatgagaccaggctaaaggaacgggagctacaagaaacaactttgtcttgtaagaaattaaaagtggctcaagatcgtctttctgaattagagtcaaggctgtctaggagatagtaaaaaagttgagttctttgcgcagtgtttttgatggattattcgttagaagacgatacttgagagttttccaaacttttctgtacttttcttccgaagagaactaggcagaggaggcttcctcctaacattagaaagattcctataccttcttgtagagaaggaagactttgtgagtagagataggtaagcacaaggccaaaaattggttcaaagattaatatcgcccctagcaatgctggtgagagattcaaactagctttattccaggctattaaagcttttgctgaggaaaatattcccatagcactacatagcaacaagaagagcagtcgctcggatcccggtgtatgcgagataagattgtgtgttacgtgggtaattccacagagatcgagaataataatcatagggaggcagatgatcaaagcgctgattccgatgaggtagctccaggtaatctggagttaggtnggggtgtttttcgagtagcgattgattgcggatcacatagattacccaaagacttgttgagagtatgactgcaatgactcccaagatagagtagagaggagaggcggctgttggcaagttgagtgcggagaggtgtgtcagaatcactcctgtgatgatcacactgctgatagcaaagagtagagaataggggagttctttttgctttgtattggagtggtagagtacggcggttggagccaggctggcgatgactacagtgattgcggatccaacatagcggatgccaagggtgattccgaagtaatacacggggttaatcagcagtgtccagaggaggctttttctccaaatatataaaggagtttttttaattacggagggattttttatagcgcaagcaatcagggagaaaataccaaaaatggtataacgggtaagtacaatatcaagatcgccaaacgaaccgaggaagtttggtatgacaaagacgattccccagtataggcaggcaacgagcccatggaagatgcctaggggtacattacgggttctggattcttgatttgcgctggggaacataaagctctcttaagggtatgagcaatagaattgcctacaattttaacatggtagggatttttgttggtattgagactttaaataatacgaattgcttttctgttcgagaggaaaataagaagataggggaagaatgttaaggaatcaggtacttgtttactgtagtgagggtgtttctccttattatttacggcatacgatacgttttctcaagtactatagcactcaagaaggtgctttcgatattcttagggtcnacgggaattttttgattaagaatcctttttgggaagaaacgacgcgcttattggtattcccagggggtgcggaccgcccctatcatcgtgtacttcatggtttaggcactgcccgtattttccaatatgtttctgagggagggaattttctagggatttgtgctggggcatattttggttctaagatgatttatttttatgagcctgagggagcgccgttgcaaggggctcgagatctagggtttttcccggggactgccaaaggtcctgcttatagggggaatttttcttatgtgagtccttctggtgtaagggtttcacctcagttattttcagattttggcttggggtatgcgatgtttaatggggggtgttttttcgagggctcggaaggatatcctggggtgaatatcgaatctcggtatgacgatcttccagggaagcctgcgagcatagtgtctaggattgtcagtaagggcttagcggttctttcaggacctcatatagagtatcttcctcattactgtcgtatggttaaggagaacgtccagaaaacacgtgaattcctccaaagggagcgtacaactttggaccgctattgtcagaatcttgtacagcgtttgcgtcagcctgcattttcgaaagcggactgctgaagatctaaattaggcaatcgaaatcatcagcgtgtatttttgtcgtatcgaactcggtgataagctgatataggattgggctgcaaagaactatggagtgcgttaggacatttcggatgttattggaggcataagacatctcttcatagccgtggagtagtccaaacgattgaatttgtggagctgtntggctgntnttatatacaaagcgattgaaatagtctctaggttctatagtgtactcatcttcattatagtctaattgctcgaatacacacagaaaagcgagtagttccatttgtcttgctatgggatttgagcttcctgtgttaaggctatctatgagtagtatttgatttctttctaatgctgttgaaaataggttatggtagtggataaagaattttttgaaaattagatagagttggttcgagataggatcccattcagatcttagaatgtcaggattatgtactacagggaagtagtaggtgatttcatttgttgtggtttcgatgaggttattttcatactgcgttttgttctgcaagtcggtcaatgaaacttgagaggctatccctaagttgtttacatgtttttcttgtaatttttgataggttttttgtaaaggttcggaggtgacaaagattctcggatccatatggatatgagaaaggatatactgttcatcttgttctaatattttccaattggcgagagcacttttaattaggaaatctggatctttaagaaagatttttttccattcttcgaaggatggaaaaaagagctcattttttaggtttatggatgttggatctaggagtagtgtttcggaggattgtattttatttttgagaggatttaggagccaggggtctaaagaaggtgtttctttaggaaaaatagattttggtttttgttcgtccttttgaacacttttcgagcactgtgttccaatgagcagggagattcctgtacttaggacgattatactgattagggacaatgctattatcaaaagagtatttgggagaagtccggagagggctatgagtatgcatgctgcaatccccaagaatagggaaagtatggcgagagaaagtttcgttatagcagcgaatttggattctggcagcagttgagcgggttttttattttcgtgtataattgaagaacacttgaccatagaagactatcaaagaaaatgcaaataataaattgaaaaatcgttgaaagaaggagtcgaagagaaaaaatactccggaggatgggttcgaaccaacgaccaatggattaacagtccactgctctaccgctgagctactccggaacagcttttactccctacatattctatgaccaaagggtaaaaagtcaatgattttcgtctctgaaaaaagaaagattttctttaagtcttgcaattttccttatatttttcttcactagtgcgtatgtttttccatcgatatgctttctggagttgtttatggagaatgctatgtcatcatcgtttgtgtataatgggccttcgtggattttaaaaacgtcagtagctcaggaggtatttaaaaagcacggtaaggggattcaggttctcttaagtacttcagtgatgctttttataggtcttggagtctgtgcctttatatntcctcaatnnctgattgtntttgttttgactatagatttgcttatgctcgctataagcttggtattgtttctcttaaaagttctgtacgctccttcaatggtagatcgtttgtggtgttctgaaaaaggatatgctcttcatcaacatgagaacgggccttttttggatgtgaagcgtgtacagcaaattcttctaagatcaccctatattaaagttcgggctttatggccgtctggagatatccctgaggatccttcacaagctgcggttctattactttctccttggactttcttttcatccgtggatgtagaggctttattaccgagtcctcaagaaaaggagggtaagtatatagatcctgtgctgcctaagttgtctaggatagagagagtctcacttttagtgtttttgagtgcatttactttggatgacttaaacgaacagggagtcaatcctttgatgaataatgaggaatttttattttttataaataagaaagcgcgtgacatgggattcaggatttaaaacacgagattatgtcttcgttagagaaaacaggagtgccattagacccctcaatgagttttcaagtttcacaagcgatgttttctgtatatcgctacttgagacaaagggatttaacgacttcagaattaagatgttttcacctcttaagttgttttaaaggggatgtggttcattgtttagcttcatttgaaaaccctaaagatttagcagattctgactttttagaagcttgtaagaacgtggaatggggtgagtttatttcggcatgtgagaaggctcttttaaagaatccgcaaggaatttccattaaggatctaaaacaatttttagtgaggtaatctatgatcgagtttgcttttgttcctcatacctccgtgacagcggatcggattgaggatcgcatggcctgtcgcatgaacaagttgtctactttagcaattacaagtctttgtgtattgatcagttcagtttgtattatgattgggattttatgcatttctggaacggttgggacctatgcatttgttgtaggaattattttttctgtgcttgctttggtagcatgtgttttctttctttatttcttttatttttcttctgaggaatttaagtgtgcttcttcgcaggagtttcgttttttgcctataccagctgtggtttctgcattgcgttcctatgaatacatttctcaggacgctatcaatgacgttataaaagatacgatgcagttgtctaccctttcttctcttttagatcccgaagcttttttcttagaatttccttattttaactctttgatagtgaatcattcgatgaaggaagcggatcgtttgtctcgagaggcttttttgattttattaggtgagattacttggaaggattgtgaaacaaaaattttgccatggttgaaagatcctaatatcactcctgatgatttctggaagctattaaaagaccatttcgatttaaaggactttaagaagaggatcgccacttggatacggaaggcctatccagaaattagattaccgaagaagcattgtttagataagtctatctataaggggtgttgtaagtttttattacttgctgagaatgatgtgcaatatcagaggttattacataaggtctgttatttctctggggagtttcctgccatggttttaggtttgggaagtgaagtgcctatggtgttaggactccctaaggttcccaaggatcttacctgggagatgtttatggaaaatatgcctgttcttctgcaaagcaaaagagaggggcattggaaaatctccttggaagacgtagcctctctttaatgaaagaagagtcctcggatgaagcctatgatttcttctgtaggtgttccaggggtattgatatcgttaagacggtcttggaattgtggatacgatgagtagaagtgtttatgagcttgttgggataggggtttaataatatctccagggaggttcaggtggtagaggctttcttctagagctaggtagagcaaggaagggagagcctctgagagttttggtaattctttagctgagctagtatggctatggaattccaaggatggcacagaaagatggggaatgtctttatggttagctctgagtccgtacaaccgtgtgtttagaaataggcatcttcggatgagcacgggagcacggtctatccataagtttgagggggtttctttttgtggatggaagtttttccatactaaagaccagtttgtttttgtgccgtgactgtcgtaggggaatatggtgaagtttgccccatggataatgagctcggagatttccaactgtttcgttagtagcatagatatggaagaaaatcgtacatctgcgtactcgatttcggcggcgtaaggaaagcgttcagaagctagagggttatgaatgcagatatgacggattttaattccagaagttcttatggagactcttcctacagtgacttgggtgtggaggcggttagatagccattgctcaacgatactttctttgcgcatccagaaatatccaacgatgcagcaccctataagaaatagattttttagcagtttaaacatataggcagaggagttttatatcttaataattaagatagattaagaaatgaatattcccaaagaaaaaggtctcttttctttagttagaaaagagacctcatggaaaattgttaatactagcttaagagactagtagtccattcctgcgcttggcatcgctggagctgaagaagatttctcttctgggatatcagcgattaaggcttctgttgtgaggagtaatcctgcgatagaagctgcgctttctagagctgagcgagtcactttagttggatctaaaattcctgcgtcaatcatatctgtataagcgtcacgtaaagcatcatagccttcatttgcagatcttgctagaacttgctgacaaatgatagcgccttctttacctgcgttacttgcaatttgctttaatggagctgttaatgcttttagaataatacgagtaccaatagcttcgtcttcgtttgctagcataggaaggaaagcttctagtgtagggatacagcgaactaaggcagttccaccaccagggaggattccttcttcgacagctgcaatggttgcgtgttgtgcatcatctactctgtcttttttctctttcatctctatttcggtagcagctcctacgcggattacggcgacaccaccggagagtttagctaaacgctcttggagtttttctttgtcgtaatctgaagtgctatcttcgatttgttttttaatattgtcgcatcgagcttggatatcaggtttgtttcctaagccttcgacgattgtggtatcttctttagttacgataactttcttagcttttcctaacattgctagagttgtattctctagtttcatgccaagttcttcgctaactagttggccaccagtaaggatagcgatgtcttctaacatagcttttcttctgtcaccgaaaccaggagctttcactgcacagactctgaatcctgcacggagtctattgactactagagttgctaaagcttctccttcaatttcttctgcaatgattaaaagagggcgtccagattctgctacttgttgtaaaactggaaggaagtctttaattccagagatttttttatcgtagattagaatcagagcgtcttctaaaacgcattcttgagtttctggatttgtggagaagtagctggagaggtatccacggttgaagttcattccttctacaacgtcgagaacagtttcgaagcctttagcttcttcaacagtaatggatccgtttttaccaactttttccatagcttctgcaataagatttccgatttcggaatcattatttgctgagatagtagctacttgagcgatttctttgtgatgttgtacaggtttactaatttttttgagttcatcaacaacaacttttacggctttgtcgatacctctttttaggtccataggattggcaccggcagtgacatttcttagaccttcgctatagattgcttctgcaagaacagttgctgttgtagttccgtcgcctgctttgtcagcagttttgctggcgacttcttttaccatctgagcgcccatgttttcatgtttgtcttcgagctcgatttctttagctacagtaacaccatctttagtcacttggggagagccaaagctcttatctataactacgtgacgtcctttaggacctagagtaacttttactgcttctgcaagagtttttacccctttatgtattttttntctggcttcttcattatatttaatatttttcgctgccatcgttgttctccttaactttctataatctgcaaactagtattttattttaggacggccatgatttcactggactgtagaatgacatactcttcgtcatcgattgtgatttcttgacctgcatacttatccattaaaatgatatcgccaacttgaacttcgaaaggaagtagagtaccgtcatcagttcgtttgcctgtgcctaaaacaaggacctcagcacgatcttgcttcctttttgctgtatcgggtaagatgattcctccacgagcagtggcttcttcttcttccctttttaccaagattctatcgcccaaaggtttaattcggagggtcgttgcttgatcagacatttatatgctccttatgttttacgttctaagagactttgctatttctgcaatcacgataacaaagcgtttttttttgtgcaataattttagcactcaataattttaagtgctaaaaactcaatcttctgaaagcaaggaagagagtaggtctatctttttcgtaatgaatgcaaaggctttatctaatggagcagaggtggtcatatccaatcccgatttctttaatatattgagtgggaagtcagaccttccgcttttcaaaaattttaaataaagttcgagagcccctggttcttgtgtaaganttttttcagcaaaggagagggcagctatgatacctgtcgcatattgataaacatagaaattatagtagaagtgagggattctagcccattctaatgcagatagggaatccgaggttacaacacctccgtagaattctttttgtaaattaccgtaagttgcggagaggaactcttcagtaagaggagttccttgttctgctgcagaatgaatttcgtattcgaaggcagcgaaaaaggtttgacggaacagagtcgcaaatatggtgtctagagttttagtgataattacgattttgtcttctttactttgatctgatttgctgagagcttccatgaggagcatctcattgaatgttgaggcaatttcagcaagaaacagagggtattgggcatcatgatagggctgtgcttctctactgaagtaggagtgcatgctatgtccagcttcatgggcaatgacggaaacgtcatagagtgtattcgtgtagtttagaagaatataaggagcgctatcatagcatcctgaggagtaggctcccgaacgcttgtgcttattttcgtatctgtctacccaacgatttgaaagaagaccatttcttagaatttcaacataatgagtccctaagggaaggaggcttttgcaaactaggtcaacgccttcttcataactataattcttacttgtagtttgggaaataggagcataaacatcataaaagtggaattcttttagatttagagcttctttttttaggttaaaataccgattgataagagaagtgtgtttctttgtttcgtttataagattgatataaacagttgtagggatgttatgttggaatagggatgcctctaggcacgaagggtaatttcttgctttggcttcaaagagatgcgcttggactttcccattgagaagattcgcgaaggtgttacggtaatcatagtaacgttggaattgagctaagtaggcagtacggcgcaattcctgatctggggattgcatatacagcgaagccagggcatgggatagcggatgttcttctccgttcgaatctttagctataccaaaaggaatttctgcatcgcttaaggaagagaaagctttatttgagacattaagggctgcaaacgaggaggctaagatcttttcttcgtttgctgttcctgtgtggggagaaagacggaaaattttttctaggtaaaatctatagggagcgagcactgagctggatagcaaggcagcgactttttcttcagaaagagcaattanagctggttggatccaagaaatttcctgagaaaagagagtgtagagatagacaatggattggtagtcgctttccccttcgggatttgtaatatcttgatcgtggatgaggtgagcgtatatgtagagttggtctaattttcgttctacagagaatttttttgataaaagttcgagtaaagattcggggttatcgatttgataatgagagggagagaattcgggccatatgggagaacgatcttttccagagctacaaagatcgaaatcttttttccactcctctctatttgcgtacatgagagttgtgtcccaacaatgctttggatctacttgagttcttgttgggagtgcttcggttttcagttcagtagtcatgagggaaggaactcctttttaagagtcaggatgaatgagaaagctcattataagacaatctttaagaaaaagccaagaacaaatcttggtttaaagattagaaggggttggccgcatctataaaggttgtggaaataggaaattcgctttttagatgctctgcaagagattttggacctactttttctgtggctgtatgtccaaatgctaggaagttgatattgctttctagagctgtcgaccatgcaggttcatcaaaatttcctgtgatgaagcaatcgacttgggacgtggctgccgaagagagttctctataagctcctcctgagatcagagctgctgaggagactctagaggggccgcccaaggcagatccttttaggggagcttggtaatatcgagataacaggtcaatgaaagaatctatatcgataggagagaaagagccttgcactcctaaataagggagggaagaaccaaagggcttcaagtcatgccaatttagatccagggcaactctccagttatttcctaaggtagggtgagcatccaaaggaaggtggtaggcaatgagttggatattgtgttctattagtaattggatgcgcttatggatcatgccggtaataggatagggcatacctttccaaaaaattccgtggtgtacaatgagaacgtttgcttcggccgcaacagcttgttttatggtttctagatctgcggtaactgcaacagcgattttctttaccggagtttggggatctccaacttgaagtccgttgggtccataatcctgaaatatttttgatgagagaagagtctcaagatgagaaaggagatccgcaacattcatagaacagacttatttaaaaaatagcatttagtacacaagtgcccattattgtaaaggttttgttataaaaacaagtaagtattcttagctcatcaaactattctatatgtaagatattagctagttccatgtttagtaattataaatgcatttagagtctttctgtacttttagaattttacatggcttgatgttttcctttagaaatnnccaaaaaaatgggggttgtaattcggcgtatctatctgtggtagagaggattacatttcatattctataaacttcggcagtattttagagtgttagtatttggaatgttttagtttcttaggggaaaccatccgcagatgagattttttccaacgtattaagttttatcatctctatctaattttcagaaagagtatgaagatgagccctggcatgtgaaaagcagagactattaganaaatctttgagccgaagagtcaaagattttaatcaggctatcgataatgatgttctgtgcgtaagttaggttttcttcggtatgtgcggagctaatgaagtttgcttcgaggggagatggagaaaggtagactccattatcaaatacttcagagtagaaggtttgaaatttctctacatcggaattttttgcttcatcaaaatttgtgggtgcagattctgtaaaaaagaggctgaacatcgttccctgatgtactagagatactgggaatccttgagatcggatttcctcttcaattggagaataaaagagagcctctaattggctgagatggtcatagaatccttcggattggcataattgaatggcggcgtgtcctgtagccatagcgaggaagttcccagacatggtacctgcttggaatatggtgccttcgggcatgaggtgatcgagaattgagcggtgtcctacaagggctgcagcaggtaggcctcctcctaagatttttccatagatggtaatatcgggggagagattgaaaatatcttgagctccttggaatgccactcgaaatcctgtgacgacttcatccataatagaaagacttccgaagcgtttgcagagttctatgatatcgtctagaaattcggctttgggaaggacgatacccatatttgcacatataggttcaaagataattcctgctacttgaggtcctagagcttccatgacatggtgtaggatttggctattgttataaggcagggatatcaataaagaatgtggagagggcgtgtgtatcaatgaagttaggttgtctatagtttcttcagttgttgagatgcctccaagaagagtatctgcatgaccgtgatatccccctataaatttgataataatagagcggtttgtgattcctcgagcgagacgtactgcagtcattgttgcttccgttcccgaggatacaaaacggattttatgttctttgagtttgagcgaggagaggagcattgttgcaaatagaatttcctcttcagaggttaagccataggaggttccttttagagctgttttttggatagccttgacaattttgggatgactgtggccgtgaattaaagctccccagcctccacaaaaatcaataaactctcgtccgtgagtatctaggaaaatatctccttgtgctgagctcactatagggggtgtgactcctacagaacggcaggcccgaacgggagagttcacgcctcctgggaagacttggcatgcctcttcaaaagtaacggtatgcttttgatttgagcagttcaacatggaatttcttttagtgagtttccacatattttggagaagctgatctttaatggctagaaaaagccgtgagttagtttagcaatagattgtcagggactgtagaaagcgaggcatattttcctccaagatctttaagaactaaagcccagagatcttctggttctgagtaaaagacgtagtctttgttccctggagctagaaaccagtcattgcttaggaattctttttcaagttgtcctgcttgccatccgctatagccaaaacataggttgatttctggcccagattcgctagaggcgatttcttggaggaagggaagatctcctcctaagtagactgatggacaaatttctaacgtttgttcaggaatttcggagcatgaatgaagtaacatcatttggtttgcttgtagggggcctcccntacaaaagcggatattatgattggagactttttcaaaggtaaagatgtcatctgagatttcaaatcccagggttttatttaagatgagaccgaaagaaccattgaggctatgttcacaaagtaggatgacactacgagcaaagactccttggtttatattcaggagaagcgactaacaaagatcctttttctaggcgtgcataaggaattttcataatatctctgagtttattcttcgtaggggactacagcatcaaatactgatttaacacacaagatgggattttatgagttaaggcgagagggatctatcgctaggacgggcatcgacatcaacgacgtatagaaattcgcgatctttttgttctaaaaagagtcttgtgtagaaaacgttatctttatagtcattaattactacacgtaacacttggatatcgaaacctgaaaagacaaagttcagtagatcatgagcaaaaggtctttgaggagagtgtccttcagtatcagcaccttgaaatgcttgccccatggaaacgtgcccatatatagcgaactttttttcttcagtacctaagatcatgcctgcataattacaaaaactgacaagtttgtaaaaattgagaagtactaagggggtttcttctaggagttctttttctaagctcatacagaatattttttgctgattagaccttggctattgctagaccacacttcgactttctctataacaaacccgacttcaataacaccatgaatttgtattaactttaataaatccttttcaggatttgggtaggagttgggggaaaaaatatcgtaaatgtagttgctgctgtctgtaataaataggtcaccagtatcttgtaggcgccattctccttcatatccaagatggcggatttcttcaataattgctgagcgaccgaatcgactgatttctaaaggaacacgaaattttcctaggactggaaccagtttactttcatcaacaaggataatgctgcgttttgctgctcttaaaagaatcttttctctgaaaaaggtccgccaccacctttgatcatccgcaattgagggtcgacttcatcagcaccgtctaccgtaagatctagggaagagaatttttctgggtttaagagggggatggcaagctgctttgctagagcataagaattttgagaagaagctatagcatgaactgctaaggactctgtttgaattctatgggcgagtgcaaagataaattccttagctgtagatccactgcctaagccaagaatcatgcctgaagttacttgtgtagcagcctcatgggccaggcattttttctcatgaagatgaagatctttttccacagcgctactactatgttacaaaatattcccacagcttatgcaaagggattcttccaatactatacaaaaatcgaaaccttttggacgagtctttagggtaatcgattttcagatctttaaatgaaagcgtattgatcctattttctgctataggttttagtgggtaggaacggatcttttgtattgcattgtcatgggatactctagaaatctcgaagtgcgaacaaaaattaagaatggaattcttagtagacaatagttggagtattttgaagtgaaatttttccaaagtccccttcgatttagaataggagtgactttaaaattaagatagaaaacgaacctagataacgtacataaagggaagagctggttggatctatagaggttccaaccagctctggtttcattatttccaaacttcttcggaaatttcttttactagagcaactttagcccattgctcttcttctgttaatttatttcctatttcacatgaagcaaaaccacactgtggacttagagagagtctttccaagggcaggtagtctgctgcttgatgtatgcgagcaatgacctcatccttattttcaagtgtaggggttttgctggtaacaagacctaagcagacagttttttctccagaaatgaaggtgagaggagagaagtctccagaacgctcatgatcaaactctaaatagtagccgtctacatttgtttgttcgaataggggctttgcaataaagtcataactaccactagcaaagaattttgagtggtagttcccacggcatacatgtaaattaacgactagatcatcgggacgatctgcaattacaagattattaatcagaagatattgttgaatcagatcttgaagacctttttcatcgataccataccacgaacagactcgagggtctactaaacctccccgagtacagtcatctaattggagatagcggcagccagcatcataaagatcgcgaatgactttacgataacctgcaacaatatcttcaattagctcctgatttgtaggatagaatttacgtgtgacctctatattattagggaagatcatctgctttaaaaactgtgccggtgcaggaagagtttgctttgcagtcgtaaattcatcttctagagcttttacaaatttaaagtgatccacaaatgggtggtgagatacagagatcttgtctgtcagataggtatcatcgatcatagcgcgttctccatcaaagaaaactccttctgtagctctgtggtgacctacgccatgaaaaccccacatgaagtcgtaatgccacgtagctctgcggaattctccatcagtaataaaagaaagacctgctgctttttgttttttgatcaaatcttggatagcgatatcctcaatttgcatgagttgatctagagaaatagagccttctttaaggctttctctagttttttttaaatgctcaggacgcaaaaaactaccgacaacatcaaaatgagatttcagaggtctttttagtgaagtattcatgattgtcctccttcagactagtgaaatggaaagagctaagtagaaaaacgtcgaattttctataggattaaaaataagaataaacaagttataggcgtttctgaaagacagaatcgttacttaatactttccacaatgttctagcatttaagaacataggatatattttgtccaactataactagatcatttaaaaatatttgtaatttagttggaatatataaaatcattagcattaagcaaactgtttttcttttcttagtttttagatgcgaataatttgataatttctcaggtaattaaaaatcttttaattgttttttctgtttatgtttgacaagcacaaggtggatgccactctatagtcacgatctttaagtccttgatttgtgaagaaattggtccttaggagttgccgctttcttcagacagttcaagagatcacttcctaatgtatttttagaaaggggaaagagatcctcttaggttagacgtttaggtttggtagtatttcgatagggtttgataaagttgcctcttctacattctcagaggaaagtttatagattttttattattcctatgtaataagaaaaacctttttaaaaagtgcttggggtgaattttatggagaaattttccgatgctgtctctgaagctttagagaaggctttcgaacttgctaaatcttcgaaacatacctatgtcacagaaaatcacctattactggctttattagaaaatacagagtctctcttttatttggtaattaaggacattcatgggaaccctggtttgctcaatacggcagttaaagatgcgctctcacgagagccgactgtagttgaaggagaggtggatcctaaaccttctccgggtttacaaacccttcttagggatgccaaacaagaggcaaagacattaggagatgaatacatttctggagatcatctgctgcttgctttttggagttcaaacaaagagccttttaattcttggaagcaaacaacaaaagttagttttaaagatcttaagaatctgattactaaaatacgacgaggaaatcgtatggattcgccaagcgctgaaagtaattttcagggtttagaaaagtattgtaaaaatttaacagcattagctcgtgaaggtaaactggatcctgtgatcggtagagatgaagaaattcgtagaaccatccaagtgctttcccgtagaactaaaaataaccctatgcttattggtgagccgggtgtagggaaaactgctatagcagaaggattagctcttaggcttatccagggtgatgttcctgaatctctcaaaggtaaacagctttatgtcttagatatgggagctttgattgcaggagctaagtatcgaggtgagtttgaagaaagactaaagagtgttttaaaagatgtagaatctggagatggcgagcacattatctttattgatgaggtgcatactcttgttggagcaggagctactgatggagctatggatgctgcgaatcttttaaagcctgcattagcaagagggacgctacactgtattggcgcgacgactttgaatgagtatcagaagtatattgaaaaagatgctgctttggaacgtcgatttcagcctatttttgtgacagagccttctttggaggatgctgtctttattcttcgtggactaagagaaaaatatgaaattttccatggagtcaggattacagagggggctttgaatgccgcagtcctactttcctatcgttatatcccagatcgctttcttccagataaggctatcgatttgatagatgaagcggcaagtttaattcgcatgcaaattggtagtcttcctcttcctattgatgaaaaggagagagagcttgctgctttgatcgttaagcaagaggctataaaacgcgagcaatctccttcctatcaagaagaggcggatgctatgcagaagtctatagatgctttgagagaggaattagcatctctacgtttgggttgggatgaagagaagaagttgatttcggggctcaaggaaaaaaagaattccttggaaagtatgaaattttctgaagaggaggcggagcgtgttgcagactataatcgtgtagctgagcttcggtatagtttaattccccaacttgaagaagaaatcaaacaggatgaagcctctttaaatcaaagagataaccgtctccttcaagaagaagttgacgagcgattgattgcgcaagtggtagctaattggacagggattcctgtgcaaaaaatgctagaaggggaagctgagaaactgttaattcttgaagaatccttagaagaacgtgtggtaggacagccttttgcagtctctgcggttagtgattctattcgtgctgcacgtgtaggtttaaatgatcctcaacgtcccttaggagtctttttatttttagggccaacaggggtaggaaaaaccgagcttgcaaaagctcttgcagatcttcttttcaataaagaggaagctatggtccgcttcgatatgtcagagtatatggaaaagcattccatttccaagcttataggatcttctccagggtatgtgggttatgaggaaggtgggagtctttctgaggctcttcgacgacgtccctattcagtagttctctttgatgagatagagaaagcagataaggaagttctaaatatccttttacaggtttttgatgatgggattcttacggatgggaaaaaacgcaaagtaaattgtaaaaatgccttgtttatcatgacatcaaatataggttctccagaacttgcagattattgttcaaaaaaaggaagtgagcttacgaaagaagcgattctttctgtagtctctccagtattgaaaagatacttgagccctgaatttatgaaccgaattgatgagatacttccttttgttccattaacgaaagaagatatcgtgaaaatagttggcattcaaatgcgaaggattgcccagagattaaaggcacggcggatcaatttatcttgggatgattctgtaatattatttcttagtgaacagggttatgacagtgctttcggagcccgccctttaaaacgtttgatccaacaaaaagttgtgatcttgctttctaaggctttgcttaaaggagatattaaacctgatacatcgattgagttgacgatggcaaaagaggtgctcgtatttaaaaaagtggaaactccttcttagagagttttctatgggtgcggaattttagatactaggaaaagccctctttgttaagagaatggataggtttttagattctatgtcttcttgctacgctttcttgtttcccgggatcataaaaaaactaggacgataaagtgtgtgtaggattagaattgtgcggcaagcttcatttggctaaacaagagcagtcacagaaatttaagaagtcctatgtttaagagctttatagtaaggtatatgtttgtaggtggccttgtttcattcttgcttcctatccccgacttggaatgtgcgaataatgtaacaaaaacttatgataagaaagcttctgttatatccagagatcttaagctacaggaagactgccagaagttttggaatcttgatccgtataaactagaaagtctttgtgcttatcaagtgctttaccatgatgactatagttccaagagaatacgagagctttttcctcaaatccaaaaagacgaagtccccatatttgcaacaatgattcttactttagggaaagtagaccgtggcttttctcctgaagaaatttcattgatccaaaaactttcttacccaggcctctcattggcttctttgagagggtctacagaaattagacccgaatacagatttggctcgtgctttagtagtgtcggagttttctggagatttagggaagaaccgagctgactactatagcaattgccttgatattttggcgttgcgtattcatgcagaacgtcaaaggtatttagatcagtctccttgtgttcctggaacctccgagtttcataaggcaactatagaagctattaatacgatactcttctatgaagaagcagttcgttatccttcgaagaaagaaatgttttctgatgaattttcttttctttcttcagttacagatagaaaattcggcgtatgtttaggggtctcttctctttatttctctttgtcacagcgcttagatttacctttagaggctgtgacgcctcctgggcatatctacttacgttatcagggtggtgaggtgaacattgagactacagctggagggcgccatcttcctacagcaagttactgtgattgtctagatttagaagaccttcaggtgcgtactcctgaagaaatgatagggcttacttttatgaaccagggctcttttgctctgcagaagaaaaagtataaggaagcggaagaggcttataaaaaggctcaagagtatttgggagacgaggaactacaagagcttttggggtttgttcaaatcctaggaggaaagaaaaaagaggggaaatctttgattggtaaaagtcctcgcgcttcccagaaaggatcggtggcttatgactaccttaaaggtagaatcaacattccaacactagctcttttattttcttatccaggatccaattatgaagagatagcttcttatgaagaagaactcaaaaaggctatgaaaagctcgatgccatgttgtgaaggacagcgtcgtcttgcttcagtagcatttcatttggggaagacagcggaggcggttgctcttttagaaaaatgcgttgaggatatccctaatgatctttctcttcatttaaggttatgtaaaatcctatgtgatcgacatgagtatacaaaggctttgaaatacttcataattgcggaaagacttatggaggatcagggatttcttaaaaaagacaatcgttcgttcgctttattttatgaggtgaaaaaaatcatatccaaagtggctcctcaaaaagctaacaccttgcttttaatggagtctgaaagataacttgatcagttctttctgtattgctcttatttataacatgttataacattgcaagtgttaatttttaacagatctttatttgttgcaatatttttttaaataagaattgagctattttttagcctcatattgcagatgtcatgaaagatttgaatcaaagtaagtcttgctttccaagctttggtaggattaaagtgtttgagatgaattcgcattttttaaattattgttggaattagtatgagcagttcggaagttgttttccagacagttcatggccttggctttggtggattgtcttcaaaaagtgttgtcccttttaagaaaagtctttcggatgcgccccgtgttgtgtgctcgattttagttttgactctggggttgggagcgcttgtttgtggtattgccattacttgttggtgtgtcccgggagttattttaatggggggaatttgcgctatagttttaggtgcaatttctttagctttaagtctattttggttgtggggtttattttctaattgttgtggttctaagagagttttaccgggtgagggattgctacgggataagcttttagatggtggattttcaagagcggcaccttcaggaatgggacttccgggtgatggatctccaagagcgtcaacgccatcttgcctagaggaacttcaagcagagatacaggcagttactcaagctatcgatcagatgtcagatgattgactctaaagcgtagaggtacttaagggagaggctttgctaatcagtaaagaaactttaatacaagtaagatctaagttgaataacttaaaaagataatgaataaaaacaaaatagcatgggggaccaatggctgttcaatctataaaagaagccgtaacatcagccgcaacatcagtaggatgtgtaaactgttctagagaggctataccagcatttaatacagaggagagagcaacgagtattgctagatctgttatagcagctatcattgctgttgtagctatctccttactcggactaggtcttgtagttcttgctggttgctgtcctttaggaatggctgcgggtgctataacaatgctgctgggtgtagcattattagcttgggcaatactgattactttgagactgcttaatatacctaaggctgaaataccgagtccagggaacaacggtgagcctaatgaaagaaattcagcaactcctcctctagagggtggtgttgcaggagaagccggtcgcggcggggggtcacctttaacccaacttgatctcaattcaggggcgggaagttagattttttatctaacctactaagttagtattttaactgtaggtttttccttccgttgttttaaaagaacctcaagaataactagaggttcttgtttgtttattgcaatcttcgtttttgctatctatagttaacttatataaatataaggcaaatggtggagagttagctctatggaaagtgagaaagatataggagctaagtttttaggtgactataggattctctatcgcaaggggcagagcctatggagcgaagatcttttagccgaacatcgatttataaaaaaacgttaccttattcgattacttcttcctgatctaggaagttctcaaccattcatggaagcttttcatgatgttgttgttaaactagcaaaattaaaccatccaggcatcctcagtatagaaaatgtttctgaatctgagggaagatgtttcttggtaacacaagagcaagacatccccatcctttcactaacgcaatatttaaaaagtattccccgcaaacttacagagctagaaattgtagatattgtaagccaactcgcttctcttttagattatgtgcattcagaaggactggctcaagaagagtggaatcttgattctgtctatattcatattttgaatggtgttcctaaagtcatactccctgatctggggtttgcttcattgataaaagaacgtattttggacgggtttatttcagatgaggagaatcgagaatctaaaataaaagaaagggtactacttcacacttcagaaggaaaacaaggtagagaagatacgtatgcttttggtgctatcacctattatttactttttggttttcttcctcaaggcattttccctatgccttcgaaagttttttctgattttatctatgattgggattttttaattagctcttgtttaagttgttttatggaagaaagggcaaaagaacttttccccttaataagaaaaaaaactttaggagaagagctgcaaaatgttgtcactaactgtatagaaagctctttaagggaagtgccagatcctttggaatcttctcagaatcttcctcaagcggtccttaaagtaggggaaacgaaggtaagtcaccagcagaaggaatctgcggaacatttagaatttgtgttagtggaagcatgctccatagatgaagccatggataccgctatagaatccgaaagtagttctggagttgaggaggaagggtattccctagctctacagtctttattagttcgggaaccagtagtgagtcgttatgtagaagctgagaaagaagaacccaaaccgcaacccatacttacagaaatggttttaatagagggaggagaattctcccgaggaagtgtcgaagggcaacgtgatgagcttcctgtacataaggtaattttacatagctttttcttagatgttcatcctgtgacgaacgaacagtttaatcgttatttagaatgttgtggtagtgaacaggataagtattataatgagttaatccgattgcgagattctcgtatacagcgtcgttcgggtaggcttgttatagagccaggttatgctaagcaccctgtcgttggggttacttggtatggagcctcagggtatgcagaatggataggaaaacgcctgcctacagaagctgaatgggaaatagctgcttctggcggggtggcttgctacgctatccctgtggggaggaaatcgaaaaaagccgggcaaattttttcactgcggatacgacaacagtcatgagttatccacccaatccttatggcctctatgatatggcagggaatgtctacgagtggtgccaagattggtatgggtatgatttttatgaaatttctgctcaagagccagagagtcctcaaggtcctgctcaaggagtctatcgggtgctaagagggggatgttggaagagcttaaaagatgatcttcgctgtgctcatcgccatcgtaataatcctggggctgtaaatagtacgtatggttttaggtgcgctaaaaatatcaattaagagaggttcatgaaggaagagaattcacaagcacactacttagctttatgtcgtgaattagaagaccatgattattcttattatgtgttgcatcgtcctagaatctctgattatgaatatgacatgaaattacggaagcttcttgaaatagagagaagtcatcccgaatggaaagtcttatggtctccctcaacacgtctcggagatcgtccctctggaactttttctgtggtttcccataaggaaccgatgctttccattgccaatagctattctaaagaagaactaagtgagtttttttctagggtagaaaaatccctaggtacaagtccacgttatacagtagaacttaaaatcgatgggattgcagtagcaatacgttatgaagatcgtgtgttggttcaagcactcagccgaggaaatggaaagcagggagaggatatcacatcgaatattcgaacaatacgctccttgcctttaagacttccagaagatgctccagagtttattgaagtacgtggcgaggtcttcttctcttattctacgtttcaaattatcaatgagaagcagcaacaattagagaaaactatttttgccaacccgagaaatgctgcaggaggtaccttaaagttactttctcctcaagaaagtcgcaaacgtaaattagaaatttctatctataatctcattgctccaggagataacgattctcattatgaaaatcttcagcgctgccttgaatggggatttcctgtatctggtaaaccaagattgtgctctaccccagaggaagtgatctcagttttaaagactatagaaactgagagagcttccttgcctatggaaatcgatggtgctgtcatcaaggtagacagtttggcaagtcagagagttcttggagccacagggaaacactatagatgggccttagcttataaatatgccccagaggaagcagagacccttcttgaggatattctagttcaagtaggaagaacgggagttctgactcctgtagctaaactcactcctgtactgttgtcagggtctttagtatctagagcgtctctatacaatgaagatgagattcatagaaaagacatccgtattggtgataccgtttgtgttgctaaaggtggagaggtgattccaaaagtagttcgggtatgcagagaaaaacgtcctgaaggttctgaagtttggaatatgcctgaattctgccctgtctgccatagtcacgtagttcgggaagaagatagagtttctgtgcgttgtgtcaatcctgagtgtgttgcaggagctattgaaaaaattcgtttttttgttggtcggggagctttaaatatcgatcatttaggggtgaaggtaatcacaaagctgtttgaattagggttagtgcacacgtgtgcggacctatttcagctgactactgaagatttaatgcaaattcccgggatacgggaacgctctgcaagaaatattctagagagtatcgagcaagctaaacatgtggatctagatcgttttcttgttgctctggggattcctctcattggaattggtgttgctactgtactagctggccacttcgagactttagatcgggtaatttccgcgacttttgaagaacttctttcactagagggtattggagagaaggtggctcatgctattgctgagtatttttcagactctacgcatcttaacgaaatcaagaaaatgcaggatttaggagtgtgtatatctccttatcataaatcaggatctacgtgttttggcaaggcttttgtgatcacagggacgttagagggaatgtctcggttagatgcagaaactgctatccggaattgtgggggtaaggtaggctcctctgtctcgaaacagaccgattacgtagttatggggaataacccaggatctaaattagagaaggctaggaaattgggagtctctatcttagatcaagaagcctttacaaatctaattcatttagaataatttattttaaaattttcttaatacattaattcttatttgtaaaagttttatttaaattatttattataaattcttttacagctataattgtccgtattttataagtttttttgttcttttgggagtaaacatggcttcttcttcaaacaattcgactaaacaggacggcataccatcttgggtaaacccaaatgtccagtggaatcgagcgtcccaggtgggtgatcaagaagcgaattctctaactccagaggctcaaacttcacgtagctggttttccgatcgcaagcattttcttgaagtcttagacgttagtctagaggagatggagaacaatgaccttaagaaatactctagatataagacgattatcctgattgccacgctggtcactgttgcgattacctgtatcgttcctatctctatggtgtttggtatcccgatgtgggtgccctgtcttattttatttggagcgggtctttcttcggcttttctttctcatcgtcttcaatctaagtgcaaggagatccatttaagataccgagcgtaccagatttatcgccagcagctgttgagtcagtaccctgacttgagaaagtctactctctataaatatagtattacccatgtcaaaccgaaaaagggatttgttggtaaactcgtagaaaatttgcgccctgatttgcataaaaataaggacgatgggggtgctgctgcagactccagattagattttgcgggatatggagtaaagcattatcagacggatgctctacttggagtttcaggtgttaatagtgtagaatggcaacgtcttgcctctctgattatgagtgttaagaacgacattttaaatgatgtgggaagcagagagcccattgataaagcgcaaaggtctgctttagtagtcagtggtaaggatattggaggggagattcagcctggaggtattttagatatttccagagatattctagcgatctgtggctacggtatgaatgtaggtgttgaggcgaagaaagctatagaccagtataagaagtggtatctcaatagtagtacatttattgcttggaatccgcagcttcctgctattgcccagtcctatttactagaacaacaacgacatctagattatgctgctaagattttccaagatctttccgcattgacgacagcccatggtacagggcaggctcttgaagatttagatagtttgctttgttattatgatcagttaattgaatctaaaggtgtcggtgaaaagataatagcatcgattcaccagaaagcatctcgacttagcaatgcaagattcctgcgatcaggaacatttaaagaaatggtcgaatctataccacgtgttttcaattactattaaagaattcactgaaggtaagctagaacaaaatgaggtagtatctagaatacaaaggcttcgaggtaagttagaaaaaagtaaatgcagcattcttggaaattgtcgaaccaacgcagaatatgcaacaaagtctgaaaaaaaactcgcagattatttgctgcagattggggatagagaacctttccttactggaatgcataaggcgatagccaccggaaaagctattcaaggaaaagtggaaggagtcatttcacaacatcctgaaaagcaaattatgatgcttcggtgttctatagagagactcgaagggatgttgcgtcgagaggattggggagcaatcctacaaaaaaacgaagacgaagtccttgcattgaagagtacaatggaagctcagcttcaaggatttaaggaccttgtaggtacctgggaaggaaaatatcaggaatttaagaaaaacaagctttccaaagttttagtttacgacttcacaaaatcctattctaaccttctaaatcgtttggaggtactccatgccgagagctccacggatgatttggtattacatgtcgatagaatgtcggaagatctgaagaaaacaatcgaggagattgacggcaatttatttcaggtaactcctgaagagctctctttgttagctcgggaatatcagggactcatgaatgaacttcctctgatcgttcaagaggggaatcggctccaagaagcaatctctagtgaaggggtttctcaaggattgatgttgttgaactctttattgaatagagatgaaaaaataaataaaaacatagaaagcagtaggaaaaacttagtagctatcgcgaaacaagcacgtagcgatgcgagaaatatagacagtcagggattggctcctttgatccaaaggaatagagctagcctggacaacattctccagaatatgtatttgtttaacggcagtatacgtaatatccatgctctagatacggaaacgttagtggcaacttcctctaatatgttttctgcgatgcataccttcgactggaatatctatacgaatttgcttgatgttttagaaatccaaagcaaaccagctcctgcccctatggagaatcctgaccttcctggagctcttcctgaagaggtccaggatgcggttgctgaagatgtttctgggactcacaggctacatcaccaggtgttaaagagacgctgtgctgacttaaaaaatatgatcagtcaattgcagaagtcgataaacaaatggggaatggctaaggccattgtcctgggaattgttgcggtgctcttctgtgttcttagtgctatttttattggtcagaacattttatccttactcattctctcttgtgtagggttacttttgactcaggtatgtcctttaatctttgatcgtatatctaagagcaaggagtttgagaagcaagtgcttgagacagcgcagtccttgattcctgccactaagattcttccctcagaattcaataataaggatcttaatcgtttagctaagctccaggataatttaaatcttgagggttttggtcctacatgggcgcgcaatattgtgagtgatctagagggcattccgactaaagaaaagagcttgaaggatcttactaaagagttccgtaaggattctaaaaacttaaataagcgtataaaaagacgtttcaaggaggggttaggacaagaagcgcctgtggttcgtcctactatcccccaagatattcgtggagctgaggtttttgcagagttacatcgcgagttagagcaccttcaaaagcaaaaagaagagattagtattcggggagatgctctggttcaagagcgcatgggtctgtgcttagaaaagtctaagtacgacaatgaaaaggctcatgctgccgctatgactaagaaggttggaaaattacaaaacatagataggcttcaaaaaaataatgaaacgtatgtaaggattcagaatttttttagaactttgattcaagagaaattagggcgtgacacagtccaagagatagacgtagtcaaagaggctaaggaattacacgaattagcagcaatcatttacggcaataccagtgggaaatctcagaagcaaagagcaaaaaagcagtttaaagagaatgttttacacatagcagggaagggtcaattagaacttttagaggcttacttgaatgtgacagcttctcaagggctctgtcgccatcaaatgcaggcttcatttagagaaagaatcttgctaaatcccgatggagcaaaacatggagaagccgagaggacgcttgcttctagggaagaaatgttgaaaactctagggctttcttatttgacgccttttgtaagattttcttctccagaaagtacgcagtctggatataaccaaattctgaaagtccgtgagcagctcttcgatattgagcagaggcttcagaatcaggagactgtgagtcccgaggactatgcggctgtacaagctgctttagcagcttatgtccgcaagcatgaatctcttatagtttctacttatggattgggtgctcaagaaggacaaacgagttctaaagtgaccactttaatgcgagatttgcatgctgtagaagagcttgttgagatgggtgtcgaaacgtatcgattgaatcgcagcgatcagattctgcatcgcgtgcattctgttttacacagccatctgcgagatagcgattcttcaggaaatggaattattgatgtagttaagaaattgtttgagcttctgaacaataatgggaacaatcctaatgatcccgaatgccaaaagtatatgcagatacttttagatgcaccagtcagtctattgtatggtgcatttaaaagtttcaaaaacgaatttttacttaatttcacggaattgaatattgctaattcaacaaaagctgctgaggaagaagctaaaaggtatgttgaagagaaaggtagaggttttgagacttattgggaggaggctaagcaacgattggaagcaattgctgctgagttggacgacttaaggaatcaagagactctattggaacaagaaattcgtttggcgaatttaaagataagtatctttagtgatttaaatttaagagagaaggtttcagtagaaaaagcagctttagaagaagaaatccaaggaatacaagagcaatatgcagagatgcaggggattgaagatctagagttaaaacaaaaattcgaagatttgcaaaagaaacttgaagctctagaagaaagattgttgcaaataggtcgaaggatagattcctctgtagacaagcagaaagaactgttgggtctcttgggtagagaagaggctgcttagagaaatcattgcgtttgcagatctcattgatggtcagagattctttttctcatcaactgcaatgaaaaccatagaggactaggaaaggctctctatggttttttttcacaatttccactaaatgcccacaaacgataggtagaccttccaataggatagcgtcctaaaaaggagttagctggtcttttcgctggcaaaaattctaagtagatatgagatcagctcgtgcagcttaaaggtatgtgttctatatccgatataacgatcggggcggataataaatagcgaatttggatttgcgtgatagaggttaaggattcgaggttccttaacattgcaaatctctatccattcgccatattcttcttgtagagcttcctttaagtcggggatatctttaaaaaagataagaaggtgcttactactttttaaaggatctaagaggaaagaaccgttttctaggcgagcatctatagctctcattcctggaccaggaccatggatttccttatcttgaggagacattttgataatatcgctagaacggtatttcagtgcttggtgaggggggtagtaatactcttctcctgtagtattaaactttcgacatccctttaaaaagtagtacatcaaagcaggtgtatagaagcgagaaaatgggagtttcttcgcgcgcttttccgtagtaggactaatataaggtaggatattgccatcttcctgttcttttgtaatcaccaaatgttttaatgcagcttttttcaatacaggaagtagcttccaagcgagattaaaggctgcgtgaatattggtattaataccgttgagataagaaagaagcagagtattagagaggctacctaaaaataatacatttccatgttcaggagggaatgcgtggtgacttgtttttatatggaaattttcatcagagatgacgagattgtaagtataaagtagcttctgtttaagtttcggtgatatggaatgcgttccttggggtagacagagctgtttcgttttttcctggggattatagaaaacgaaatttaagaagttctttgtgatgggaagaagatggatatgatcttcttcaaagggctcgccctcatcgcaattgataaaaataacttctcgatttattctacgtgctctcagctggcttttgacaagatccctgatgtctaggttgttgtcagcctcacaggctataatccactttggattgtagatctcacgattttcaaaattttgtgatactttagtactttcaataaagatactgttatcaactagagttacggggcgtgtcgaccaatctatgacgcctccgcgttttagaaactcgtcaattaggtgctgttctaaactttgatatgttgttgatagagaaaaaggaactggagagtccgttgcttggctgaacttaaataataaggttctctttttccaatggtaacgcgcaccaaagatcttatggttggcttggataaaatcgcctagcatttcactattgtgaagaagctccaaggaagagcaagacaagattacagggagcttacgacaatctaagaagctaggatcctcaggagaagctctgtggtcgataacttttacagagatcccatgttgtattagcatatttgccaaaatgagacctgtaggattagcacctatgactaaaatgtctgccatacttgccctcggatagtgaaaaagattttcataacattataggataaaatcctaggaggaatcaagaaacgaattccaagagctatgaatataggtgcttccatctagaagttgtatttaaaattgtagtgttctagaaccgttgtaccttgaattaaggtacaactgaaatttaaagtgttcgttggaagtggctcacaatttgatctaagatcatatctaaatcaggagctgtggctaagttgtgtcctgtgttagggtaagagatgaaagtcattcttccgggagctgtgtttttaaatagtgtctgttgtgtcctagaaacaagagtgtcatcaatgccttgttgatgcaaaatatagggttttgtgggtagggaatttgctgtaacgtgatcttggatgcgtatgaggagatcaacatcgccagagcaaacaattataggaggaggaccaaatccaaagtccttcccaacagagataatatctccttcgccgtgtttagagaaattctcatagagctcttttaataagatgcccccatctgcaattggagcccatacactcagggctttgatatttaagtctcttgggttatagattttagccaactcgaaagctatgtggcatcctaaagaaaaacctgaaattcctaaacgatatgcattgagatctgggtgttcttggacagtttcaagtatggtttgtgcatcacgtaaataggtctctataggaacttcttcagcaactccttcactatctccacatccggccatgtcgacacgtaaagtggcaattccagctgcagcgaattttcttcctaattttcgataggctccagttaaacctccgaattttgttcctcggaagccgtgaaacaacacgactgtagggaaccctccttccggtgtgggagtgttaggaagatgtaaaacaccaataagattgtgatcgtcacatttgatagtaactgctaaacatacttcttgcttcggacatacttctgtcttgatttgaacganatcttctggaatttgaggaaatcccggaacacggactggagctgccgaagcccctatagctactgaaaataggcaagaaactaaaaaagcaactttacgcatcttgattaactaattaaaaaaggaacacatatagagtaggggggcgctcctgtttttgtcaatgtcatggaagtttttgaaggaaaaacggacaagactcttgttttttcctctggggagacgtacactaagcctttttaatttttatatatataaaagtttagaatatgcgatatgaccccaacttaatagaaaaaaaatggcaacaattttggaaagaacatcgaagctttcaagcaaatgaagacgaggataaagtaaaatattatgttttagacatgttcccttatccttcaggagcaggtctacatgtaggccaccttattggctatacagcgacagatattgttgcgagatataaaagagcacggggattctcagttcttcatcctatgggctgggatagctttggtttgcccgcagaacaatatgcgattcggacaggaacccatcctaaagtcacgacccagaagaatatcgctaattttaaaaaacagctctccgctatgggattttcgtatgatgaaggacgagaatttgctacgagtgatcccgactattatcattggactcagaaacttttcctttttctttatgatcaaggactcgcctatatggccgacatggcagtgaactactgtccagaacttggtaccgtattatcgaatgaagaagttgaaaatggattctcaatagaagggggatatcctgtagagcggaaaatgcttcgtcagtggattctcaaaatcacagcatatgccgataagttattagaaggtctcgatgccctagattggcccgaaaatgtaaagcagttacagaaaaattggatagggaaatctgaaggggctctcgtaacanttcatttgacgcaagagggcagtctagaagccttcactacccgcctagacactttattaggggtgagtttcttagtgattgctcctgagcacccagatttagattctatagtgagtgaagagcaaagagacgaagtcacagcctatgtacaagagagtctcaggaaaagtgaacgagatcgcattagctctgttaagacaaaaacaggggtctttacaggaaactatgccaagcaccccattacagggaaccttttacctgtttggatttcagattatgtcgtcttaggctatggcacaggcgtagttatgggagtcccagcgcatgacgagagagatcgagagtttgctgaaatgttttctcttccgattcatgaggtgattgatgataacggggtttgtattcatagcaattacaacgacttttgtcttaatggcttgtctgggcaagaagctaaagattatgtaatcaactacctggagatgcgttctctcggaagagctaagactatgtacaggctgcgagactggctcttctctagacagagatattggggagagcctatccccatcattcattttgaagatggaacgcaccgtcctttagaagatgatgagctgcctcttctccctccgaatattgatgactatcgtcccgaaggattcggtcagggtcctttagcgaaggctcaagattgggtgcatatctacgacgagaagacaggtagaccaggatgtagagagacttatactatgccacagtgggcaggctcttgctggtattatcttcgtttctgtgatgcacacaactactcagttgccttggagtaaagaaaaagaaagctattggatgcctgtagatctttacattggaggtgcagaacacgctgttcttcatcttctttactcgagattttggcatcgagtcttctatgacgcgggtcttgtctcaacaccagaaccttttaagaaactgatcaaccagggacttgtgttagcctcttcataccgaattcctggtaagggatacgtaagcatagaagacgttagggaagaaaatggaacgtggatctcaacttgtggagagattgtggaagttagacaagagaaaatgtctaaatcgaaactcaatggtgtggatcctcaggttttgattgaagagtatggtgcagatgccttacgtatgtacgctatgttttcgggacccttggataaaaataaaacctggtccaatgaaggtgtttggggggtgccgtcgtttcctaaatcgtttttatgatttggtncttcgtcagaggttcaagatatagaagaccgtgacgggctggttctcgctcacaaattggtgtttaggattacagaacatattgaaaaaatgtctttgaataccataccgtcttcatttatggaatttctgaacgatttttcaaagcttccagtctattctaaacgtgccttgtctatggctgttcgtgtattggagcctatanctccgcatatcagcgaagagttatgggttatattgggaaacccaccagggattgatcaagcagcatggcctcaaatagacgagagttacctagttgctcaaactgtgacttttgttgttcaggttaatgggaagttacgaggacgtctcgaggtagccaaagaagctcctaaagaagaagttttatctttgtctcgaagtgtagttgcaaagtatctagagaacgctcaaatacgaaaagaaatttatgttcctaataaactagtgaattttgtcctatgatgctacgaggtgtccatcgtatttttaagtgtttctacgatgttgttttagtttgtgcatttgtaattgccttacctaagcttctttataagatgttagtttatggtaagtataagaaatctctagcagttcgttttggtctgaaaaagccgcatgtccctggagaagggcctttggtgtggtttcatggagcatctgtaggggaagttcgtttgcttctacctgtacttgaaaaattttgtgaagaatttccaggttggcgttgtctagtgacttcatgtacagaacttggagtgcaggtggcaagccaagtgtttattcctatgggagccactgtttcaatactgcctttggattttagcataattatcaaatcggtagtcgctaaactgcgtccctcccttgcagtcttttctgaaggggactgctggctaaattttattgaggaagcaaaacgtataggagcaactactctcgtcattaatggtagaatttccatagattcttcaaagcgttttaaatttttaaagcgcctaggtaaaaactatttctctccagtagatggatttttattacaggacgaagtccaaaaacagcgttttctttctttagggatacctgaacataaattgcaggttacagggaatattaagacctatgtagcagcacagacagcactgcacttagaaagggaaacttggagagatcgtttgagattgccaacggactcgaaattagtaatcctaggttctatgcatagaagtgatgcaggaaaatggcttcctgtagtgcagaaattaataaaagagggggtctcagttttatgggtgccaagacacgttgaaaagaccaaggatgttgaagaatctttgcatcggttgcacattccttatgggttgtggagccgcggcgccaatttttcttatgtaccagttgtcgttgttgatgaaattggcttattgaaacaactttatgttgctggtgatttagcatttgttggaggtactttcgatcctaagatcggaggacataatttattagaacctctccaatgtgaagtccctttaatttttggtccacatattacatcgcaatcagagcttgcgcaacgcctgttgctttctggtgcaggactttgtttagacgaaatagagcctataatcgatacagtttctttcttactaaataatcaagaagtgcgtgaggcttatgtacagaagggaaaagtgttcgtaaaagcagaaacagcttcctttgaccgtacatggagagcattaaaaagttatattcccttgtacaaaaatagttaagtttgataaattcatcggcatatcgcgggatagagtagtggtcatctcgttgggctcataacccaaaggtcggaggttcgaatccttctcccgctaattnccattttgcatggcggtatagctcaggtggttagagcagcagaancataatctgcgtgtcgttggttcaaatccgactaccgctatccatgctagaagacattcattttttaataaaatttaaaaaaatcttcttagccaaaatttcctacctatattttttacataacactttgtttttcaatttggatttatgttttctcgaagaaaataaagatcttcataaccaagtaaatcagacttaaagtacgtcctgatgcctttttcttgattagagaatccgttagaactcgaattgtgtgttttcataaacaattcatgccgcatttcttcaataggaattagagaaatttttnatttttctaagaaaggcactccaaaactcaaggagttttaactaactaaaaaggataaggaaaataaaatatagcagataatactgtatttttgaatagctcttgcttactcatctctaataaacaagtgattctttaacacacctttattggagccttcaaaaaaaagagtaaagccagtggtattggactcacgaagatcacaataaaagaaccctgcaccgagctccttaagcctttctagtagaataaagccacatccgtcaggatgatcagattgtggagttgcagctctataaaaatagaaacagtaccatatagtaaagagattgcctattgtagatggtattccaacaccaccctgagctattggatacttattagggaaaaatgccgtcctaccaagaaaagcgcttcgtccaggttcctcactaagaacaacaatattgtgcatcatatgtctagccagaagctttttgctttccaagctaaaatatttgttgccttcttctttcagaagaatatcttttatcagtttttcttcttcaggatgacctgtaaagtcaaaaggtcgatttttcaagaggagttctgtaggccaatctaacgttaaaagtaattttataaaacttgccttaaggagtttcaactttcataagttgatatttcttaggaagagaatagaagagcggagaaacagttagagccgcttctttcactagcgcaggaatttttggcaatgatcagttcttcggctttagtaatttctgtggggataaaaaatactgctcgatccaaatctttattaaacttgttatataagaggtagcgtatcgctagagctatcaagactagaggaaacaggataaaggaaaggatttttaaaattttttctgctgtagaaacaacagccttctcttttttagccaagataagtccggagggtcgaagagaaataatgcgcgtcacagtctctcctcctaaacaaaaataggagttcagctgagccatcaacgaagcttgccaattaggggaagctccaggagaaaattggtatatgttcataagggcttctttataagtgacaaagctaaattataatcatttttgtattaagattaaaaacagaaatctcaagggaaaacagtacaatttagattagatttatccgcctgagcaccatccgaactctaaactttttaggaagtctagaatagagagccatgccctttttaattgtctttgataaatccatgatccttcaacacagatccatagttttcttcccaaactataaggaatcctataggtccatatggacctccattacgcccgtcattttgagcgcctgcttgtggtctatattttaatccaaggtttaagagcctattatggacttcgcagcctgcttgtttaaaatccttttctagtttggggccgttagaatggtagtaataaaaataaatgaaggcccatacagtgggttttttagtttcatgactgaactcgattaagaaagattctctacctccatcaatagtggatgtaggaaagttcaatccggtttcgagcttaaagagttgttctaagagataacgtgccaagattttcttgctttctaaacaaaactcctcgccaggattattcttttcaagtttagcaactgtatcaattatagccttgctttcaggataataggcaaaatcaaaatcctcactcaaatagagtttaggccatggtatagaatctgtatctaagtcctctaagagcaaatctatatttatagagagggtaattttaggaggctaccctttagaagtttggatgtacatactttggtattttgtaggtagggcaaagaaacctgggtggacctctcgagctgctttttcaactaattgaggatttgctgcaagaattagctccagttctttaggcgtgtcttgagggataacgaagcattttctatcgaattttctatgtaagaagtagcggatagccagagcgattaaaatgatcgggaagaagatcagagcaaggatctttataactttttctgctgttgagacctgtactttttcttcagtagctaaagaaaacccagagggagtcatggagaaaatccgagttgcagtttctcctccaaaacaacactaagagtcgagtttactcataagcccagcttgccagttcgggcagatgcctggagaaaaagagtatatgttgctcataaacaatcccttttaaagaattagccatcttattttataaattttctgattctataagtcttagttgagaattttaatttttaatatagatgtttttttaaagcttaagaaatcttaacacaaaagagccgttcctttgcatctagcttagaatattcttataggaatggacaggttgtcagagtagaggcgaatgcgtttgattttcccaaagcagggtcaaaggtcgttgatctataagctcctctttcccgaagtactgtaaagggcctggaaaacggtataaatcttcaaccaaacaagaatcactttgttgaagtaaatgttgaacagcaggggattttgggtctacagaatctgttttaataacaggagtctctgtcccacaacgattttctaagtgcatcatcttatataatggagtggctcccccttgccattcagtataagattgagcaagattattgattgtaatcatataaccagtcttttgtcggaccagaaataacgcagaaatgatccctaaagcgattccataattacaatcaaagttggaagggaatcctgctcgtgcttcataaccaaaaaaatgcgatacagaatggaattccatatggggttttatcttttcgatttccttctttaccattactgcaagcagctcttctgtagcaatttttganactctaacatttccatgagaatctcgagctagaagaagttggttcgcaatatccttaggaaacaagtgaaatgtttttatgtctctggagagagcttggaaagaatttttcatagaagaatctccattggcgagtaaaacattgagttcatctataagcttgcgtgtatcgaaaatatgctcaatcagtccctctgggattaacacagtactatagttttttccagatttatagcggcgtaccaaacctaaagcaagctgttcactcagttgctttaaagagattttcctagtggcaataagttcgctaattaaagctatattagggagggtctgcaatccgcattctaaagtagtataagaggcctgctgccccataaggcggatgaaatggtggtatttttttgcagaaagagcatctttagcaagattcccaatcatttctgagtacgtgcgacaagaagtatgaaaacctaacgaggtttcaatccaacagttcttaagatcaccatctatagttttagggactccaatcacggatgttttgcagttgtgagcaaggaaatattctgcaagcatcgcagtgtccgtattggaattatttcctcctataatgagtagtccgtctaactttagttgcttgactgtgttgaggatgttttttttctgctcttcagttttaattttttctcggcttgaggagagcatgtcgaaccctcccatgttgtaataatcatagattacggagatatccagatctttatagagcccacgagtaagccctaaaggtcctttgatgaatccaaataagcgagtcttgggattgaatactcgtaaagcatcaaaaagaccaataacgacattatgccccccaggagcttgtcctcctgatagtaaaaccccaatctttaatggttttgatgacgtttcctgttcagtataaatagaaacttcagggatccgacatagattgggaatgtgtttttgcaactctggagggggtgaagggggagacgaagtttcttggatatgtttcgaacgtatcgtttctaataaagtaagaatctcagggcggtagcgaaggcgttggatttcaaaataacttttatttaacgagagaagttccacagtttattccccagaagttaattctctttttaaccattgcgtgagatccgaaagagccgaagattcggcaaaaggaaacgcgtgatcgacatcgggataagtaagaatagtaattggtttgtcttgatttgcaaatgcttcggtaaacagtgttctgtggttgatagaaaccagaagatcttgttcaccttgcatataaagaattggagggagattgcgagcactaggcataagctctttcacaatatctatttttaagaattgcgtataaaaatcaggatttaaagtcatcccagcataagtaatggcgcctttttgactcattgtgatcacttcaggagcatttttttgtgcttccgcagccattaattctcctgaaattgtaggcgcccatacagctaaggctttgattttattaaaaaaaggaagagtctgaagagcaagagttcctccgagtgatgaaccaaaaatagcgagcctttcttggtctatatgaagtagggaatgcgtatattcaatgatttcacgaatgttttgcttataattttcaagagaaaaatccataagctcaccctcacagtctccatgaccaaggagatctactcttagagctgcgatacctaaccgagtgagttcctgagctagcctgacatgagagcgtttcgaaccggttttatctgaagctaaaccatggagaaggatcactataggatagggaggattataatggagaggagtatgtagaaggccaaaagttgtaaaattattcagtagggtcagtgaaaacatggtgcgctgctcatgcttttccaataccacgcctgtaatcaaaagaggctcctgctttctggatgtgcttgacctatgtcaatgtagtttctaaagaaaaattagtcgagaaaattcgttgcatggaatgcctctaactaaagttctcaaaaacagccatcaaaaatcgtgtaaaatagtatcagaacaatccctggatgaatagtttacaggaatgatttaaacctccttattgggttgataggaatcttcccaatagatacgaatcccttgaaaaccttgaaaattaggattgtctggtccttgagaggggcaaattggaaacctaactcctaactcttgtaattgctctaagatctcaaatcctcctcctcgatcttcatctagaggaccttgtctgaaaaagacttgcggccatattgtaggattttgtggagtaaaatgagaatagatataacgaacactagggaatagagtcagtcttccagatgtattgttaggaagggcttcagggttttcttgtgtgatcccatcaataaataggtgctgtaacatgaattttaaaagctacgctttcctacagaatttatgtaagttcctgtccgcagattttgtacattctgtataacacgtttatctgccttgctgcaaaaatccatagtagagttaagatactccgtaggccaggaaaccgaatctaaattaatgtcatcagcaagttgttcaagatctaaagaaaagcgaatgccgtgacttgaaattataatctgacggtattttgcaggtacacagaaaaaagagggttttgtagttcgaagagccgcttcaacttntagaggatttgatcccatagcttgtagatttttttgggatactggaaccaatgttgttaatttataatgagacgccgtgtntcctgaacgaccaggaataggcacatactgaggagctctttctaaaatnttagatacaagtaagtgattagcatatttagcatgtagaaaatagtgtagggctaaagcgattaaaatcagagggaagattaagaaggataaaatctttaatattttcactattgtggagatccgaacgttttctacttttccaataattaagttaggttcttgcataactatagatacaaccttgattctattcccgcctaagaaaagataagaatctacctttgacataagctgaaatatccaaggtgtatctacatctgaagagatgctataaagtttcataattcgaaaaggcgattgtatattgtataaagtgtaaacaaattataaaatgtatatcgatcattcatacccctacaccagcgacacctctttgcacggagggggaaatttttccaggtcttgtagattctgcaattcagaatgatctcgagagattactcacagtaaagaaaagacctgatatcatccgggagtatttgcgagcaggaggtagtcttgttacaacataccctaaggaaggtcagagattgcgctccccagaacagttaagagttctggatgatttagtgcaaagctatccaaatcacctacatgcgattgaacttgattgtggtgcaatccctcaagatttgatcggagccacctatatcatcacgttcgccgatttttccacctatattctctctttaagaagctaccaagccaattctccctccgatgatacatgggggatttggtttggatctattgacgatcctgttcaagcagtcatatcatttttaaaagatcatggatttgctcttccctcgaccttagctcaagatcctttgctttgtactaacaagtaatttattaagtgaaataaataatataaattaaaaatttatcgcttaattgtgttttaaatgtatttatattaaaataattttttcttttttaaaacagcttatgactagaagtactattgaaagcagtgattcgctatgctcaaggtctttttctcaaaaattaagtgtccagacattaaaaaatctctgtgaaagtagattaatgaagatcacttctcttgtgattgctttcctaactctaattgtggggggtgctcttatagctttagcaggagggggggttctttctttccctcttgggctaatcttaggaagcgtactcgttttgttttcttctatctatttagtctcttgttgtaaattttttactttaaaagagatgacaatgacctgtagtgtcaaatctaaaatcaatatatggtttgaaaagcaacgaaacaaagacatcgaaaaggcattagagaatccagatctctnnggagaaaataagagaaatgttggaaatcgttcggcaagaaatcaactagaaatgatcttacacgagactgacggaattattttgaaaagatatatgaaaggagctaaaatgtacttttatttatgaattgggttccaaaaacaatagaccatgtagatccagaatcagagatagatatacgtaaagtcgtctcctgctataagttgataaaagaatgtcaacctgaatttcgatctcttataagtgaattactaggagtgattcggtgtggcttaagactattaaaacgttctaagtatcaagaacaggctagaactgtatctgatgaagatgcacctcttttctgcctgactcgttcttattatcaagatggttatctcacgccattaagagcaggacctcgtgatcttataaatcactatatacacttgcgtcgccgagagaatcctaagcattttttcagtcctaagcatccatgttattatgctcgattggcttttaatgagtcagtgtgtgtctatagagaactctttgatatagagcgacttacaaaaatgtatgtcgagggtgattattctaaagaacaagagaaaaacctacaggctattcttagttttgtgaaaactctagatgaaggaaaggactttcttattgaacataaagataccgatctcattgggagaggttttactgatgtgttctgcacttaaatcaatgaaattgtctcaaacaatataataaaagcgattctattatgtctgaaagtattaacagaagcattcatttagaagcctctacaccattttttataaaattaacgaatctctgtgaaagtagattagttaagatcacttctcttgttatttctctattagctttagtgggtgcgggagtcactcttgtggttttatttgtagctgggatccttcctttacttcctgtactcatcttagaaattattttaataaccgtccttgtcttgcttttttgtttggtattggaaccttatttaatagaaaaacctagtaaaataaaggaactacctaaagtagacgagctatctgtagtagaaacggacagtactctttaaaattatatttaatgtatagggctaatcggagtacgcatttgaatatcagagcaattactaaaggaattatgagcaggtaagataggatcttcagtgtacagtgtacagttcatagagcctggcttgaatttcctatctttagcactcaattcttccacagtgattccttgatcctgtttgcttaggaagactatttgagactgtcccagatcaaaataagaatctacggttgcagctaaacgttctaagccgtaattctcgctatttaaaaaaggtttagcaagaaggatggtagggcaaaaagggagcataaaaaatcctcttgggaaatgcgaccacaaattttacatcatctgttctattaatgctatttctattttacgaattcatgcaacataataacaattatcagactttatatggagatcctagtagactatcgtaaggcttaagaacaaaatatatcggcgccacctctcccaataaaagtggtgtctttatgtgtagcaagaaagtcgtcaaagccgtccttctcatctaaaatttgcacaaaactaagaatcgactttaggttgtcttcgttttgctgctcataatcacccgcgccatacatttgtttaagttccgctgtgttaaagagttttcgatagatacgcactgactcattaaaggccaatcgagcatagtaacatggatgcccaggattaaaaaaatgctcaggattctcacgccgacgtaagtttatatagctctatttataatataacgcggtcctgctcgtagtggtgtaagatagccatctcgataataagaatgagtcgggcagaaaagaggtgcatctttatgggatacagttttagctcgctcttgatacctagaacaacggcttaataaccctaagccactctgcatcgctcttagtaattcacttataagagatcgaaattcaggtttacatgctttaattaacttataacaggagatgactgtacgtatagagtcttctgatactggatctacatcgtccattgtttttggaacccagttcataaataaaagtacatctagattcctctcatagatctttttcaaaacatttccatcacaatcgcgtaaagtctcttttacttgacttcttgcagagcgattattgtcttccgccctattttctccaaagagctcaggattttccgtagccttttcaagatctttatttcgttgcttttgaaaccattggtggatttgagagtcggtattgtagacaacccctagctcttttatagggcagaatttatatgaaaaaagtaagaataaagcacaaagcacaacgagcacaattcccaagactaaccaaggaagaaaagaaagaatgcctgctccagctaaagccgtgagagtaattcccccaactaaagctaacaaagcgataacaaaagaagttatcttcactaatctactttcacacagatttcttaatggctgggtatttaattccataactaatggttgtgaacactctgaaccaacatttttcatgttattttctccgatagtgaattctatatgaaaagattaacactgtactttcaaataatttttaaaagattaagtttaatatttatacaaatataaactaattatttcgtttcgtgaatcttgtaaaataactaagaaaaagtatcggtatgagtcacagatcaaaaagagatatttgtcatagcatgttttataagaaattcttttctgtgattttcttatctaagctagacaggtctttcctcttgtttccaacaaaaagtcgagttattttatatttaagctacgttaaaaggcaatcttaaatcatcatatcaaaaatttaatgagacaccctccccttcgagctctcttttcttcccatcgactctcttgaaagcttcttctctggagacgcttttttttaacattactgctttagaatagaaataaagtaagaagaaaagctataagtcttaggaacttataaaaaataaaaaggaaatttagtgggtcgtatctatagtttttctcctggaacttatcctaactggcaagtaactcttatgggtaaactagatggctgttttcgtttaagagacgagaaagtcactcgggttatctcgatcaatccctctggatttaccttagctgacgaaaaaatagtccgggtctctatgccttctccagcatgagctgcacaaccaaaccctgagtcataagcatttctatatccagaagctaatcgcttaggacaggctccgggcgcagattctgatcctgcggattgtatccctacaaatagaccaggaaatgtagaatcaacctcttggagccattgaacagcttcttgggcaggttcttgtgtgtttatttgtggagcaaatgttttattgaagcagtttaaaaatcgtaaagtaatcccgtgttttgaaaacgtttgcgaagcacgatacaagatttgataaaacttcatacgcgcgtgcttttcaggtaatgaaggatacaaaacatgggcaaggcggatattttgttgtacttcagtatacacgatagtatcgtccagacattgctggagatagttattgaaaatgagaagaaggtcttcttcattttggattcctccaggaggaaagcgatgtccttgtactgtagccatcactctatcaaagctattaaaatcgtaatttaagatattatattgtaatacacttaaatccggatccttttcgtgacagatatcttgaaagtttcggaaaatattggagtattgtttatgaggattcttaggagaaagtaatcgatgattggtccaagaattataagaccattttaagaacccatttttcacacctaaaatccaagctaattgaggtgttatggtcccaggaaggtgtacatggatatctgctttggggaggtttttgatgatagcttcggtgcaagcgattgtattgagtcgtggtactaatgcaaagatctcattgcatatcttatgtacagaatcttccttttcaagattcttgaataacgtatcataagacatagaaagaacgaacgctataactgtgcaagtgttatacttttctcctctaatgatatgatttttacgaacattctaatgatgttactaaataacgagtctttgatttacccctatggtggctattcccattctatagttgctggtggcttgtcagaaatatcatagaccactcggcttacctcgggtatttcattaataattcgcgatgagcaagaactgagaacatcgcatggaaggtaggcccatcgtcctgtcatgaaatctgtagattctacagcacgtaatgctatggtataaccatagcttctacaatctccttttacagatactgattttataggaagaaatagagcaaaggcttggcttattttatcgtagagttttgctttcctaagctcttctataaagatgaggtccgcccgtcgtaaaatggctagatattcaggaaggatctctccaatcacacgaattgtcaagccaggtccaggaaaaggatgcctgtccaagagatagctagaaagtcctagggcttctcctaaaattcgaacttcatctttaaataaataacgtaagggctcgactaacttcagcttaagattttttggaagcccccctacattatgatgtgattttattacttcggaggcatgtccagagcgtgaggactcaataacatctgagtagatggttccttgagctaaccattgtacgtctaatgactgagcgacttcatcaaatacttcaataacggtatcttgaattttacttacaaggtcttgctgaatatacaagggattccatagtgtgggagcagaacagatctcttgaacaaaagtttctagaatcttatttcccgttggagtggagtcagaaacctcgggatgaaattgcagcccgtacaaccgttgtttggtattttctattcctgagatcgagcattgtgaggtggatgcgattacattaaatccttcaggaattgtcgtaacatgatcccgatggctcatccgaatctctgtgtctagagattcgcagtcgacgatgtgtttgaagagctcacaaggatacagatggatgggcgtatatccaaattctcctacaccagggcttacagtccctccaaaatctctagccataagctgcatgccatagcaaatagctagaattggaatgccaagtttatagatttcaggatctaaatgtggagccttgttttcatagacagagtgaggacctcctgagagaatgatccccaaaggcgctctttcttttaaacattgcacagagatattccagggaagaacttcgcaatatacaaataacttccgcacttgctttgctaatacataagtatattgagatccaaaatctagaataaatatggtgttcaaatgtctccttgcactctgcaacttaataatttaaggttggttgaactttgtaaatattatgaatatgactttcagctcttccagattcagtaattcgaacaaaggaagccttagtttttaaatctttgagagtttcagctccaacataccccatacctgagcgtattcctcctaaaatttgatagaggacatcgtggacagagcctttataagcgactagtccttcaactcccccaggaaccagctttttctgtccctgtgtttgaaaataccggtcagcacttccttgtttcatagcgcctaaagatcccatgccgcggtaccttttaaaaagcttctcatcgatagaaacgatatccccaggagcttcatcagtccctgcaagcaaacttcctagcatgacacagtctgctcctgctgctaatgcttttaccacatctccagaatagcggattctcccatcagcaattacagtcacggcagagtttttaagagcttttgctacgtttgtaatggcagtaatttgtggataaccgacccctgaaacgattctagttgtacagatagatcctgggccaatacctacctttacagcgtcaactccaatctcagctaaggaaactgcggcttcagctgtaacaagattccctacaactaaagaaatttgtgggaactgggattttatttctaaaactgtttggaatactcctttagagtgtgcatgagctgtgtcaatgactagaacatttgctccagcttccacaagatgatgcgctcttgaaattcctaaaggaccaatgcctatagcggctcctatgggagcttaaggataggcttctttaatttttctcacagatgagctttgttctacttcgctcatatttttatgtaagattcccaaaccaccttcttgagctaaagctagtgccatggctgtttctgtgacagaatccatagcagctgaaagaatcggtatatttagagagagggtttttgaaatggccgttttcaaggacacttcagaaggaagtatttcagaatattgggggattaaaagaacatcatcaaaagttaaggcttcttccatgtatgctacaataggacactttaaaggatagtcaatgatcccctgctatactgtcaatgcttttttcatgattcgtgacattccttcgaatcttaagaagaaatttctttggaacagaagtttcttcttccgtgtttaggcttcttattgaacttatagcttagaaaagattgaaggaaggaaagataagactatattgattctcttgtcttaagatatacgacgacagcactccctattcctacactcgataataagtagaaccaatactataagagataagatcccaaatacaagtgaagctgtttctccagaagttccataaacagaaaaacaaatgatgatgctaagtagggataaaaagataaagagacatcgggaacagtaatgacaacaattcgataccaaagtttttgcatctatatcctcgattggggaggggctcgttgattcaacgaatctatccggaaatacgctaaagtccataaaaccttgttgatgtttgtaagaatctattttgtagatgagatcgaaaatcgtctaacgatctgattcttctcaatactttatttgcctggaatcataaaaccctcaacctcttcgatgtcgttgtgtggcgcaatctattgcaaatcacgaaaatacttgattgagggcttcggagaaatttgaaggggtgatgcacaataggtgccagttcttgcgttttttaaaaaatttttatatggtttgtggagaaaattgttatactatcaatgattatgactactatatctaactcaccctcccctgcattgaatcccgaactttcccttattcctccaccaacacttgtatcttcaggtacgcaaacatctctagcttatacgatccccgcacaaggacgaagatccaccctacgtattatattagatatattcattatcattcttggtttagctacgatcatttctacctttattgttattttctttttaaatgggctgaacttgctctcgaccccatctattatctcttcgtcatgtttaatcattgttggattgctttttttgattatggggttatatttcatgatctcgagtttggatcaggggcttgtaggccttctgcaaaaggaactctctcaagccgaagaaagagaagaagagtatatccaggaaatcgaagctttaagaggagctcctagagcagaatctcccacagagtctcctagtacctggttatgatttacaggtatgaagttcttattttctaaaatttgtcagcagtttttcttttataagaatactttttaattcttgtatttaaattccttacgacaaaagggtgaaaaacgtcttgtagaacattctagcttctattagcctgtttccaatttttattaaggagacgcgatatggagcaacccaattgtgtgattcaggatactacaactgttttgtatgccttaaatagctttgatcctagacttagtgatgacactcacagacttgggaagcaatcacctcttgaagcagaaaatgctcttggagaatttattgaaggtttggatacaaatagctttcctttagaggaagttgccattcccatcctgccaggttatcaccctaagttttatttatctttcatagatagggacgatcaaggtgtccactatgaagttttagatggcgtatttttaaagacagtcgctgcttgtattatagagaactccttcttaactgattctatgagcccggagcttctcagcgaagttaaggaagctctgaaacgatgatgatcctatggatgaatccgatggagaagaagcttcaaaagattctgcattttcagctagtttttcctatgagtttgtaaaatcaagtactcgagaatctaaaaatacagtcacacactcaacagcgtctcgtacattatatattttaaggcaggattgttcttatgatccaagagctctcaaagtagatgatgaatttcgttattgggtagaaaaaaggttggacgccaagaatccagattcattaaatgcgttcgttaaagaggtaggaactcattatgtcgcgtcagtgacttacggtggcattggttttcaagtgctaaagatgtcttatctccaagtcgaggagttagagaaagaaaaaatctcgatatctgtagctgcagcaagttctttattaaaaagtaaaacatcgaacgcgacagagaaaggttattcttcgtatcagtcggaatcatcagctcaaacagtatttcttggtggaacagtattacctgatctccagcaagacaagttggatttcaaagattggtctgaaagcattcctaatgagcccattcctctagctattagtgtatcttcaattacagatctcataattccagaacttttcccttctgaagatgctcaagtcttatcccagaagaaatcagctctaggacaagttattcttaattatctagagagtcacaagcctaaagaagaaggcccaaaaccagtccaaattacttctggattcaattcatcgtcttcggtatttacgcttcaagcagcaaaagctcctaagactgtgtctttcccctatatagattattggtctacaattccctatcttttccccactcttaaagaaacttcaggtgctcaacctctctcgttctacttgaggtttgatgacatctttgagcaacaaaatttagtccataatacttcatatattttagcttcaacctcggtgaggttaggatatttcggagattcatatagagattatgatgctctatctttctatggtagttggcctcaagcatattttgactgggcaggctataaagataggtgtacttggaccttagaaaaactcaatacaactggagatcttttcatccgttctggagacgagatacgtttaaaacacaatacctctgggaaatatcttgctacaacgagcatgtctgatggctatcagacattaacttgtacgacacagacgagtgattctgtctttataattactgtataaatagagttaagacatccccttaagttttaaggggatgtcttatttgctttctagagaactcatctctaagtaaacttcttttcttagggctgaggaggaactttcttatagctttcatgaacacagagtatagaagttccgtttgctaaaaacgtgcttctgaggtagtcctctgcaaaggaatctccaaaagcattcagagaatcagaggaagaaacgctttcccagactaaagaatagtacccttttacaggtaggacctcttttgagcaagcactctcatctgcaatccaggcataagcaatgacaaaaggattcccctgaggatacgagcacacttcaacgggatacaggctataaacaccttctcgccttctagctattacaaagtcttcttctgtcatctcaaggcctatagcattacagcgtcgtcccgaagatttaatgagattcagtacagctcgatttttcggaccatcgtgagaagttctacggcgacttccgttttttaagtactttcctgtgtctatattaaaagaacgctcgtatccatttatccaaataggatgtggacgatacgtttttaatgtaagagctgctgattttgggtgcatcagacttccataagtcgatatgggaatgtaagaacctttgattttgagatttttatggatttctctccaaattttacgagactcttcatcagtcttagctacgacataaggatcattgtgctcttcagaaaagatttgagtcgtacgaaatgcagaaggataatgaggcagttgcgaaacactcttatttccatgaacaaagaattcttcgctcgttgaagtgttgtgataattccaagagggcttttgattacaggaggaaagagatccaagacctaatcctaaacatacacttgaaaagataagagacatgggctgtttcatggattcctcggagattaagaaaatgaattttgatnngtttgctctcttttgtcctacttaaaggagcttttcaacaacgtttcggtctgaaattttgctaaacaagaccctgccgttaccctagcttgtcccagcttctctagcataatttgaaaattgtaaaggaaatatatgaaaaaaggaatacgaaacccaccctatctaaggnattcttaattctgaacgtatagtatccagaactaagaattctctatcttaggaagtctataatgaaagcaccccgagattcgggagagaacttttgttagtgcatgccttgaacagtttagtccaagtacacccacacttctctttctctgttttcataacctgtgataatgcctagcgcgagcagttgttttaaaatgctctcacctaaacaaagcttaccatgcccaggttcggtcttaccagctatatggaaaagctgacctgtagttgttttagcatctatagattctcctccaaatttctgagagaccgtacagtgacgttttgtttgaggatctctttcaacattccgttgcactagaaaatctaagtattctttcactcaaatctaacttctcctcataagaaaggttaggtttgccttcaaagatgcataggagccggagagatctaaaagcaataactcaacttagtgaaaattaaggaggacatgaactttctgtctttcttaagagatcttggcaacttagcgatcaatccctttaagaagtgatgaggtactacctttaaaatctttcgcactaacgcggcttgctggttgtgttgtgcttcaaggtcttgttcattaaagaaccctatagattcaaaaatacaggaatagttaggagtttttgcgtcatttacatttaagaggatcgctttttttcctggaatgattccagagcggcctgcttgcaaagtaaaattaaagaaattagcaacacatgcttttgatggacgcgagcttcttcctgatttgtggaatgatttacgaagtcttctgttaaactttggaactgaggttgcttcaattctagtttcgaaatgagtatcccagatcttaggtcaagcccaacaacccttggaacctcaatatttcgaattttacacgctgcaagtaggtttcttgcatgtgttctacgtaccatagcctctacaagaacattatctagaggattagataagccattcatctcattgttttttgaagatacaaatgtaaagcggagattcggataattatctacacaaaaagtaaatacggaataatgattagtatgataaacatctaataaacagattttcttagcctcgagaatctgattagcccgagcaggatggcaatccgcttgattaaaataggcatcacgtacttccctctgagcgtgcaatatctgagaaggatacgtttcagacgccacggtattctggataaagactggcttatacttacaatccagaatcttatgtaaagacgtctaacacaataaatctccctagaaatatcgtctctagctagaacatctgttgtatcccctccccaatagaaataagagtcgagggcttgcacagctttttctaaactgctaggtttttcatgatgagaatttaaagaataattattataaaatagcttcataaattttttaaaaaaataataaacgccgtctattttaaacaattcatgcacttattaagaagctattaattcaacaacagcttaataaatttaaaaatcatctttttataaagaaatatttatataaaaataattcttagaccattgtaaatttaattagaaaagcctccgagcttcaagagccctaaggaagattcttaaattatttagaattctttaaaaaaagaatttccttgagcaagtaggttatcgatatagttaatatcgtaattagattctagaaacttcggattatccaacataaactggtggaaaggtattgtagactgcacaccaccgatatgaaactctttcaaagctcgtttcatgatagctatagcttcttctcggtttttgcccttagcaattacctttgctatcatagaatcataataaggagggattgcatagccgctataacaagctccatctacacgaattgaaggacctgcaggaggaagataataatctaaacgacctggagatggtgagaaattattggtaggatcctcagcgttaatgcgacattggatgatatgacccgagaactcaatgttcttttgtttccaaggcagcttatttcccatggctacatgaatctgttcttttacaagatctatacctgtgacttcttcagtaatggtatgctctacctgaattcgggtattcatttccataaagtagaattttttgtctttatctaataagaattcgactgttccaacagaaaaatatccggcgcttcttgctagatctacagcaacttttcctactttgactcggatttccgcattgagaatgggactaggagtctcttcaatcaacttttgacgtcgccgttgaatggtgcagtctctttctcctaaatgcacataatttccatgggtatccccaatgacttggatttctaaatgccttggattttctataaacttttcaatataaacattggggttattaaaaccggcttcggcttctgcacgtgcggcagaaaacgctctatagaattcgtccttttctttaacaatacgaattcctcttcccccacctccagcaacggctttaataacaatagggaaacctattttttcagctatttttaaaccttcgctctcgtcttcaataatgccttcagaacctggaataacaggacatttgattttctttgccagggacttcgcagcaatcttatcccccatcatagcaatagactctgaactcggccctataaaggttaagccacagctctcgcatattgaagcaaagtttgcgttttcacttaaaaacccatatccaggatgcacagcatcagctcctgtgatctcacaggcagccaagatattggatatctttaaataagactttgctgcttgaggctctccaatacaaatagcctcgtcagcaagaagtacgtggagagcctcttgatctgctaaagaatatacagccactgtcgacaatcctaaatcatgacaggcacgtataattctaacagcaatttcccctctattagcgattaagacttttttcatgatgcatctttagctatacgaaacaacttagacccaaattggacaggatccccattggtaatcaatacttcaagaacacgcccactcattcctgctttcacttcattcattactttcatagcctcaacgatacaaacaatagtatcttccgaaacaatatcgccaggttttacaaaagaaggagaatctggggctggagaaccatagaaagttcccactaaaggagaacttataaagtctccggaacttgttgtagtagaagtttctgaattttctgtagtagtctctttaattgtatcttttttagggtccgttgggataggtcgttcttgagaaaatccactaaataacctgctgtcataaaacacaggctcttgtctattcccctccctagtatctctttccaactccaattcaagcccttcacgttttatagcaaaacgcttcataccattgcgtcccatagcaatcatgagcttttctatttgttttaagtccataccaagtcttctttaattgaaattagacgcgttgaatatactcacaagtccgcgtatctatttttataacatcaccaatttctacaaaaggtgggaccataacttcaattcctgtttccagcaaagctttcttaactcctccggaaagagagagagaatctccaggaaagtctgtttttgataccataagctctagaaaatgaggcagctctacagaaaaaaccacattgtcatagaccattgcagagacagtcacacctgcctttaaaaacaaaaagttatccttcatgatttcttgtggaatgaataacttttcataatttcctaaatctaaaaaaagataactttcatcttcaagatataaatattctaaagtgcgggtttcaaattgagcctcttttacctcttgagttgctttgaaatttctctcaataacaacatcagaatccgcagcctgcaaagcgactttaatgaaggattcgcctttgggccctgccaccttagacactgaggttactttataaagaccgtcctttgtagaaataaacatccctacggataattggctacttaacaccataattttctcctcgcagcaacaaaattttatcttccattgctaatgaatctgcttcgaataagtaagaagctgtgactaaaatatctgctcctgcatctcgacataacggcgcagattgctgatctatgcctccatctacttctattaaacaagaatcctttaaacctaaagtctttatcgcatgacgtgcaaaagcaatcttttctattgtatttggtaaaaagctctgtcctgtaaatcccggataaactgacattagcacaacgacatcacaaaacggaaggaaagaaggaagaaattcgattgaagtatcgggagaaaaagctagacccgcttgaaccccacatttttttatataagatagaagctcttttatatcctctgaagcttcaaagtgtactataattctatccgcaccagaacgaacgaaactttctataaattcaaaaggattgtaaatcatagcgtggacttctaaaaatagatccgtagatctattaatggcagcaatgatccctggaccaaaagtaaggttcggaacaaagtggccatccatgatatctatgtgtataaaatcacttcccgcctgctctagtttttttgcttctacacccaaacaggtaagatctgcccccataatcgaagggccaactaatacggattcctgtttcttcacctcagcctatctcaacttcactacgctaaatttaaagtagagtgagctttaactttctactatttatatttactggttgatgtattcatgaactcctactcattgtatgaatagaaaatgaatacggactactaccataatacagaacgaatatatttcaaagaaccattgaacatttcttattaaaaattcttttctttttatacaaaaatcccaagattaatctttctgtttcactaatgaaaatgcatttggagataaggattatgatatagcaaatatattgtgattctaacctcctataccttcatcaaacatcaaattagtgaaataaagatgattaaatatattttggatcctcagcaagaaaggtataaatttcttgatttttagatcgagaaaaacaacaattcttatccaagttaacctattaaggataaaattcttatgtcatctcctgtaaataacacaccctcagcaccaaacattccaataccagcgcccacgactccaggtattcctacaacaaaacctcgttctagtttcattgaaaaggttatcattgtagctaagtacatactatttgcaattgcagccacatcaggagcactcggaacaattctaggtctatctggagcgctaaccccaggaataggtattgcccttcttgttatcttctttgtttctatggtgcttttaggtttaatccttaaagattctataagtggaggagaagaacgcaggctcagagaagaggtctctcgatttacaagtgagaatcaacggttgacagtcataaccacaacacttgagactgaagtaaaggatttaaaagcagctaaagatcaacttacacttgaaatcgaagcatttagaaatgaaaacggtaatttaaaaacaactgctgaggacttagaagagcaggtttctaaacttagcgaacaattagaagcactagagcgaattaatcaacttatccaagcaaacgctggagatgctcaagaaatttcgtctgaactaaagaaattaataagcggttgggattccaaagttgttgaacagataaatacttctattcaagcattgaaagtgttattgggtcaagagtgggtgcaagaggctcaaacacacgttaaagcaatgcaagagcaaattcaagcattgcaagctgaaattctaggaatgcacaatcaatctacagcattgcaaaagtcagttgagaatctattagtacaagatcaagctctaacaagagtagtaggtgagttgttagagtctgagaacaagctaagccaagcttgttctgcgctacgtcaagaaatagaaaagttggcccaacatgaaacatctttgcaacaacgtattgatgcgatgctagcccaagagcaaaatttggcagagcaggtcacagcccttgaaaaaatgaaacaagaagctcagaaggctgagtccgagttcattgcttgtgtacgtgatcgaactttcggacgtcgtgaaacacctccaccaacaacacctgtagttgaaggtgatgaaagtcaagaagaagacgaaggaggtactcccccagtatcacaaccatcttcacccgtagatagagcaacaggagatggtcagtaatctgccgtaaagtcttcaaagacttccttagaaaataagcagtaaagttttaactttactgcttattnttttttgaaatgaactcactcattaaagatatttgcaacaaattttcctgcgtcttatgcttgttcttttaggattgagtttttctcacttacactagaaccctacctatgcattcaaaatttctttctcgaagaaaaaaaaatagttctcataaggaggaaacctcttgggattgtatagcctcaagttacaataagatagtccaagataaagggcactactatcatagagaaactatccttccccaactcctgccttcactcaccttaggttcaaaaagttctgtattggatattggctgcggtcaaggttttttagaaagggcccttcctaaggaatgtcgttatctaggcatagatatctcttctagattgattgctctagcaaagaaaatgcgatcggtaaactctcatcagtttaaggttgcagatcttagcaaacgcctagagttcgtagaaccgacattattctctcatgcagtagcaatcctctcccttcaaaatatggaattccccggagaggctatacgtaatacagctacgctcctcgaaccactcgggcaattttttatagttttaaaccatccttgttttcgtattcctagggcatcatcctggcactatgatgaaaataaaaaaagctatctctcgtcatatagatcgttatctctccccaatgaaaatcccaatcatggctcacccaggacaaaaagattcgccttctaccctctcctttcactttcctctaagctattggtttaaagaactgtcttctcatggattcttagtttcaggtcttgaggaatggacatcttcaaaaacctcaacaggaaaacgagctaaggcagaaaacctttgtcgaaaggaatttccattattccttatgatttcatgcattaagataaaataaatttttaattatttaattaggttttttattagaataaataaaaaacacnaaattcttgcattatgtttcgaaaacttttcccgttttctaaaaaaaaaacaggtcagaagcaacgtcttcgaaacaatggacttctgcaagcgatcattcaatcaataaaagtcttactacataacgaagcttccaaggaagcctgcgtgttaagctactatggtttgcttacttgtgttcctattttagtattctttctaaggctttcccaacacttattcactaatctgaattggaaagaatggttgattatcaaattcccagattataaaaagccaatcgtagctattgtggaagccgcatatcatgctacagaaagcaatataggattagtcctagttggaagcttttttgttttctgttgggctggcattttaatgctcttatctctagaagatggcctaaataagatcttccgcaccagctggactccaatatctttaaagaggttagtctcttattttgtgattaccttagtgagtcccatgatttttattatcgtctgtggttcctggatttatattacacagatcatgcctatccaatacgctaagttgttttctctcagccattccatgacagcattgtactttatttctaggtttgtcccctacctgctgctctacctagctctattttgctgttatgcttttcttcctcgcgttgcaatccaaaaaacatcagctcttatctctacgctaatcataggatctgtatggatagtctttcaaaaggcattctttagccttcaagtctctatttttaactatagcttcacttatggcgccctcgtagccctgccttcattccttctcctgctatatatctatacaatgatctacctattcggaggagcactgacatttattatccagaatcgagggtgcactttcatatttcttggggacaaaatcctgcccagctgttatttacaactcattacctcaacatatattctagctttgacaacacgtcagttcaatgaaggcctctcccctttaactgctcaattcatcgccaaacaatcgaaagtacctattggtgaggtctctcaatgtctagatgtattagaaaaagaaggttttctttttccttataacaatgggtaccagcctgtcttcaatttctctgaacttacaatcaaagatattgctgacaaactcctgcatcgggaaattttcaagaaattcaatcccgaccttgggattactttcatagaaaacagcttccagaacatatttaaccaagcttctaaaaataaagagaatcttactcttagcgagattgctaggcgaatcaaatgaaacgaagatcatggcttaaaattttgggaatctgtttaggcagcagcattgtcttgggattccttatattcttgccccaactactttcaacagaatcagggaaataccttgtgttttccctgattcataaagaatccggactctcgtgttctgctgaagaacttaagatttcatggtttggacggcaaacagctagaaaaataaaactcactggagaagctaaagatgaggtctnttctgctgagaaattcgaactcgacggatctctattacgtcttctgatttataaaaagcctaaagggattactctatcaggatggtctttaaaaattaatgagcctgcctctatagaccatccttctgtgagtcacttagatccaggatctttacttacctacctaaatgactgcaagattatttctgagcacggatttatcactatgaagacagtatcaggatcttcattatctgtatcagggtnttatctagaganatcttcagaaaagttcatgacgaaatgcgtggtctctgaagatcagcaatccgggaacatctttatagagagtgtactttctcctgatgtcagtatttccgctcagttttcttcagttcccgttgcattttttaaaatttttatagcttcccctttctgggaccatcttctctcttatgaagacataatcaatctatcagcagaggcaacacataccaatgatggtaagatttctatgacagcctctggcgagggaaatcaaattcaaatgaagcttcaaggccatattcataaatccacattttatattgtagaagggagttcttcgttcatagaacttaaacctgagctcgcctcagctctttgcaaccagatcattccgctgtccacacccattactagtaagcaaatccantgctacggtctcttatgctaaaattcccttggatattacgaaatggaaacatattgaaattacctctcaagcacagctccctgaagtcgcaatacatccgaaagaccctaatcttgcattacagctgcgcgacacaaagctaggaattaaaaagacggagaaattntcagacatccgttactcctcatctacagtcttaggaggagcttctccctctcaccttaatggtttaatcagtatagataacaaaaaacatcttactaaatttcgtctacaacaagcacaactcccccacacctatctaagagccattttccctcaacctttcgtgatcaatgttcccctggatgttgcttattattcattaaatatcgaagggacgtacaaaaatgctcacttagaggcagatgctatcctagataacccgctattgaaattgtcatgctccatgtctggagcatggaaaaattttctttttaaagggcaaggaacgtaccactttaataaaaaatggcaggagattctctctccccacttctcttacgctgaagctagattctcaggaaaagcacaaattaccgatacgaatctctttttccctaaattttctggaaaaattactgcaagagaaaatgagctgctcatccatgcaaaatttggttcccctaatgaacctataaaacctgaaactacctctatactcatccacggacaattttgttctctgccaactcagcctagtttctaatcacctagcccccttccatttgaagaaattgacattttccttccatacggatggaggtaagtttgtaaccaaaggaaacctccaagctcttattgagaatccagactatcccgacctaaataatacgcgtatcctaatccctgatcttcttctttctcttgatgaatcctcaacttcaccttcttcaaaagacttgaaaatccagggttctggagagatattttctttgcctctggattctattactaagacctatgggaaacaagtgcgtctctctccttattttggttcctctggagacttgaactttgtagtaaactacaatcctaaagatcagaataagctcacactactatctanctttaagtcagaagctctcctaggagaactgaagttagtcatggacttttctatgaagctatcttcaggaactcagggaactctccagtgggaagtgagcccagaacgttatgcaagtttctttaaaaacgcatcatgctctcccacctgtttgcttcatagaactgcaaatgtacgcttagacatctcaaaactctcttgtccagaggaaaccaaaggtttatcttgtctcacgcttcttgccgcagaggacttgaaggttcattagaagcaacaccgttgatcttctatgataatgtgtctaaagagacttttattattaatgactttanaggttctttgcgagccaacaatttagacgctaaaatagaatatgatcttaaaggctcgtgtctagctcctaggcaagactctaaaactcttgcagaattttcattagaaggacaggtagatcatctgttctctccagagtctcgagaatttaaacaaactgcaaattggattcacataccctcttcgttcattgctggaatcattcccatgtctccaggattgaaagctcagatatcctcgcttgcaggccctagaatcaacgtatcaattaaaaatgcgttccgatttggagaaggccctgtcgacattatggtcgactctgaaaaccttcaagctcagattccactgatcttaaacgaaaagtccatcttactgagagagaatctaacagcgcaccttagtataaatgaagatgtaaataaggctttcctacaagagtttaatcccctcttagcagggggagcctactcacaatacccagtaaccttagagatcgataaacaaaacttctatctccctatacgcccgtattcttttgaagaattccgcatccaatccgcaacattggatatggggaaaatctcaatagcaaatacaggaactatgtatgctcttttccaattccttgatattacggatcaaaagcaatttgtagaatcttggttcactccaattttcttttctgtacaaaaaggctctatcatttgtaagcgcctcgacgcccttatcgatcgtagaatccgccttgctctatgggggaaaactgatatcgctcatgatcgtctgtttatgaccttgggtatcgatcctgaagttattaagaaatactttcataacacctctttaaaaactaaaaacttcttccttataaaaatccgaggatccatctcgtctcctgaagtggactggtcttcagcttacgctagaatcgctctattaaaaagctacagtcttgggaacccgtttagtagtcttgccgataagctattctcttctcttggcgactctacccccccaccaacagtacaccccttcccttgggaaaaatctaattttgattctatagaaaataaatagaatcaatataaaaacttaacagttctttttaattaattatttttataaatcttaaaaataaaattaaattaattattaggaataaaactcatgagaaaacgtcactctttcgactcaacctctacaaaaaaagaagccgtcagtaaagctatccaaaaaatcatcaagattatggaaacaacagacccttctttaaatgtagaaacccccaatgcagaaatcgaaagcattctccaagaaatcaaagaaattaaacaaaagttatcgaaacaagcagaagacctcggtcttttagaaaaatactgttctcaagaaaccctctctaatcttgaaaacactaacgcatcgctcaagctttccataggcagtgtcatagaagaactcgcttctctcaaacaacttgtagaggaaagtattgaagaatccttagggcaacaagaccaactcatccaatctgtacttattgagatctctgataagtttctttcctctataggggagactctttctggaaatcttgatatgaaccagaacgtaattcaaggactcctaatcaaagaaaaccctgaaaaatctgaagcagcttctgtaggatatgtacagactctactagagcctctaagtaaaaggatcggcgagactcataagaaggtcgctactcatgatgtgaatatctcctccttgcaatttcatatgatgtcagtggcaggaggtaggttccgtggtcatattgatatgaatggctatcgcgttttaggattgggagagcctaaaaatggagaagatgctgtctctaaggattatttagaacgttacgtaagctcgcagctcactatagacaaagttgaagacaagcccattacaaagccaaataagggaaaattactctattcccaagggacgagtcctaaacttgaaggtcccttacctttagggcttctgacatctggaatctcaggatttacttggaaaagtgcaagcaaatctaacgatggaagcttcccttttagtgctttaagacacaaggaaacagagtcggatacagattgcttccagattacttccacaacgctctcaggaaatcaagcaggaacctacacctggtccttatctttaaaagtgttggtgccttcaatcttccaaatcgaaaaaccagaagtccagctctctcttgtctactcttatgaagactggcttcctatcgataatatcttcaatatgtctcagcctaggaccataccactagctctcctaggacaaacaatgcttgcaggacaaaaatatgatatcctagagctcgccgcacatcaaacaaaccaaactctaatgattagcccgaactgttctcgattctctctacaattaaaacaaactaatcagtttgaaaactcccctgtcgatttctatattgtccatgccgctcattcctgccactggtcaggattctaaagtatcactacagctgctctagcagctgtagtcctattgagcagagtggatatatttcgataatggatgaccagaatcgagctctccgtcacgcttgtcatagacccccgcaacagttccttgatctataagatagatacgatccaaacaactatgaacaaattgcatgtcatgagtagttaaccctacagtcagttcctggtctcgaagtgtttctaaaagatgtcggaacgatgccgtagcaaaaggatctaaagccgatgtaggttcatcaaaaagtaatgtatgtttatccatacataaagaacgtacaatagccacacgttgtttttgtcccccagagagctggtcaggataattcttagcaacctcttcaatatccaacaaatgtaaaagctcgaacgccttttctcgagcttcttcggtactacgacccttgatatggatttgtggatgggtgcaatttcctaatactgtcatatgggaaaataactcgggttgttggaaaactagagctggagcctccccttcaatccaaatatctccttgagtgggctggactaagcccgccaaagcacgtaaaatcattgtttttcctgaaccactcttcccaacaaacagtgtaatgtgccctcgctctaaagaaaaagttacaccatctagaatctttttcttatttacagagtaggcaaggtttcggactctaattgtcataactccttctcttttctgataacctagaaatacaggaaaatgatgttgtcattaagaaatatagcccagcacaaataagatacatttccatagggttcaactctctcgagacaatatccttagttactttagttaactcggggacaccgacaaccattaaaatactactttccttgatcaaagaaacaaattcattggttaaggatggtaaaatatttttaaaaacttgaggataaataatataaacgaaaatttgatacttcttatatcccaaaaccattgcggattcccactgccctatagaaagagaattgatacctccacggatattttctgcaagatatgctgcagaattcatacttaaagcaataattccagcaactagaggtgtgggttctatggggagaacttcaggcaatccaaaatatataatcaaaatttgaataaataaaggagtcccgcggataacagtcacataactattagctaaaagtttcgttaacttagaagggaagtatagagaagtcaccgttccaatcaaaagacctaaaatagaaccacatagaatgccgattccgctcacacataaggtgtatccgcatcctcttaacaacagtcttgctatagctagccaatgatccactccgacctcttatgcatatttatttataatgaaatcatatttatgcaattaatccaagaaaacttgcagtaaatttgcaatcgaaaccatcaacaatgggagcctcccttcatctataggagtgacaaaaatcgtgtcatctcctgccaaagttccaagaatttcatctttgagcccttgatctaacaaagcagcgatccaagaagctgaaccaggaaccgtacgaattacaataagagaggcgttatggcgaatagagagcaccaaatgacgggtcgtggtcttctctgttgaagagggtaaagaataacgagcaccacgctctccagcaacctttacagcctgaatctttcgtagccaacgagatacagacgactgggttgtagcaaaaccttgagctaagagttttgcacataattcctcctgagttgccgctccttcaagacgtaaaatttcttttaaagcctcatctatagttactttttttttcataaaaaccccatgtaacttttacttgctcatattgagaagtcccccatactataaaaggcaacgttttcttttcttggttttttatgctcaccctaggcttggaaagttcttgcgatgagactgcctgcgctatagttaatgaggataagcagatattagcaaatattattgcctctcaagatatccatgcatcctatggcggagtcgttcctgaacttgcttcaagagcacatctccatatcttcccacaagtgataaataaagctctacaacaggccaacttattgatcgaagatatggatctgattgcagtaacgcaaactccagggttgataggttctctatcagtaggagtgcattttggtaaaggcattgccataggagcaaaaaaatccttgattggagtcaatcacgtcgaagctcatctctatgctgcctatatggcagcgcaaaacgtgcaattccctgctttaggtcttgtggtctctggagctcataccgcagcgttttttatagaaaatcctacatcctataaactcataggaaaaactcgagatgatgctataggagaaacttttgataaagtaggacgctttctaggattaccataccctgcaggcccattaattgaaaaactcgctttagaaggctctgaggacagttatccttttagtccagctaaagtcccaaactatgacttttcattcagcggtcttaaaacagctgttctctacgcaatcaaaggaaataatagtagcccccgctctcctgctccagagatatctttagaaaaacaaagagatatcgctgcttcatttcaaaaagcggcctgcactactattgcacaaaaacttcccactattataaaagaattttcgtgccgatctatacttattggaggtggcgtagccattaatgaatactttagatccgcaatacaaactgcgtgtaatctacctgtatacttcccccctgctaaactatgctcagataatgctgctatgattgcaggtctagggggagaaaattttcaaaaaaactctagtattccggaaattcgtatatgcgcaagatatcagtgggaatctgtatcaccattctccttagcctctccgtagtcctccaaggctgcaaggagtccagtcactcctctacatctcggggagaactcgctattaatataagagatgaaccccgttctttagatccaagacaagtgcgacttctttcagaaatcagccttgtcaaacatatctatgagggattagttcaagaaaataatctttcaggaaatatagagcctgctcttgcagaagactactctctttcctcggacggactcacttatacttttaaactgaaatcagctttttggagtaatggcgaccccttaacagctgaagactttatagaatcttggaaacaagtagctactcaagaagtctcaggaatctatgcttttgccttgaatccaattaaaaatgtacgaaagatccaagagggacacctctccatagaccattttggagtgcactctcctaatgaatctacacttgttgttaccctggaatccccaacctcgcatttcttaaaacttttagctcttccagtctttttccccgttcataaatctcaaagaaccctgcaatccaaatctctacctatagcaagcggagctttctatcctaaaaatatcaaacaaaaacaatggataaaactctcaaaaaaccctcactactataatcaaagtcaggtggaaactaaaacgattacgattcacttcattcccgatgcaaacacagcagcaaaactatttaatcagggaaaactcaattggcaaggacctccttggggagaacgcattcctcaagaaaccctatccaatttacagtctaaggggcacttacactcttttgatgtcgcaggaacctcatggctcaccttcaatatcaataaattccccctcaacaatatgaagcttagagaagccttagcatcagccttagataaggaagctcttgtctcaactatattcttaggccgtgcaaaaactgccgatcatctcctacctacaaatattcatagctatcccgaacatcaaaaacaagagatggcacaacgccaagcttacgctaaaaaactctttaaagaagctttagaagaactccaaatcaccgctaaagatctcgaacatcttaatcttatctttcccgtttcctcgtcagcaagttctttactagtccaacttatacgagaacagtggaaagaaagtttagggttcgctatccctattgtcggaaaggaatttgctcttctccaagcagacctatcttcagggaacttctctttagctacaggaggatggttcgcagactttgctgatcctatggcatttctaacgatctttgcttatccatcaggagttcctccttatgcaatcaaccataaggacttcctagaaattctacaaaacatagaacaagagcaagatcaccaaaaacgctcggaattagtgtcgcaagcttctctttacctagagacctttcatattattgagccgatctaccacgacgcatttcaatttgctatgaataaaaaactttcataatctaggagtctcaccaacaggagttgtggacttccgttatgctaaggaaaattagcacctcttttaatctcgcaaacttgtcaagaactgaatcttatactaaactgggtgcctttgtggcacctcgtttccttctgactgctcttctctctctactcaaccgcatccctaaaagttgaaatcttattctaaagaaaggtcttttatgctccgtttcttcgctgtatttatatcaactctttggctcattacctcaggatgttccccatcccaatcctctaaaggaatttttgtggtaaatatgaaaggaaatgccacgctccttggatcctggaaaaactcgtctcattgcagaccaaactctaatgcgtcatctatatgaaggactcgtcgaagaacattcccaaaatggagagattaaaccagcccttgcagaaagctacaccatctccgaagacgggactcggtacacatttaaaatcaaaaacatcctttggagtaacggagaccctctgacagctcaagactttgtctcctcttggaaggaaatcctaaaggaagatgcgtcctccgtatatctctatgcgtttttacctatcaaaaatgctcgggcaatctttgatgatactgagtctccagaaaatctaggagtccgagctttagataagcgtcatctcgaaattcagttagaaactccctgcgcgcatttcctacatttcttgactcttcctatttttttccctgttcatgaaactctgcgaaactatagcacctcttttgaagagatgcccattacctgcggtgctttccgccctgtgtctctagaaaaaggcctgagactccatctagagaaaaaccctatgtaccataataaaagccgtgtgaaactacataaaattattgtacagtttatctcaaacgctaacactgcagccattctattcaaacataagaaattagattggcaaggacctccttggggagaacctatccctccagaaatctcagcttctctacatcaagatgaccagctcttttctcttccgggcgcttcgactacatggttactctttaatatacaaaaaaaaccttggaacaatgctaaattacgcaaggcattgagccttgcaatagacaaagatatgttaaccaaagtggtataccaaggtcttgcagaacctacagatcatatcctacatccaagactttatccagggacctatcccgaacggaaaagacaaaacgaaagaattcttgaggctcaacaactctttgaagaagctctagacgaacttcaaatgacacgcgaagatctagaaaaggaaactttgactttctcaaccttttctttttcttacggaaggatttgccaaatgctaagagaacaatggaagaaagtcttaaaatttactatccctatagtaggccaagagtttttcacaatacaaaaaaacttcctagaggggaactattccctaaccgtgaaccaatggaccgcagcatttattgatccgatgtcttatctcatgatctttgccaatcctggaggaatttccccctatcacctccaagattcacactttcaaactcttctcataaagatcactcaagaacataaaaaacacctacgaaatcagcttattattgaagcccttgactatttagaacactgtcacattctcgaaccactatgtcatccaaatcttcgaattgctttgaacaaaaacattaaaaactttaatctttttgttcgacgaacttcagactttcgttttatagaaaaactataggagaaaaagtttagacttaaaattcgatagtaaatttattaaagtaatttttaaaatgttttcacgatggatcaccctctttttattattcattagccttactggatgctcctcctactcttcaaaacataaacaatctttaattattcccatacatgacgaccctgtagctttttctcctgaacaagcaaaacgggccatggacctttctattgcccaacttctttttgatggtctgactagagaaactcatcgcgaatccaatgatttggaattagcgattgccagtcgctatacagtctctgaagacttttgctcttatacgttctttatcaaagacagcgctttatggagcgacggaacaccaatcacctccgaagatatccgtaacgcttgggagtatgcacaggagaactctccccacatacagatcttccaaggacttaacttctcaactccttcatcaaatgcaattacgattcatctcgactcgcccaaccccgattttcctaagcttcttgcctttcctgcatttgctatctttaaaccagaaaacccgaagctctttagcggtccgtatactcttgtagagtatttcccagggcataacattcatttaaagaaaaaccctaactattacgactaccactgcgtctccatcaactccatcaaactgctcattattcctgatatatatacagccatccacctcctaaacagaggcaaggtggactgggtaggacaaccctggcatcaagggattccttgggagctccataaacaatcgcaatatcactactacacctatcctgtagaaggtgccttctggctttgtctaaatacaaaatccccacacttaaatgatcttcaaaacagacatagactcgctacttgtattgataaacgttctatcattgaagaagctcttcaaggaacccaacaaccagcggaaacactgtcccgaggagctccacaaccaaatcaatataaaaaacaaaagcctctaactccacaagaaaaactcgtgcttacctatccctcagatattctaagatgccaacgcatagcagaaatcttaaaggaacaatggaaagctgctggaatagatttaatccttgaaggactcgaataccatctgtttgttaacaaacgaaaagtccaagactacgccatagcaacacagactggagttgcttattacccaggagcaaatctaatttctgaagaagacaagctcctgcaaaactttgagattatcccgatctactatctgagctatgactatctcactcaagattttatagagggagtaatctataatgcttctggagctgtagatctcaaatatacctatttcccctagacaaaagaagtctttggtaaggggttttttttattgaagagacctttcttcaccagtatactattgtatctttataagaagtttcttctgtatataaattgctatatgaagaaacagtaagtaataggagcattaggatacgcctccttaaggtatttctatcctgaaagatacaataatctcattcccccatcgactaaatccaccacggactccgacctcccatgtcttcaatccatatgaacgtaatattaagtagcaaattgagtactatataatgaagatgcataggcttaaacctaccttaaaaagtctgatccctaatcttcttttcttattgctcactctttcaagctgctcaaagcaaaaacaagaacccttaggaaaacatctcgttattgcgatgagccatgatctcgccgacctagatcctcgcaatgcctatttaagcagagatgcttccctagcaaaagccctctatgaaggactgacaagagaaactgatcaaggaatcgcactggctcttgcagaaagttataccctgtcaaaagatcataaggtctatacctttaaactcagaccttctgtgtggagcgatggcactccactcactgcttatgactttgaaaaatctataaaacaactgtacttcgaagaattttcaccttccatacatactttactcggcgtgattaaaaattcttcggcaatccacaatgctcaaaaatctctggaaactcttgggatacaggcaaaagatgatcttactttggtgattaccctagagcaacctttcccatactttctcacacttatcgctcgccccgtattctcccctgttcatcacacccttagggaatcctataagaaaggaacacccccatccacatacatctccaatgggccctttgtcttaaaaaaacatgnacaccaaaactacttaattttagaaaaaaatcctcactactatgatcatgaatcagtaaagttagaccgagtcaccttaaaaattatcccagacgcctccacagccacgaaacttttcaaaagtaaatctatagattggattggctcaccttggagcgctccgatatctaacgaagaccaaaaagttctctcccaagaaaagattcttacctattctgtttcaagcaccacccttcttatctataacctgcaaaaacctctaatacaaaataaagccctcaggaaagccattgctcatgctattgatagaaaatctatcttaagactcgtgccttcaggacaagaagctgtaactctagttcccccaaatctttcacaactcaatcttcaaaaagagatctcaacagaagaacgacaaacaaaagccagagcatattttcaagaagctaaagaaacactttctgaaaaagaactcgcagaactcagcatcctctatcctatagattcctcgaattcctccatcatagctcaagaaatccaaagacaacttaaagataccttaggattgaaaatcaaaatccaaggcatggagtaccactgctttttaaagaaacgtcgtcaaggagatttcttcatagcgacaggaggatggattgcggaatacgtaagccccgtagccttcctatctattctaggcaaccccagagacctcacacaatggagaaacagtgattacgaaaagactttagagaaactctatctccctcatgcctacaaagagaatttaaaacgcgcagaaatgataatagaagaagaaaccccgattatccccctgtatcacggcaaatatatttacgctatacatcctaaaatccagaatacattcggatctcttctaggccacacagatctcaaaaatatcgatatcttaagttagatccgaaatggaaaaattaaaaattttatagacaatcttgaaaagagaattaaaaatttttaatttaaattatagttgcaattgaaaacgcccctaagaatcggggcccctaactactgaatctacgtgaaatgcaattgttaaaaaaataagagatttatagaaaaataaaagtcttccttcccaacgcattttttgtattgaagatgactaanantgnaagtataatgacttaaacattttagagctgaggtctacttcaaggtagaaatgcttaatagggttgtctctcgtgttctcatacataaaaaaccgaattctttttaatttgctttctctatggattgttttgacactcacgttcctagttatgaaaaccatcccaggagatcctttcaatgacgaaggctgcaatgttctttccgaagaggtcttacaaaccctaaagtctcgatacggtttagataaacctctctatcaacaatacacacaatacctccactccatcgcaaaactagattttgggaactcgttagtttataaagatcgcaaagtaacgaacatcatttcgactgcctttcctatatcagcaatcctaggattgcaaagtctttttctctccataggaggggggatcgctctcggcaccatagcagcattaaaaaaaaagaaacaaagacgctatattctaggcgcctctatactccaaatctcgattcctgcttttatattcgcaacactcttacaatatgtctttgctgtaaaaattcctcttcttcctatcgcctgttggggaagctttactcatactatactcccgactctcgcacttgctgtaactcccatggccttcatcatacagcttacctactcttcagtatccgcagcattaaacaaagactatgtcctactagcctatgcaaaaggactctccccacttaaagtcgttataaaacatattttaccctacgccatattcccaaccatttcttattccgcattcctaactactacagtgattacaggaacctttgctatcgaaaatatcttctgtattcctggattaggtaaatggtttatttgtagtatcaaacaacgagactacccagtagcccttggcttatccgtattttatggaacttatttatgctctcttctttactttctgacctgattcaatccattatagatccgcaaatccgttatgcgcacggaaaggaaaaaaaaagaaaataaaagtcataagaaaaaaagaagcataaacttatggaaaacctatcctcagctccatcacgtagcatttggaaatctataatccagaataaaatgcttgttctaggcctcacgaccctcataattctaatgcttggagccctccttttgccatggttctatcaagattatgaacagacttcattaaaagacattcttgtctctccatgctcgcgctttccctttggcacagacactctaggcaggtgcatgtttgcccgaactctacgaggtctacgactctccttactcatagcgacgatcgctacacttattgatgtgtgtgtgggacttttatgggccactgttgctatatctggagggaaaaaaatagatttcttaatgatgcgaaccacagagattctcttttctctaccgagaatccccatcattattcttcttttagtcatcttccatcacggactgctcccgctaatccttgcaatgacaattacaggatggattcctatatctcgaattatctacggtcagtttctactcctgaaaaataagccctttgtcctttctgcaaaagccatgcatgcctccacgtttcatattctaaagaagcatcttcttcccaataccctagctcccatcatatctacattgatttttactattcctaacgctatctataccgaagccttcattagcttcctgggtctaggaatacagcctcctcaagcaaagcctcggcaccttagttaaagagggaatcaatgctatagattactacccatggctatttttcttcccctctctaattatgattgccctctctataagcttcaatctcatcggcgagggggctaaaacactatgtctcgaagagggatctcatggataactacttactaaatatcaaggatctcacaataacctctacaaaccctaagagaactctaattgaaaatttatcactacagctcaaagaaaatcgaaatcttgctctagtcggagagagcggctcagggaaaactacaattaccaaagccatcctaggcttcctccccgaaaattgtctgatcaaaaccggaagtattttatttgaagatatagatattaccaagctctcaccaaaagagctccataagatccgcggtcaaaagatcgccacaatactacaaaatgctatgggttctctaaccccatccatgcgcataggaatgcaaatcatagaaaccttaagacaacaccacaaaatgaataaagaggaagcctataataaagctatgcaactccttaccgatgtttgcattcctaatccaaaatatagcttctcacaatacccctttgaattgagtggtggcatgcgccaacgtgttgtaatcgccatagcactcgcaagccaacctaagctcattcttgccgatgaacctacaacagccctagactctatgtcacaagctcaagtccttaggattcttcgtaatatccaacaacagaaacaagctacaatccttcttgttacccataacctctctctagtcaaagagctctgtaatgatatctgtattatcaaagacggcaaactcatagaaacaggaaccgttgaagagattttcctctctccgaaacacccctatactctcaagctcctcaatgctgtctctaaaatccctattaaaaaaaccagctctcccatccttaaaaataagttccaacctctaatgagtatgcaaggtggtttatgacaactctactaagtataaaggacctttccctaaccatcagaggaaagaaaattcttaatcatattaacctcaacctaatcaaaggaagctacttaacaatcgtaggacccagtggctcaggaaaatcttccttagcacttactattctggatctcctaaaacctaccacaggaacaatcacgtttcatatggaccccaagatccccagagcacgtaaggtccaagtgatctggcaggatatcgactcgagtctaaatccctgcatgtctataaaaggaattatttccgaacccctaaatatcatcggaacctattctaaagccgaacaaaataaagagatttataacgttcttgatcttgtgaacctccccaagtctgttctccaccttaagccttataaactcagtggaggacaaaaacaacgcatagccattgcaaaagctctagtctcaaaacccgagctccttatctgtgatgaacccctctcctcactagacacgctcaaccaatccctaatcttagacctttttcaaacaataaaaaaagaataccaaaatacccttctctttatcacccacgatatgtccgcagcgtattatattgcagacactatcgccgtcatggatcaaggaagtcttgtcgaacatgcttgtagagaaaaaattttctcaactcccaagcatacaactacacaagatcttctcgacgccatccccatattttccttgatctccacagaaatggaaccctcggaagaatacgaattacaagtcgcctcaaagtanatagatttagaaataacgaattcttatagaaaaattaggatttttgacgtctctcaatagaaaaatgaaagtctgatatgatgaatcaaaaaaaccaatagttaatttgatttttgaattgttttttctcagaaagttccttgactccactaaaaactcgctatctagttataaaatagagtcaacgcctcctacggccgtccaatctagggttagatcaaaaaaacttaacactagaatcagacgccaattatttctaaactattgtattacaatcattcctatttgaattaaacactttgaatccccataatgttcttgcttcaacaaacgcaaccattctaaaagaaccctcgccttctctattgcgacgtgtaccttaatttattgaaatataaagcatccgaaaactgtagttctattaagagctgggcgcttaggaaccttaagttattcctataaatcgtccccctcccccaaaaaaacaataaagagaccagttgtatgaatacctataccttctctcctacacttcagaaaagcttcagcctatttcttttagaaaaattagactcttactttttctttggagggactcgtacacaaatcttagtcatcacaccaaccaatattagattagcagctaaaaaaagagggtgtaaggtttctactatagaaaagataatcaagatcctctcttttatcctgctgcccctagttatcattgcctttatacttcgctatttcttacataagaaattcgataaacagttcttgtgtatcccaaaagtcatttctaacgaagacgaagctcttcttggatctagaccacaagcagttgaaaaagcagttcgagaaatatctccagccttcttctctataccaagaaaataccaacttattagaatcgacactcctaaagatgacgctccctcaatccttttccctataggcatagagatcattctcaaagatttatgtattgatacactcaagcaatctaatcttttccttaaaagagaaatggatttcttaggtcatccagaagaaaaagcattattcgactcgatatgttctatagaaaaagatcaagaatggatgagcttggaaagtaaaaaacttttaatcacgcacttcctaaagtatctctttgtctctggaatcgaacaactaaatccaggctttaacccagagaatgggcgtgggtatttttcagaaataagtacagcaaagatccattttcatcagcacggtcgatatgggccaatccgttcttcgggacccatcatgaaggaaatataaaaataaaaggcatgggctaccaaatcttcacaagacttaaaaaacttggaatctcattctcctcttataattccattaatcctaatccttacttcttcgatgaaggctgttttgtctactgggaatcccaatttaaatccgcactgcaagatcacgggattctccagaaacagacagaaacattctatagaaatacttaaatacatttctaagaagtctgtctaagagaactccaaacctataaaaaaacccttaaatatttcctaaatagaagactctataaaaggctatggttccgctagtgcctttagaaatccccctcagctattgctaaagttctttctagtatgtgaagagttatgtatacttactgttgctacacatagagctctcttagaaactcctttagctctatcattttttaaagaacttaaagacaaaatatgtctacagggcgaaagacatactacaactacataacctataaaggatttactatccttaatacatcaccgttatgttcttaatttctctatctgtaaatcgttgacagaagaagccctgcatgctacgactcaattaacagtgatgcaattggagtatctttgctaatggatatttcccatatcctggaagatcttgcctatgacgaagggatccttccaagggaagctatagaagcggctattgttaaacaaatgcaaattacgccttatttactgcatattttacacgacgctactcagcgcgtccctgagattgtaaatgatgggagttatcaaggtcacctctatgccatgtatctcctcgcacaattcagagaaagtcgcgcactccctctcatcattaaactctttgcatttgaagatgatactccacacgcaatagcaggtgatgtcctaaccgaagatctgcctaggatcctagctagcgtctgcaatgatgactcgctaattaaagagctcatagaaactccaaaaatcaatccttatgtgaaggcagcngcaatctctggtcttgtaactcttgtaggagccgggaaaattcctagggataaagttatccgttantttgcagaacttctaaactatagattagaaaaacagccctcgttcgcttgggataacctaatcgcagggatctgtactctttaccccggagagctcttctatccaataagcaaagcctttgacggaggacttgttgatacatctttcatcagcatggaagatgtcgaaaatattatccacgaagaaaccgtggaatcttgtatccataccctctgttcttctacagaactcattaatgacactctagaagaaatggaaaaatggttagaagacttccccatagaaccgtgacatcgatcaatcaatatttctaaccactacaccgaggtcctaagtgaacaaaaaaaaacgtttcttatctctcctctttctgactgcagtacttttaggcatttggttctctccccatcccgcatctataaattctaatgcttggcaactcttcgctatattcacaactactatcatgggaatcattttccagcccgtccccatgggagctattgccattattggaatctccacactactactcacacaaacgttaactctagaacaaggattgtcaggattccataatcctatagcgtggttagtcttcctctccttctcaatagcaaaaggaatcataaaaacaggactcggtgaacgaatcgcatacttctttgtcagtgctttggggaaaagtcctctaggactcagctatggactggtaatcacagattttttccttgcacctgcaatccccagcgtgactgctcgagctggagggattctctatcccgtagtcacgagcttatcagattcctttggaagttccgcagaaaaaggaactcaagatcttatcggatccttcctcattaaagttgcctatcaaagctcagtgatcaccagcgctatgttcctcactgctatggcaggaaaccctctggtggcagctctagcaggccacgtcggggtttctttatcttgggttctatgggcaaaagccgcaatcattccaggactcctcagtctattcctcatgccgatcatactctacaaactctacccaccaaaaaatcacatcttgtgaagaggctatccgatcggcaaaacttcgactcaaagaaatggggccgctaaaaaaagaagaaaaaacaatattgatgatctttttcctccttgtagtcctctggacttttggagatctcttaggaatctcagcaacaacagcagcccttataggactgtctctcctcatcctcactaatattctagattggcaaaaagatgtcatagcaaatacaacagcatgggaaacattcatctggttcggagccttaatcatgatggcttccttcttaaaccaactcgggtttatcccactcgtaggagactcagcagcagcactggtcagtggcctctcttggaaaattggcttccctctactcttcctgatctacttctactcccactacctttttgctagcaataccgcgcatatcggagccatgtatcccatattcctcgcagtctccatatcgttagggactaatcctatattcgcagcactcaccctagcattcgcaagcaacctttttggaggactcactcattacggatccggacccgcacccctctacttcgggtcacatctcgttactgtccaagagtggtggcggtcaggattcgctcttagcattgtcaatattgttatctggataggaatcggaagcttgtggtggaaagccctcggactcatttagaaaccaagtcttttatatagaaaatattctttagcaagtttatattttgtgaaatatganagctnaatcataggaccacctgtgatttagccttctgtcataagctctctttttatagcctaaagttgaagaaagcttagccgtaaaaggtcttgttgtattcttccaacgagttacaacgaaatacactaaagttcattctcaaagtagaatcattccttaaaataagacctttttaaaaaaacctgatgttcttatgcacaaaaagaatcccattgactttagccttgggatgatgcaaaaagcaaaattagagtgtagccgttatccttatgcatcctttatacgttgatcttgatactattatcagctcctactctcctcccttacctaaagaatttcaagaagcagcctctttaattgctgttccagatacttcacattctaagcctgtcgttccaggagtgaaaaccctctttccacaaacctaccaccttccctatctaaagtttgtccaaggagaaaatgtcgttcacactcctctaaaagtaggcgtaatgttctcaggaggacctgctccaggaggacataatgtcatccaaggactcttcaatagtctaaaagatttccatcccgattcctccctcgtggggttcgtaaataatggagacggtcttacaaacaataaaagcatagacattactgaagagtttctctccaaattccgaaattccggaggcttcaactgtataggaacaggaaggaaaaaaattgtaactccagaagctaaagaggcttgtctaaagaccgcagaggctctggatctcgacggactagtcattattggcggtgatggctccaatacagcaaccgctattcttgcagagtattttgcaaaacgacgcccaaaaacctctattgtcggagttcctaaaactatagatggggatctacaacacaccttcttggatctggccttcggatttgatactgcaacaaaattctactcttcaatcattagcaatatttcaagagatgctctttcctgtaaagctcattaccacttcattaaacttatgggacgctcagcatcccatattgctttggaatgtgctctccaaactcatccaaatattgcccttatcggcgaagaaattgccgaaaaaaatctaccactaaaaaccatcatccataaaatctgctccgtaattgcagatagagccgctatggaaaaatactatggcgtcatcctcatcccagaaggcattatcgagttcatcccagaaatcatcaacttaattacagaaatcgaaagcctatcagaatacgaagataaaatctccaggctctctccagaatcccaacgcctactgaaaagcttcccagcacctatcatcgagcaaatcctcaatgaccgcgatgctcacggtaatgtctatgtttctaaaattagtgtcgataaactactcatccacctggtcagcaatcatctccaacaatatttccctaacgtccctttcaatgcgatctcacattttctaggatatgaaggacgctcgggattgcctacaaaattcgataatacctacggctatagcctcggatacggcgccggtattctcgtccgcaatcactgcaacggctatctctctactatagaatccctagcatgccctttcatgaaatggaaattacgggcaattcccgtagtgaaaatgttcacagtaaaacaacaggcagatggaactctacaacctaaaattaaaaaatacctcgtagatataggaagcacggcatttcgtaaatttaagctctataggaaaatttgggccctcgaagactcctaccgattcctagggcctctacaaatagaaactcctccagaaatgcactctgataatttccctcctcttacccttttgcttaatcataacttttggcaacgtcaccagggttgcatagaaatccctgatactacgtattaattacgttctaatacgttcttaattcctgaaaatctaagatgcttccacgcaagcttatccgcatactaaacttagcagaagtaatggatctgattcggatacagtaagactgttacaagccacaactggtgcactgaatcctgtacatgccatgcaactcggtacgaatgccacgccatgacgaatcaaagggaaactagatacaaacgtggcaataagaaaagagagcgtcgatcaaccaaggacttttgataagctacctgcctatagaatcctctccccacttaacaaagttttttataaaganactttcattcttattaataagagataattcaatcgttactatttaaaaataagcaacttagaatcaactatagagagaaaacaattattatattaaaattcatcgaacaacattaggttgaagatggaaacttatagcttttctacagaactacagaaaaatacttctctctatatcatggaaaagttagattcctatttttcctttcaaggcaaacgcacacgggtaattgcaataacccctgcaggtttagccatcgcctacgagcagaatatccacctctctatgaccgtgaaaatattaaaagtcctctcctttccacggtctctcctcaggacaactagtttgtggtatcgcccttgataatacgaatatcgataaacaaaaacaactatccgaagaactcaaagactctcccaaccaacattttgtctatatagaactccaaaatgccttcttctcctataccgagatctaataaagtttcatagacatcgtatcgaagattttgtaatcattcctgcttattctgtgtctttccgcggcgacttcacagtttcttcttcgaacatagaatctaaactatgtttagcggcanttcatacttcctcataactaaacagccccgttctaacttacttttagcaattgcaaactcaagctctttagtttgttttattcccttttcgagctctagaaggctgaatttctccctaatgaactcctctttagccctagcctgctcttgaaaatctgtggatgtcttacataacaatgtatactcatacagcaacaataagtacctcaatcgtgattgatacaaacaatccttttgatactcctcttgactgggagtcttagaaaaacaaaaaagagaaacatcatgcaattcaataataatgtcgctaagtttcctttgcagatcttgaatcgagcatttctccatcgcatgctcctctctaagaaggctctcattgagctccttggtttctttttcaaaagtgcatagcttcctctttgctatttcaacacaatcattcccccaatccacaaactcttctatcttgcaaagaggccatctaaaatctaacaggtaatatgcattcaaatctcggattgctgtttttagaaaatgtatctccgaagcaatacaaaaagccctccgattcacttttgataaataggcacccaagaattctatagtctgatagatagcacctatgtccccaagacctaaaacatctctggcttttgtcagtaaagcattccacgcatcgattgctttttgagactcaaaaagcacatcttcatcttccgtagcctttaaaaatttgtcctggcccagcccgagtaaaacgaattcaagatgatccaaacattgataaagtgaagtgatctcttggtcacttgtcggcttctggtcttttaaatgcgcaaactctcttttaagagcctctaactctactagcatagtgctaatagtagcatgctctttctctctaattgtcttgaaatactctctttctctttcccaaagtttctggtactataataaagattttgcctcctcaactaaaagtccgactcctccagctaataaaagaagtcccagaacaatcccaagaaccccaaaaactaatgaaaggactccatgagaaaatactgtgagtatggcaaccccagcaagaagaaaaagagaacctataataactaagctcacagctaagatcacaaaagtactttgtttaaagcacctcttctgttgtatctggtcagaagtcttatgaagcaaagcagattgaatagaagaggcctgtacattggaaatatcaggataagacataacacattctcaacaaaacttatgggaaaagaataaaatcttctttaaggcattttatttttaagcaatgccttataaaaagaaatgttataactttgaatggcttaaaaaataaaatatttatttgtttatgcctctagaaggatatccacataaagttgagcaatctcgagttctaaagtctttgtatgtactacgcacatttgtagctcttcaaaggtctcaatacaatcctccacagccatccgagcccttaccctgtcaagagtatctattggtttcctagatactacctcatcgttgtatatcgcccataaagcatgtaacatagtcacacgtatacagtggatttggtattcttccaaaacatcctcagaatcactcgtaaaaagattcgtttcattttctaagtctgtttcaatctcagtacaacaacacagaagttctgaaaccgatagctgttttgctcttttcttttcttcattcactctcatatcttccacacagacttttacataattacgcaaattttttgctgtgcggcacatagcatatgcttccataagaaaatggggagcagttccctcaaaaacatcaccaatataaagattactcagtgctttctttgaaacatgaatttctgaatagcaccaaaggtcttctctgtaggatctccaaaaagcagctttcctatcatagagcttcttgaagatctcctgagcagattttcttcgaaataatagtgcctctttacactgctctaaaatagagttttgctcttgggctctctcctgaatttcacttagatttcgaggaacacctatctttagaatctgttttttctctgttttagaaccttccaaaacatcgagtcgtgcagaaaacccacgaatcaatgtatcctttttctgctctaagtccaactcccttgctaaatcagcaatctgatcctgcatctgtataatctcactaggaagcttcttatcgaaccctccctcaacaccaaatagctctttaggctctaatccatagcgctccttaaatttaagaagcgccaatcctatacttattaagagcagccctaaaatcatgctgctcatccctaaaaggtacgtagagaaaactcccaagaataccatccccaggcatacgaaaagagtccctaaaataataagacaaacgatcacgacattaaagacgtggtgaatgcgaatactcgccgtttctataggcccaaaagggaaaagactgtgtttacaagaagtaagttctgaaaaacttaatatctccgaataaatagacacaaccactccatacgacagctctcagagagattttataaaataatttctcanttttaatatttttttacaaaccgttcttctaattcaataattcttgaaattcgcctcttgaagtatgttgtaatactatttgatattaaggatgataaacgtaccctcaactctcgaaaacagaaaacagaaaacagaaaggatcgttctctttcttccacaaaggaaggataagctctaatctgggaattcctatctgattggtattagaaaaaattaccctagagaaaactaccaaaatctataaaccttgaatgtgtagaactgctaagagaggcaactatggtcatcatagtttagaaacgctctcttctgtgctttagtaggagatctgtaaactaagtttcttctgtcactatatcttttatcttatggatcagttctagttccaatgacnntattacgtcttgaagtgatcgtaactctttttcaatctctgtgagtttttcaaaatacgcagattttatagcacctctgaactggagcttacgcaccagaagggcgttcaacccagtagaagccgccctcattcgattttcacattcttcaagagttaggccagaagttactgttccagaaataaggaactcataatgatgcagaactatttcgctatttaaataattcaaaattaaaagctgttgatacggactaaaaagttcaggatgggaaagattttcaggatctagcccctgatttttaagggcttcttcattttttttcatttctaagagagactcagttctacccatgaaaagacgtgccggactttctttcttggctctatccataagcttttttgttgccctatcgacaatatcaaaagctttctctacttctttaaattccctactcatttcattaatgaacttcttacgttcctgagctttcacatcaagcttatctaatctagaggttaatcttataaacagacctttgatagcctcaatttcatcataatctaccttgagtatacctggggggagcagaaaaaaatttaatagaacttggaggtctttcctaagcctatacaattctaaatataatgaagacttttcctcatgcaaatcaaaaatattgctttggatccctttaacctgttctccaaaagtggtaaaatttcttctggtttctaaaaatctatctcgaacaataagaaatttagtcacttcgtcttctaaagttagccatttctccatgcaattgataaatttaccctgaagctcttggcttagatcagagaaatctttcgtatggaactgaaacagattttgcaacttttcaaatgttacccgcaactcagagatgtcattggggatctctttcttatgaatcaccaaagaatctaaatcttgatcataataatctaaatcttgacgagtcttgtgtttgtgacataagaaaacaataagagctacagccaataaaacaagacctatgcaaagtatgggaagcgccgctcctaaaagaactccgcaagacgtatgaacaaggaatgcaagagaaccagataaaaagaaaatcccaaggataaataaagcgacaaccaccacagtagaaacgtgcgaaaaatacatcctttagaatctacacgttgaggatgtggagcaggaggtatgttacaataggtgggacgctcatagtcttcctttaatccaagaaatcatcgtgagcatcttcaaacacactatcattaccatctaatgattcgctctcactcaacaaatccgtcgtagatgcaacaaatgccacatttgctctgacttgatccaatttaactctaagagtcttgcgaatacgtgcttttaaggcctcatactcctctaagactttctcttgttccgaagagaaagtttgagttaaaaactgctcaacaatacgacattgaacttcataaaggcgcaataaatgatactgaataagagttggttcacaactcagatcttctactaccgatttcctgacttgaatatcaagaagttctgctttagctttatctagtgcttcttgcagctcttcttcagaaaagacggttctgtgtaaagatgctaatttttcttcaaatgcactcacaacttcttcgaaaagttgaatctctttttcaacggaaagccttgtttttaggacttctaatagttccctcctataacttcgggaaacacctccagtttctctactttccttttgtctcgataacattcctgttctatctttacgtcttttaaagcagatttaaacttagtcaactcacaagcaagcttcaatccagatttccctactttcatgacttcttttcgaagcttatctatttcacattgaaggcgatctccttttttccttaaaaattcaagaggcccccagatattctttaactcagtaagtaacgctacatcccttccgtctagttccttccaaatcgtctcgtatttttcgacttcacgtccaaacagaagaagatccccctcaaatgtagcgaactgactcttatgttgagcgacaacctctttaaagtcctcccactcatctaatagaaaattgctccattcctgaacttcattaagctcttttctaagatctgcccacggttgatattctaaagtaattttttgttctaatgatctcgtggcttctgaaagtttccggtgataagagacaaagaaaatcagccccaaaatcaagagtaaacttcctaagaaaacacctgcgcccccgagtcctacagtcaagacagaaaaactaaaaatagcatttacaagcaagagcatccccacacataacaggagaacacccaagacaatcaaagatacagaaaggatcagagacttatatttaggtggatgaactcctaaagttgaagagggttggggggacggagacgggaaacaatcacgggcaatagcgctagacataacttgctttttacttgaagttaactacttaatttccatacacttatatgaatgaagtttctttttgtcaacaaaccagtaatacaaacattttaataaaaatttataatatttgtattaaaaccaaataaatcaataaacaatagccccgtttattaaacaaagacactatcgctataacgaaatttctccgctatcctcagcttttcttcaataattcctagacgctcagaaatcgcactcatgtctctctcagattcaagatcctctttatataagggagtttcatattgaggaacctctttttcaagatagagagaaagtacatcaggaacacgtttctcttgagataagagcaaaatcaggctaaaagagaaaagaaaaagagcaaaaatcaagcagccgagtcctagagtaaaagcagcccccgcagaaagtccaaccagacctatatccaaacaaatgacagataaaatggataagacaactccaagaataagtaagccccccgccactatataggagttgattctcaaagaagtgtcttcaggaataaaatcaacttgaatacgatcaaatgtcacaggattcatggtgcgtgccttgttctagatttttcgcaccaaagatgttatcaattatttattttaaatagcatgcaaaataatacaattttgatttgatgctatcccctaagacatatccacgaaactctttaaccatgcacgcacaagcttcatatagcgttgtgcgatttacacctcgagacatctatgactgggaaggatttccaagcatcatctacaaataaaatcctacatatcttaaactaaaacgaaatgtatctgatctatgatttcactaaccaaaatgctgcaaattgaaaggatttttatctgtgaatgaattaatttttggattccagactttctctgttgtagttttaggagttttctttgcctctagaggaaaggcttggcttacaggatggctatcgctgctctcaagcatcatgaatgtctttgttctaaaacaaatccatctctggggttttgaagttacgtctgctgatgtctatgtgattggtttgcttacttgtctaaattatgcccgagagcactacgaaaaaaacgatatcaatgatgctatgctatgctcctgggtcatctccatagcgtttttggttctcacccagctacacctatttttaatcccctcacctaacgactcttctcaagagcatttcttagctcttttttcttctactccaagaatcgtagtagcctctctggtcactttaattttcgttcagatcgtggatataaaactctttaccttccttcaacgagttttttcaaagaaatattttgcaatgcgctcaacaatttccctgctcttttctcaactcattgataccataatattttcatttttaggattgtatggattggtcagcaatctttgtgacgttatgatctttgcaatgctagtcaaaggcattgtaattacactagctataccgactctaacagtaactaaagccgttttagatcgtcgttcctcttaagctaagaaattaacagcttcacctataccctctaacatcctttcggtaaaggagaggttctgcacacaagtaaaggttgaattacaatagagaagtaggcttagaattattgcgacaaggaaagcaaggaagcaccctataatatcaaagacaagaatcagaacccctaaacctaaaatctcaataacagcttgaagcacctcgaatctgtacttcattttatctctaggatggatcggccctgaatgcgcttctatcaatcgaatgattccaccaatggtagaaatgataggaaggctacgatatagcctatggtgtattggagtcttcttaaagtcatgaatacgataaggagtctctttaagttctgaatcaacaaaataccttccctggaccaaagctcttaaagacttaggccaggaggaagctacatttgcaaaatcttcataagattcgaaaaacacttttttagacaaaaaaattaaaaaacaaaacaaatatacattattattcattaaaataaaagttttaaaaagattaattttcttaaaacaaaatatccccaataaaatattgtacctaccagcgcctatccgtattaagacccaggaattcagaaagctcctttggagtaaaagaccctactttaaatctaagaaatcccaagctagggtcagataaaacaaaccctatttacttaaaaattttgtcattgtaaacttcctcttccctaaaagacacatccaccttgttctttatagttaaggatctagtttggcactcaaattccatctcatccatcaatctaagaaatcccaagctagggtcggacaaatagagaccagccatggagtgatcgatacacccgcatttgtccccgtagcaactcacggagctttaaaaggagtgattgatcacagcgatattcctctgctcttctgtaatacctaccaccttcttcttcatccaggcccagaagcagtagctaaacttggggggctgcaccagtttatgggacgtcaagcaccaatcattacagattccgggggatttcaaatttttagcctagcctatggttctgtagctgaagaaatcaaaagttgtggcaaaaaaaaaggcatgtcctctctagttaaaattactgatgaaggcgcatggttcaaatcctatagagacgggagaaagctattcctctctccagaactctcagtacaagcccaaaaagatctcggagctgatattattatccctctagacgagcttctccccttccatacagaccaagaatacttcttaacttcgtgttcccgtacgtatgtctgggaaaaacgttctttagaatatcatcgaaaggatcctagacaccaatccatgtatggggtaatccacggaggcctcgatccagaacaacgtcgtattggcgttcgttttgttgaggatgagccattcgatggctctgctatcggaggcagcctaggaagaaaccttcaagaaatgtctgaagtggttaaaatcaccacttcatttctatcaaaagaacgtcccgtacacctattaggaatcggcgatcttccctccatatacgctatggtcggctttggcatagactctttcgacagttcttacccgactaaagctgcccgtcatggtcttatcttatcaaaagcaggacccatcaaaatcggtcagcaaaaatatagtcaggactcttccactatagacccctcgtgctcttgtttgacctgcttgtcaggaatctctagggcatacctgagacacctttttaaagtaagagaacctaacgctgctatctgggcttctatacataatctacatcacatgcaacaagtgatgaaagagattcgtgaagccatcttaaaagatgaaatctaagtctcctttctaaagattccacatctaaaaaactctaatttttccatttattttcaaaaaaatctgtaaagatttctttatttagatcacaaaatactctcttatttataagaataaaaaaaattaatttttattaaaaaataattaatttatcggattttaaaccaactttttataaaattgattctatagttttttaaaaaaaaagggaattttttatatgtcgaaggaaagcattagaagttattctgaaatttctactccaacgccgatattcagagaaacgccctcgaaagaaggcgtggcatataaacttcagcttagatcaccagctaaagactgcatactcaggaatagagtatctctaaaaggagctctattaagatccattccattttacggatcattcttaggtgctaaaagaatccatagtgcctggtctgcaaaagatgccccctgcacaactagagtgtatcactacctagtcggtgggcttgagttattgggactcggggtttgttgttctagcgtgtaaagtactcgccaccgctctaaagtttttattctctaaagcctcctcgaagataaaacaaatgaaatggcgagagaaagcgcgcaacctagcagccaaagatacggtacaatcaataaaagagttctgttccgttgatcttacatcttgctttacaagatgtttcaggcttcgaaatagagtggtagaggaaggtgcatctgaaaaccaaacagtaagagagatcattgtataatctcatagttttctatgtattcttaaacaaggatatacgcctataaaatcgcaagaaaactttctcatacttcaataaagaaacgaagtacctatacgtagcagctactaagaaaaaaggaatccccacttctcttagtagctgctattattataaaacacgtaatttaataacgtagaccgcctaaccccatagcattgtcttccctcccacaatagcgcacagaatccgaaaattataaaagtcttaattatgaagaattttaaataaatgattgaaaaactcgtactatttcaaagatcttagcattttataaaacaagcgctatcttcataatccgctttatataaacattttattttatctaaaattagattaggatgcactacgttacaagtatgaaataggcatccaaatggtaaacagatacaagagctctgcagaattttccgctgatcattactatgatgacaacctggttcggatggggtataaaagaaacttaagaggactagctcctgtggagaatgaagtctgtctttttgaggagaataacctactcgaatctgtcatggcgtctataccaattatgggatcgatacttggcttaggcagacttcatagtgtttggtctacacaggaccctaaagatagtaaaatctctataattttccatactgcacttggaattctagaaaccctaggtctaggaatcattgttctccttattaaaataacgattactattctccttattctatttactccatgtcttctctgttatttcatgtattcctgctgcttatagtgattttcatcctatttagttaggttctaacattctctatttaaaaaaagctttgaatgttcctttgacaagtagacgagcaacctaaagtttccttcggagaatcacgagttttttcttcaggttacatctcagttttagaggaaactaagacgtagaacgtttgtgttgcgaatccatcttaatcatgaatgattctcatatggcacaagcagttctccaagctctctaccagtaagaagttgggtataggagctttggctaccgtaggctccaatctcacacacgatccttcggacaacttgtaaaactcggcatactagcattagggtctgaaacatcctggcatagaaagcttctctctcgcatggaaacaagtcgtttcagaattcatgattctagctgttttatcgagccaattctgtaaggtgaaaagtttttaaaaccttgggagaagttgcgagaattaaatgcttttgaattaactcaacctgaagagtatcgaaaccgttgggttttgatgccttgtcttaagtgtcgtttttgtagaacgcaacatgcaaaagtctggtcttatcgttgtgtccatgaagcttctttgtatgagaaaaattgttttcttactttgacttatgatgataagcatttacctcagtatggttcgttggtaaagctgcatttacagctgtttcttaagagattaagaaagatgatttctcctcataaaattcgttattttgaatgtggtgcgtatggaaccaaattacaaagacctcattatcatctacttttatcatgacataaagatttttttaaaaatcttaaaaagaaatgacctaaggactgttaattatatggaatttttattacgagtttcattaaaatgttcggctaaaaagttaaagtacgatgctaataggcagatacagtagtgatgaccaattcactgaagcaacaaaaaacaccccaaccataattaagctaggttttgttagagataatctcgagggattaacgaaccctatctctgaaatcgtctcggaaacctcctcttctattaaagattccgttcttcgctctcttcctattttagggtccattttaggatgcgcccgactttacagcacactctctacaaatgatcctcttgacgaaactcaagaaaagatttggcacactatatttggagccttagaaaccttaggcttagggattctcatcctcttatttaaaattatttttgttatattacactgcatatttcatctagttattgggttctgcaaataacaacaattaatccacgcctacggcgtaattaaattgtatctttttagaaaaagacaagcgtataatatacatttaaaaatcctaaaaaaaataagaaaatgaagccaaatagtattatttttttagaaaatactaagcattatcccgacatctttcgagaaggatttgttcgtgatcgtcatggactaatggaagcctcggattggttactttctacggaaattacgatcattcgctccattctgggagctatccctattttaggaaatattcttggagccggacgactctatagcgtttggtatacaagtgacgaagattggaaaaaacaagtggtttgacacacgatatttggaatcctagaagttcttggccttgggattcttgctttagcattaaagattctcctaaccaccatttattacttgctacgaggcctctggaacgtttcctttatgcttatagagatcttttccgcactggtccctaattatccagtacttgtttaaaactctttcacaataaaatttttacttatgactaaaaatgctataaattcacaaacaacaaccccacaacccaatttaacagacgcagaacctatcgctagccgtgcgcaatgtaaatcaatagcggtaatcattagtttgtttgctctgggaatgctcctactctgtctggggataatccttatttccatacctattcctggacttgctgcacaagttgctctcggcctcggaatagtaagtttaatcttaggaattgctttagccaacataggtttcctatgtttattacttagatgcaagcagttccccaaaaacccgatacattgccctctgaaagctctaaacagccttccgagggaagcactcccaccgcactcccatggcaagctggagaatttttagaaaaagtacaagtatctgcaacccctatactccttcccaagaacaaagatgaagagttatcagcaaaagttatgaaagaaggagccgaagcagccttcttcaattaaacaagctgttctagaatctacagagaaattaatcgatgctagaaaacaagaggagagccgacgagaggctaggaaaaaaatcgtggcggaggaggctgaagcatctagaaaacgtattcaacagcaaatggcagccgaccaagaagcgttaagaaaacgaaaagaagaagtagctaaaagaaagtaagctatttttaatagaaaaagaatgccatactatgcaaacaccctggagttcatccagggaactcaaagtctatgtcctttaattcaaatatgggtttgtaagacaccattataaaggacaactagaaatcgaagatgcttctcacgactgggatttcttagaacccccttctacatggaaacgcactctccttgctgcaattcctattctaggatccgtcataggtctaggaagaccctttagcaatctggtccattagagaaccccaggactctcaagaatacaagtctatattctggcacactctatgtgctgtcctagaaattttaggactcgggattgtagctcttattctaaagatcttagcaacctttattatggcaatgccaggtttaaagagagttgcaactttcctattttattcttaagagttacaaattctttaggcctagaatcgtctaccctatcctctataattttttgtaagaactaagagacatacaatggcaccgaaagcaacaacagacgccatagggatcgtcacgtagctaaaaagaaagatctttgttgagcaggagactctaccgcagatatccaattgcatccctggaatttcttgcaagaaaacttggtagatagaaatccctaagcctaggactgcctgaggaaggatatacagtttgattgaagagtcctcgcgataagctgaaattcctaaaattacagtgagtgggaacagacagattctctgatagtagcaaagaatacaaggctctacgttaagaatatagctataaaaaatgctaatcaaagtgccagcacaagaaatagcccaagcaaaatataaagcatagctacggataaaattaatcatcatgatctccttcaacagcttgcagctgacgaatatgttgaatcgctctttctatttcatgaaacgtaggatcttcgattaagtagtctccgactacagccgttggtgttgctaactgtcctcctaaaacctgagacccgtatagattattcttcttaatctgctcgttatactgtcctgaagcgatacactgttccaagcctttaggattaacactacgtccagaatttatttttaaaccctcagccaactttgtaagaaacccaggagtcacccaggccgggagcattcctctttaggataagtcaaaatacgatggaaatattccatataagcgtctatatctgcctgacgtggaatcgtgatgataaatacatagcaatgcttgagctgcaggtttagacccgcgaataaagcagacaggaatcaaagtaaaagaaatctctccagtatcaatatagtgcttctttaacaaggggaacacttcagtagtgaattctgcacaagcagaacaagaaggctcctcaaatactgttatgtttataggagcataaggattccctatggtaggaaagtgttttgcatttgtaggaatatgagctttagggggtagaatcgtatgttttttatgtattagaaagccaaagcaaacgataaaaaacatcgcagtgcacagaactagganctttttattcaaaggactcgtaaagagaatttgttaattgcttaatagaacaaaaaacataaaattcaaaagcgttttcttttttganaattgaacaggaaaacttttcctttaagtttaagaaatccgctctatcttttacctataacaccgcaaatctcactaaaagtactttcacttttattctactgcttttattaaggaaaaaagatcagggcctaagatttatggataaagaaacactagaaaatatctatcgacattttcgataccgttttttaaaactcaatatcctccctgcatttcttggtctccttcttctatgttctccaaataccctaaattatacacaagtcgatgtcatcttctctgatcgtctttgtagttgtttacttattttcttagctattgcttccctaaccaaacgttctcttctctggttaggagccccactaggcatctgggttacccttttcgcctgcgttgcagacgatctcctactatttttgcaaatgatactctaattggattcgcaattcttgccgtagtgtgtatttcccctacacgacccgaagcccttgaagtaggcccgacattacctgaaggtttttcttacaatccttctgcaggaggacgcagagctgcagtactattcctaagcttactggggtggctagaagctcggtatcttactgcttccagcttgggaattacatcgagtcagtcttcgaacttcttactattgtactcatctataatgactgtatactctctgctcgtggttctctctctagcaggaagtgagcgccgctggcacacaagaccaaaaatcgtaatagcgacagcttagctttaacaggcgtcattattttaactcttctccctatcatcctacaccaactgcgctatgattgctggctatgctttgcctaactatagaacctgctcttgccgtggtctttgcttacgatgaaaccagggccactttgcgctatatttctcaatttttaggagataaacgagctcttactagagcctcgttctttggatcagaatactataaacacactctgtcttgggaagaaagaacagtacgtcctctacgaaaggcatataaacaggcatttgaggggatctccttcccaatcaaccagttattggctatcctagttgctagtttttgtaaaagtcaatagcagtatgggccttcctacctttcctagnnatttcctcaatatatgttgttggtttattatcgtcctgttcatcttagcttttgcagaaagccttcgtcatttgcgttggatgaatctgatcttctctgcagcgattttattctctccagtactctttcatattcccgtagaatctcccatgttcttgccgatcatcgttacaggactcattctaattattctatctataggaaagagacgaagaactaaacgcaaactctaaaagagaagcttacgtgcctaacccctcccataagggattggtttttgaggcgttttttgcttctttcttagcttcgcgttcgtcacgcttttctctttggttcttgttcatgtagatattctccttagcacgctctaaagctttttgtatcagctcatcatgttttaaagattcaggagaatccttttttggaatgattttaagcgtcttacctaagatcatagaagagaatcttttgctatactcaggtactagcacctgagattctatgtagagagaaagagctttcttattaggagttttcttttctttttcacagtggtcatagatttctttgtaattgctctgtgtaatcctctcatggagagccaacacttgcttatggtgggaataagcatagatattcaaaggcaaaacaagaagaacaaaaacgagaatcgagggtaatagccagggaagaatcacatcataaagaatagatgcaccttccagaggagcacccaaaagtatagatcctaaaacaaaaccaaaaatacaaaacatgagaagtgctgctgctaaaattatagcaggagccccatgccaaatatgattaaaggctttcttgtagcaagctactttctcctccccagtaagtacaacataacggcttaaagaagaggaagtggtgaccagaggctgtgaactcatgtatataagtgcttttttaaatctttaatgaaacatagcccattatttaaaggtctcattgaaggatccagaggaacaggagtgagtgttttgttcttaataacgtacaagacatcccctaaacaggaaacgtcatgaaagtcgtgagtgacaagaagcaccgtcttattttccttctttgctaaagcaacaatatcttggtagagctgttctttaagcaatacgtccaaagacgaaaaaggttcatctaaaaggagaataggctttaaagacaagcactgagctgcaagagcgatgcgctgcctttgccctccagaaagttcgtctggataacgatcaagaagctgtccgagatcaaaattgtgtataatctcttcaaggcgttcattggataaggcgttgtgacttgtattgatgccaagctccgttgacaacgtcatgttttttaaagccgtacgccaaggaagcagggcttctttttgctgcatataggcaacgtctttgcgatttagagggctcccattccatagaagttcgccttcttgcaaaggtaggaaacccgcaagcaaacgaaacaaagttgtctttccaactccagaacttcctaaaataatcgtaattgtccctggagacgcttggaaagaagcatcctttaaaatgacttgattgtcacaagaatagcatagacgatgagcttgtaacatggaaaagcctctatcttgaatagaaacgaaggcttgcggttaccaagacttgaacttgggacctcgacattatcagtgtcgcgctctaaccaactgagctataaccgcgatttggagactaggagattcgaactcctgaccttctgaatgcaaatcagacgctctaccaactaagctaagtccccggccatcccaataagggaaaagtaaagaatcatcttacctatcaagagatttaagctcaacaaagaaagtataggaaaatctcaccttaatgagaagaacagagttcttttaatacactcttgagcaaggtatccatataaattttacttgcctcactttgaagatgcttccaatcctcgttactccgtgattctaaaggatgagggagaaggatattcacacctaaacaaggaatgctatattcatagcatacctgagaaacagcgccgctgacactatcaaaaccatgaatctctggatacaatttttgtaaggaaagaaaatagtttcgcgacatcgcgaaagactcgcctgtagcaaccaaaccttccattaaggtgtgctccgttttggttgttgatttcaaatacccatgagtcttcaaaagctcttcgatttcttgtttatgggtagaaataaactcttcgcctccacgaagaattgcctcccgatgaacctcactggttgcaaaaacactctttttaatgtctggaatctcaaatctttcaaagaaaggcctcacatctgcatcataattaatgtagcctttagaaactaagacgctgccaaaacggctatcttgagacctagagtaacacgagcctataattagaataagatccactcgatgtttaagaatcatattacaagccacaacagctgaagaaactttattaggccaaagagcagaaactacaaagtatttcccaaaggagtcgccagagtaataaattctctgtccctctagagtctttttactatgagaaaaccaaggaatagaacaattaccatcaaaagaaacgggagtaaccccaggtaaagcaaaaataatacttacacgacttaaaggactctgtttttcttctagaatagtgaaattatcagcagagaatgcgaccaaaggaagagagctaagaataagaaacagaaaacgacgcataagaaatttcttctaagttaaagatactgttttcgcattgtataagaaaaagatctgttaaatagaattaaaaaacgaaagtacgcttctttttaagctctagatactcccttaaactcttcttaactctgtcctttgttctttaatgacacatccatttctactactataaaagtactgacaaaagcacagagtacgattttcaaatcgggagtctcaagatgaaagaagatcccaatctcttgaacgtaagaccttcgagaaattcttagcaaaaagagaagaactttgcccaaaaacatagtccttgctttttctcaagaattagagctttcagatgcctagtatattgagaatataaataaaaaaaccattgccaacccggcaatggttcttaaaacacaaatccaaaatatagaatcttacagactcactttctttttcactgaagaaggaatcgttcttggttctcgtattttagtaattttaaaagactgagaaaacgcctcgtattctttatccaaggcctgaggattcttattcttataaaccataaagacttgataaagagtgtgatttacggaaatcaacatccctctgaaataaacatcttcgcaaacaatccaaaattccaaagccttatggccttgaatctgccttgcttgcatgaaaagaacctgggattcagggagagcctgcatcatgcctgaaaacccctcttgcagattgagctctggacgacttatatctactttttcaggatactcccaaacagagactacatacacagtgttgtctggatgagtctctgttacataggtatcataacgtatggtaatctctgattgagggacttctacaatttgccccgaatgatcaggctccccaggaaattccacagaaaacccagaacttgatgtatagtcatagcgtttccatgaaagactgtctttaactggtaaaattctagcctcttcctgaatctctttttttgagaaccatcctttgactttccctaaaaaaccagatttagcttcgactcccataccagggatagggtgaaaagctaaaatcgatactactatggataataaggcctttttgcaactctgcaacataataaactaaaaaacaaaacaagataactaacttaataatatcccttcgagatttttattttgtaaaataaaatacttttttttcagaaaaataaaaaaaatattgcgttttataaaatgcatcacaataatcctggtagtcttaaacacataagtttttgttaggtatctccttatgaagccggaagagtctgagtgtctgtgtattggagttttgcccgcacgctggaatagcagtcgctatccaggaaagcctttggctaaaattcatggaaaaagcttaatacaaagaacttatgagaatgcttcccaaagttctctattagataaaattgttgttgctactgacgatcagcatattatcgaccacgtgactgattttggtggttatgcagtgatgacttctcctacatgttccaatggtacagaacgcacaggtgaagtagctagaaagtacttccctaaagctgagattattgtaaatattcaaggtgatgagccttgtctaaattctgaggttgtcgacgctttggttcagaagttgagaagttctcctgaagcagaactggtgactcctgtggcactcacgacagatcgtgaagagatcttaacagaaaaaaaagtaaaatgtgtttttgactctgagggaagggctctgtattttagtcgcagtcctattccttttattcttaaaaaagcaaccccagtatatctccatattggagtatatgcttttaaaagagaggctcttttccgctaccttacagcatanctcanntcctcgtaagcgatgccgaagatcttgagcaattacgtttcctagaacatggaggcaagatccatgtgtgtatcgtagatgcaaaaagtccctctgttgattatccagaagacatagctaaagtagaacaatatatcacatgcctttcaaatgcatatttttaacaggaggagttgtctcctctttaggaaaagggttaacagcagcatccctagccctaattttagaacgtcaacggcttaacgttgctatgttaaaattggatccatatctaaatgtagatccaggaactatgaatccctttgagcatggagaaatctatgttacagatgatggggttgagacagatcttgatctcggtcactatcatagattctcttctgctgcactttctagacattcaagtgccacttcaggtcaaatttatgctcgtgtcattaaaagagagcgtgagggtgattatctaggaagcacggtacaagtcatcccacacattaccaatgaaatcattcaagtcattttagacgcagctaaagagcactctccagatgttcttattgtcgagattggagggaccataggagatattgaatctcttcccttcctagaagcaattcgacaatttcggtatgaccattccgaagattgtctaaatattcatatgacttatgtcccctatttacaggctgctgacgaagttaaaagtaagccaacgcaacactccgtacaaactctacgtggtattggcatcattcccgacgcgattctatgtcgttctgaaaaacctttaactcaagaagttaaatctaaaatcagtctcttttgcaatgttcccaaccgggcagtgtttaacgttatagatgtaaaacataccatttatgaaatgcctttgatgcttgctcaagagaaaattgccaatttcataggggaaaagttaaagttagctacggttccagaaaatcttgatgactggagggtactggtaaatcagctatctcaagatcttccgaaggtaaaaattggagtcgttgggaagtatgttcaacaccgagatgcctataagtccatattcgaagcactcactcatgcagctttaagattaggtcatgctgctgaaattatccctattgatgctgaagatgaaaatcttactatggaactctctcaatgcgacgcatgtttagttcctggaggcttcggcgttcgtggttgggaaggaaaaatcgctgcagctaaattctgtcgagaacaaggcattccttattttggtatttgcctaggaatgcaagtgcttgttgtagagtatgctcgcaatgtcttaaatctggatcaggcaaattccctagaaatggaccccaacacccctcatcctattgtatatgtcatggaggggcaagatcccttagtagctacgggaggcaccatgcgcttaggagcgtatccttgtctattaaagccagggagcaaagcccataaagcatataacgaatcttctctgattcaggagcgccaccgccatcgctatgaagtaaatccggattacatacagagtttagaagaccacggcttacggatcgttgggacttgtcctccacaagggctttgtgaaattattgaagtttcggatcatccttggatgattggtgtgcaattccatccagaatttgtatctaaactcatctctccccatcctctatttatcgcatttatagaagcagctctagtctattctaaggatgcaagccatgtctaagccatctagttgcaaagcataccttggcatagactacgggaaaaaacggatcggccttgcctatgcagccgaacccctcctattgacactaccgattggaaatatagaagcaggtaaaaatcttaagttgtcagcagaagctcttcataagattattttaagtagaaatataacttgtgtagttctagggaatccccttcctatgcaaaaaggtctttactcatctctgcaagaggaagtttccttacttgctgaggagcttaagaagctttctacggtagaaatcatcctatgggatgaacggctttcttcagtacaagcggaacgtatgttaaagcaagattgtggactaagcagaaaagatcggaaaggaaaaacagattccctggctgcaacattaatcttaacaagttttctagatagcttacctaaaaaactaaccttgtaatcatcaaaaactacgggattttaattttagaaactttttactttttgttattttcgcaagtgcggggacaaaaaaggagataaaaatgacgaatgttgttcaggaaactataggtggattgaattccccacgaacgtgccctccttgtattttagttatctttggagcgactggagatctgacggcaaggaaacttttacccgctctatatcacctcactaaagaaggacgcctttcagaccagtttgtttgcgtaggatttgcacgtcgagagaaatcgaatgaactgttccgccaagagatgaaacaagctgtcatacaattttctccttccgaattagatattaaggtatgggaagatttccaacagcgcctcttttatcatcgctcagaattcgataacaatatgggatatacatctctcaaggactccttagaagatttagataaaacgtacggaacacgtggaaatcgtcttttttatctttctactcccccccaatatttttctagaatcattgaaaatttaaataaacataagcttttctataaaaatcaagaccaagggaaaccctggtcccgtgtcattatagaaaaaccttttggaagagacttagatagtgctaagcaacttcagcaatgtatcaatgagaatcttaatgaaaattcggtctatcatatagatcactatttagggaaggaaacggttcaaaacatcttaacaacacgtttcgccaatacgattttcgaatcgtgttggaattcacaatatatcgatcatgtccaaatcagtttgagtgaaacgattggcataggatctcgcggcaatttctttgagaaatctgggatgcttcgggatatggtacagaaccatatgatgcagctactctgtttactcactatggagcctcctacaacttttgatgctgatgaaatcagaaaaganaaaatcaaaattcttcaacgtatctcaccattttcagaaggttcttcgattgtccgaggacaatatggtccaggaacggttcaaggagtctcggtccttggctatcgtgaagaagagaatgttgacaaagattcccgagtagagacctacgtagctttaaaacagtcattaataatccccgttggcttggagttcctttctatttacgtgcaggaaaacgactcgccaaaaaatctacagacatttctattatttttaaaaaatcaccctacaatttatttgcagccgaagaatgttcacgttgtccgatagaaaatgatttgctaatcatcagaattcaaccggacgaaggtgtcgctttgaaattcaactgtaaggttccaggaactaataatattgtccgtcctgttaagatggacttccgttacgacagctatttccaaactacaactccagaagcatacgagcgtttattatgtgattgcattataggggatcgtacgtttatttacggggggggatagaagttatggcttcttggaagctttttactcctgtattagaggagtgggaccaagattcctcaccctcgtttccaaactatcctgcaggatcttcaggtcctaaagaagctgatgctctcattgaaagagacggaagaagctggagacctttatagacaatcttatacagcatctagaaatcgataagcatgacaaacatagggattgagactatggcaacactgataaatttcaatgatacgaacaaacttttgcttacaaagcaaccttctctatttatagatctagctagtaaagattggatagcttctgcgaaccaggcaattaagcaacggggagcattttatgtagcattatctggaggcaaaactcctttagaaatctataaagatatcgttatcaataaagacaaacttatagatcctagtaagatttttctattttggggagatgaaagactagctccgataacatcgtcagaaagtaattacggccaggctatgagcattctccgtgatttgaatattcctgatgagcagatctttcgaatggaaacagaaaatcccgatggagcgaaaaaataccaagaacttatagaaaataaaattcctgatgctagctttgatatgattatgttaggactaggagaagatggtcacaccctttctcttttttccaatacctcggctttggaggaggaaaatgaccttgtggtctttaattctgttccacatctagaaacagaaagaatgaccttaacctttccttgcgtacataaaggcaagcatgttgttgtttatgttcagggggaaaataaaaagcctatccttaaaagtgtcttcttttctgaaggtagagaagaaaaactctatcctatagagcgtgtaggtagggaccgctcacctctattttggattatttctccagaatcttatgatatagcagacttcgataatatctcttcgatatataaaatggacatcctctaaaaaagataggcgttgcgatttagccgtagatagtatcgtaagccggcggtggaaaaggaggaggagcactaggcatggtaggagccgtagggtatcctgctccaaaatgggatcctgcaaagccccctcccccaccaaagtgacttcctccaaaattaccgtttcctcctcttctattctgataatcagaggagcctccataatgctgagatggtcgagaacctccaccaggagctcctccttgaactaactgagcaacttcttcgttagagaagaggtgtccataatgagacagacagtctgtgagaaataggtctcttgccaatgcatttgtttggaaatgagagggatcatgtagcagagcctcactaacggcagtatgcaaaacaacattcgttaggtgacccacgcatgcctcttggtgctttgccttacgaactatagcaatccatagtcctagcagagaaattaacagagcgcctccacctgcagcgcagaccccatcattgccgcagtaattacgggagcagctccaggagctacaaaaaataatactaagacaatgccagctgttaaggctattaaagctaaagaagctattaagctaacgactaaggaccctatcatagcactcttatacaacttacacgcttttacagcctcttctgatgaccttatggttgcaacacctgcagctcgatggaagacattttgagcaggatgacgtaatacttttgccttcgccttattcagagagtaaatcatcttcccaagcgtataaactttataagcacaataaaccagggcacctaatgtcggtcctaggataagagcaattacgaagaaaagtagtgtagctcctaaaacgatcgctgatgtctctttttctggagtttgacagctcttacattgcgaaaagcacataatcaatattccgaagctattgaacaaattccccaaattctgcgcantttaaaccctgtcatcatcatgtcggttggtctatcaaatagagattcaatatcaggaactcgtcccttcatgatctcactaaacattacttctgtactctcggaaggagatacaaatttgttttctagaaaataacagaagttactgcgcaccactgaattagctttaacaacagattctgaggaaggggaaaacaccataaaataaaccaattactaacaatacattacttactaacgataagtatttagctaagggctctcagccttaagtaagttctttgtttattaacagaagtattttatcttaatgatttaaaaacttcaactctcgagactgattttagaatcgtatttaaaataatttaagaattttaataaccgattgtttgaacgaaaaacttaaaaacttaaaaatttaaatttataatttagataaaaattaaaaactacagcttgcctattgctaaaataaataattcataaacacaatgcgaaacttcgttataaaaagcacatgcaatctagtcttaaaacggtgattataaaaattagcgataataaggaggaggagaagaagagggaaaaggagaattcgacgagtctatcgtagaataggccggtggagattctctaggaatcacgttgctgctaccatcgctcccctcctcatgaaacagagtctcgtaacttggaggtggcgtcgtctgacggttcaaggggacttcgctctcgatatctctatactcgtcatcactgaagaactgttggtatcttcgtatagactgagtaagcacttttttagttcctggagtgataggaaggtagggcatctgaataattgtgttactcactatacaacgcaatagtgcggtatgcatatgatgaacaccttcttggcttttctgcacgctatacacagaagcaagtaaaaagcctattacagagaggaggattcctgttcctcctgcagcacagcatcctatcattgctgcggtcattacagcaggagctccaggatctaaaaaaaatagagcaaaaacaaggcctacaattaaagctgctaaagatatcgtaataattaagccaagcacaaagaaaattaatgtggattgtctaaatactttacaagccttgattgtagattgtgaggcggcagcggcggctacagcccctgaacgatgtataaaaggatctgatttctgtacggaatttatgacctcagtgtgggttcttgataaagaggatattttcttggtaagttgataaattttatatgcagagtagcacaaaatgcctagtgtaggcccgaacacaatagctaagactgtaaagaggacagctgcgaaaataccggttatgagtgctccacagggatcagtgtgatgagaatctgtcactaacaacaggggacaacaccctattccaaatattttttcaaaaaatctctgataaatcattttcaagctgatattagaatacacttgaaagtgatgttcgccttctgtctctactacatctttcaaatcatctataatagcagttgacgaaagtgttcctcgggctaggaatactttaatcggaagaatctctgtgttatgttcaacaaattcgtccatagctaaagatactaggacgtcgcggacctgtgtattagaagcaatgcttgcctcatgtgaagaagaaagagaaatcatggcagacataaattttaccagaaaaatttatcacgcctctttgtttaaaaatagtcattttttatttaatgcaaggaagaagagtttccttggtctatttaaaaagacttctctttctaacgaagcgagctcatttccttaaggtttgattaatccagacattcctgccaattgaagaatcggggcttgcataaagactattgcggatgagagtctagcgtcctcactagtcctatgtgaaattataaatccgtgaattgcggttcctatgactgggacgattaacaagcacgcaagtagataaggaaggccaccaccatagaggcatttaaaatgtgatcccagacttactctttccccaggtaaagcactcgatgcactacataacttaaacggaaatgagagaagtagaaatagaacctttaaaatcaacaaaactacacttacaactgcacaaactacagcaattacaggatacaacatagtatctacaactaaacaagccgtttttcttactcaagggttcatcatcataatctccttgagacattctaaaaaaaatagaacaagccataagaataaccgttggtttctgagaaaattgatataaagaacaatattttaaagatttttagttttaattggaataaaaattctaacccttccccctctaattacgatgtagttgtttaaaatatttttaattattagaaactacttgttattggtccatgaatataaaaatagaggtctttctagcttagaaaaacccctatctatagttattaccaatttataatagcagttgatcccacttgataagcaggagatataataaagtatcttaaacgattagtatccgattgtactgtaataatcgtgctataaattagggtccctatgatcggaataagtactaggcatcctaaccaatctgatggacctggtttatcctttggtccaaacaagcattgaaaattctctttacacgagggcagaggccttgatttacaagctgcaatacaggtattaacaaggaattttatagctaaaaacagtagttttactaccatcaagacggcaaaaacaactgcacaaatgaccgccataaaagggtagagaagaatatctgcaactagagctactttcgacgcaacgaatctgtcgggctcgtttgcattacacacatgataaccaatagaacaagccattattatcctccctttaacaaattttaataaaaaaactaaataattatagtttatttattaaaaaaaataaagttatattctttactatttccccgttcaagccaaagagacctcttttcttttaattttcttgtttttctatatttacagtattttgaaaagatatatagtagtcctagggaaaatcttgggactcataacgatccaattctatcagaatctaggtggaatgtcttcggagcgctatagtgctttgcattctaggaaaagtctctctgttttaccccatgtcgtacgaaaagtattgttaagtttccctgattttaggggtaatggtgacgtcaatttaaggaacattcgaagtgactaagggctctgtttttattattatggggcctccaggctcaggcaaaggaacccaatctcaatatcttgccaatagaataggcttaccccacatcagtactggggatttattaagagcgattattccgagaaggaactcctaatggattgaaggctaaagcctacctagataagggtgcttttgttcctagtgattttgtatgggaaatactgaaagaaaaactgcaaagccaagcctgctctaaaggatgcattatcgatgggttcccgagaaccttagatcaggcgcatcttctggatagttttcttatggacgtccattctaactacacggtgattttcctagagatttctgaagacgagatcttaaaaagagtgtgttcaagatttctttgcccctcctgttcgcgtatctacaacacaagtcagggacataccgaatgtccagactgtcatgtgcctttgatacggcgttctgacgataccccggaaatcattaaagaaagattaacaaaatatcaagaacgcacagctcctgttattgcctattatgacagcttagggaagctatgtagggtttcttctgaaaacaaagaggatcttgtttttgaagacattttgaaatgcatttataaatagtttttcttccttccaaagaaaagtaccgaattcacccgaaaaaaattcactcagaaccttgtcttaaacttgtcagaaggaaattatgaaacactacctatcattttctccttctgctgattttttctctaaacaaggtgctattgaaactcaagtcctttttggagagcgcgtcttagtcaaagggagcacctgctatgcatattcccaattattccacaatgagctgttatggaagccctatccaggtcatagctttcgttctaccctagtcccctgcactcctgaatttcatatccatccaaatgtttctgtggtttctgtggatgcatttttagatccttgggggatccctcttccttttggaactttactccatgtgaattctcaaaataccgttattttccctaaggatattctcaatcatatgaacaccatctggggctccggcacacctcaatgcgatcctagacatctacgtcgtctaaattataacttctttgctgaacttttaattaaagacgcagaccttttactgaactttccctatgtatggggaggacggtctgtacacgaaagtctggaaaagccgggtgttgattgttcgggatttatcaatatcctttaccaggcacagggatacaacgtccctagaaacgctgcagatcaatatgcggattgtcattggatctctagctttgagaaccttccttctggtgggttaatatttctttaccctaaagaagaaaagcgtatttctcatgttatgttgaaacaggatagttccaccctcattcatgcttctggtggagggaaaaaagtggagtatttcattttagaacaagatgggaagtttttagattcgacttatctattttttagaaataatcagaggggacgggcattttttgggatccctagaaaaagaaaagcctttctgtaataagaaaggctttttccaaaaacgattcgaaaaacggtaaatatcttaacgcttagagaattggaagcttttacgagcttttttatgtccgtattttttacgttctttccttctaggatctctagtaagaacccgcaactctttaggtcttgtctattctcttcattttcttttaagagagctcgtgcaaggcctaatcttgtagcaattacctgcccttgaatccctccaccgctcacacgaataattaaatcgtattgactttggtcttctgtaatttttttcaaaggagaaagaattgtagttctttgaatttccaaaggaaaataatcttcaaaagacttaccgtttacatcaattttaccacttccaggtcgtaaacggacgctagagacagcctgttttcttctacctgtagctacagattcttgtattgtactttttgccacaactcatcctaaattaaatatctaataaaattggcttttgagattcaaaagtttcgtatgaatccccttttacaatccttaaggacttcaattgtttctttcctaagcgagttctgggcatcattcccttgatcgcatgctcaataatgtaattaggttttctcgccatcatattttcaaaaggaatttctcgcattccagagatatatcctgtgtagtagcgatagattttttggcctttcttagctccagttaggcgaaccttctctgcattaataacaataacaccgtctcccatagccacatgaggagtataggtgactttatgcttgcctcttaaaatttttgccacttctgaagaaagccttcctaaggttttcccagcagcatcaacaacataccatgacttcgtagtttcactggactttactatagttgtttttgtgtcttttcttttttccataataatgtaactgtcttactagagagggcgattataagtctgttcaaatttttttccaaacaaaaacagccgaaaataacaagtctcttagtttaaaaatatttccataaatttcttttcgtacaattagcagttttttcttaacggctgctgatataaaagcattcagacaccgtctaaagctagatctcaaaaatatggatttatcttgaaatcagagggagtgttttcttaagagttatgaaaaaatagcttgccattggataagactccttccctagaacacctagaggcgaggtgcttattatgtgtcacaataagaattccacataatgcggatgcttgttctaacagaaggttatgaatctgttctgaagtctcttcatcgagattccccgaaggctcgtctgccaaaaggatggccggttcgttgattaacgctctagcaatagcgactcgctgtttttcccctcctgataatttagagcagcgagtccgtactttgtcttcaagattcactaaatccaagagctctagagccctggtatatacaggagatcctttagatatgttttttcgagcaattagagctggcattaagacattttttaatactgtgtcgtcttctagcaaataaaaattttggaagacaaagccgatatgctggtttctaaaattcgcaagatcctggttttttagatccttatcaaaaaagcgtaagcttccagaagaaggaacatccaaagttcctaagagatgcaatagcgtggttttaccattacctgaggctcctgtaatcgatatagtttctcctgcatgcagtgataacgatacatcggtcaaaatagaaatattttggttctgttgctggatagttttagaaaggtttttagcttctataagtaaggacatagctaatctgcttttaaaatttctgagacatgcatttttgcgacttttcttgcaggcagggctcctgaaactgcggctaaaagtagcgtacctaaccctagaaaataaatagcctgggggtgaacgctattgggaagattctggccaaagaaagcagtattaaatgtttctcttccctgtaaatagttcagtgcttttacaatgaattgtaaattttttaatgtaattatagcgaatatcgttcctataaccactccacaagctcctgaaaatgctccacaacaagcaaagatgatctttaaacttcgtgatgatgtccccatagctttaagaatgcctatttcctttttcttattatttacaaggagcatcgacatagtcacgatgttggagcaagcaacaataagaataagtatgcacacaaaaagaaagagaacttgatcactttgaagttgatctaggataggctggaaataatcgtaatcgtgtagggaagaaatctcccaatagtcatcgacacctaaggaagttagaatattttctatttgtttttttacaaagacaatgcgtttggtattggggaaaaatagatggaagccgttactcatccccaagccctcggattgagaacgaatggatctagcaagatctgggtctataaatacagttcttccccctaacggagagagcccgggattataaaatccgatgacatgaactgtatattgagtttctttttcattctctatggagtaggtactaaaaactcctgtatcccctactttataaccagagtctttataagtactagggagtatgatcgaagctcctcggtagagttcttctaaatgatggaaatcttgttgccatcccgaggggcttctattaaatggattcaattccgcagaggtatagtctgtttcatcgtagggtaaaaccttatcttcataggaaagcttagagggatacgttaaaaaatgcgtgagatttctaggctgaggtttttgtaattttagagaggttttgatatcgaggtaacccactccctgctcaaattcgatcactttcccgtgttgggattgaaggtagggtcctaaagattctagagtcatctttacaggatctttttgctgccctcctagatcacagtcttttaatggaaatgtttccggaagaaggtagtctgattcaggatcataagggtcgacttgtggagaagctattttttctcctaaagttttcgtagtgtagttagaaagactggagtgtttgtctatttgatagtagtacgaagaataatatgtgtcggagggaagaatagtaattggagaatggagttgggaaagatcctctatccatctttgttctaaaccgtgaatgactgaaataaaaactatagaaagccagacaacaagagaaatgatacccacagaaaatagggagactatagctgaatatagccttccccttcctggaatcaaatactttaaagctactgaaaattcgaacttcatgacttctaactaagaatacgattttagaagcgagtagttaagtacgatgaaatccttttacctagcttctttgaaaattacgtgcctacgcagttttctatcatattttttgagttctagtcgacctgttgtttttcttttgttttttacagtccagtacatatcagaactttccgagctttttaatttaataatctcccgattcttgcttgccatggatgagtccttttaagaaaatagtaaatcgcttactatgctatatttcttttcaaaaagaatcaagaactctcccaatcattattagagaacctaggatgacaacaaaaagtttaggatctttcaattcagttatttccaaaaataaaattcattttattagtttgggatgctctcggaaccttgtagatagcgaagtcatgctaggcattcttcttaaggcaggttacgagtctactaatgaaattgaagatgctgactatttaattttaaatacctgtgcgtttttaaaaagtgctagagatgaagctaaagattatctagaccatctaattgatgtaaaaaaagagaacgctaaaattattgtaactggatgcatgacttccaaccacaaagatgagcttaaaccctggatgtcacacatccattacctactaggttctggggatgttgagaatattctttctgctattgagtctcgtgaatctggagaaaaaatctctgcaaagagttacattgagatgggagaagttccaagacagctttccacaccaaaacactatgcctatttaaaagttgctgagggctgtagaaaacgttgtgctttttgtattattccttccattaaaggaaagctccgcagcaaacctctggatcaaattcttaaagaattccgcatccttgtaaacaagagtgtgaaagagattatattgatagctcaagacctaggagattatggaaaggatctctctacagaccgcagttcgcagctagaatcactattacatgagttactgaaagagcctggtgattattggctgcggatgttgtatttatatcctgatgaagtgagtgatggcattatagatcttatgcaatctaatcccaaacttcttccctatgtagatattcccttacagcacattaacgaccgtattttaaagcaaatgcgaagaacgacttctagggagcaaatcctaggattcctagaaaaattacgtgccaaggttcctcaggtctatatccgttcttctgttattgtgggtttccctggtgaaactcaggaagaattccaggagttagctgattttattggtgagggttggattgataatctcggaattttcttgtactctcaagaagcgaataccccggcagcagaactccctgaccagataccagaaaaagttaaagaatcgaggttgaaaattctatctcaaattcagaaacgcaatgtggataaacataatcagaagctcattggggaaaaaatagaagcagttattgataactatcatcctgaaacgaatcttttactcactgcaaggttctatggacaagctcctgaagtggacccttgtattattgtaaatgaggcgaagcttgtttctcattttggagaaagatgctttatagaaatcacagggactgctggttacgaccttgtagggcgtgttgtaaaaaaatctcagaaccaagctttgctaaaaactagcaaagcttagggtcctgtggttagttaacaaaaggcaaagtcgctatattccaagaaaaactttgcactctaaagctataacttcgattttccaaaacaaagtatccaggtctcacagcataatatgttgagcaaagccactgcattggtcgtgcacggtaataacttgttccagaacacgtcgacatagctaattcaattcttatgtcaggaaataacgggttttgatttgcttcatatgctaccaaaagaagctcccctcctgtaccattatcaatccaatctccatgcttggtcataaaaattgaaatacgaaagagcctaggaatagaagcacttgcttgaaatcgcatcatccaagtctgacttgagtcgatataaatagcggaattgatcactgtactttgtgttgacgtttgattgaacttattccaaggtacattgactccccccaaccaatatctcccgaacctacatgccctcctgaaagagcagctcgctgcatcatcatgactctggtaagtttgtagtatccataaggcacatactgttgaggttgctcagtattaatatttgcatagtcttgacgcttattccccaaggagtcttgataagaaaaaggagaattcgatagattcacccgaccgttgaaaaccatagtattgaaggtttgtggagtgatattgatatttcctccaacggaaagatcgttctggcatatcagtcctccatctgcatcaacaaaatttcctaaaacttgagtattctctgtagcaatattctgaccaatagtaagtgctgttttcttttgctcatcagtaaggttgattgattcgatgttaaatcgaacaaaagtaggaatcgatattgttattttttgtgttgtgggtatcgaactcgacattaatctacctccacaaaattagatggaaatggaaaccaaatgaccacatgtggatagagacataaggttcatccatatcgtgctctctaagttaatccaaggatagtcataaggaggactagaaaccagctctgttacactgaagattgcagttacagcgacactcgtacggtcactcgaataacctcctctagtatctgaagtacaaagcaacgttttattatttccagagacaaaattaagaattagagtggcagaattatctccgtcatgttgtccgctccaccgtgtgagctgcatagtgacttgatagatcccgacttgtttgagtttaaccacaggctcaatatctgcatatctgctgaagtcaggggtcgcgttacgactcacacttttagaggtgatagctgcaacatgagtttcaattgtagtgttaggggcaacgtaataaccattcccaggataatacgtatagagattcgcagcctgacatccagtttttctataataactaaatgtaagcgcatctcgagcagactgaggatcactaatattattgcatactggagtttgcgatacgtctgtcttagaatagatattaaaaccgtcagagagtgtagtagcattaagttgagaaccttccgcagacacattacccttcacaataaattcacatggagaagtcgtggtatctaagactttgagatcccgagtctctaaattattttctattcttacattcctttcgacactgagagttgcttgatctataaataaattctgatctttgacccccagagttttcattgggatttataggtggagtcgtcggtccaaatatgtttccctgttgttttatntttttcataactaccctctatcgtccggataatagagaagagaaaaggagtaattccctatacctgcactagaaccaccgttactgagatagaaaatacccgctctatagcgatccgaagcattcggatcattaggattaggagctacatctacagaggctctatatattgaggtccccagtgtacctattgttgcataccctccaccactataaatcgtgctttcacattggacttgtcctaaaccattattgatataaatggctcctccccaaccattattccatccccaccgtttaccaacagtaaatgaaacgatataggttcctgctgcaagaaattgtatcgcagtatttccccctacagttaattctcgtgtactttgcttccatcctataaaacgaaatatactatttacattacgtgactgatatagagtatattccgaaccagtcagaggcaaataagattcccctgagttaaaatcaaaatctccgatcagaggcttggaacagaaaaaatattcgggagaacgaacataattcgctggcaccggatcgcagtcttcttttggcaatgcacaattactcagacgattatttttaaaatctatagagatttgggaggaagtaaagttttgtgcatttaaattataagtagttcctgaagttaatccagttgctgaaacttgatctttaaatgttgcattcccctgaacagaaaatgtttcagtcgatgagattccttgggcctgtgtatcaaaggtcttgagattggctgctaacaaatcaccatctacagttgagtctaatttaaaatagcactcattattattaatattgtttttcatgataacttttaataaagtttaatttatcaactcaaaatcaaattaataatattaagtcaaattattaaatttaaaatatagaaaagataagaatcagaaaatattcaaacttaagaaaagggattcaataaaaatgagtgtgaataaccgtaagaaatagaagccaagtgatataaggaaatcgaactccaagcatcgttagtttctaacaatacttggagttcgatgattattcaacgtaaggcaaggcaactatgttccaagaaaagaaagagactcttaaccctccaccagctctattctggaaagtaaagtaaccattattttgagcatagtatgtaacgcaaactacctgtaaaggacgtgtttcataataactggaccctctagaggtcgtcattgcaagatctgtgacatttatcctccctccgccttgctcatattcattcgccgctaagagaatatctgctcctgttccgttatccaaccaagaaccatgtttagccataataacactaatacgaaaaagttttggcaccttattatttacttcgaaaaccaatttagttgagtcatttgggtcaatataaatctctgttcctgatgttttttgagttgacgtttgatcgaacttattccaagggacataacttccagatggaacacttccaccacctacataccctgatgaatgagcagctcgctgtgccatcataatttgcgtacgtttataatacccgaaaggaacatattcttgaggtttccctgagctcattttttcatagtcggtaatgtcttgtccttgagaatttttataagacaaaggtgaattagataaatttaagcgaccatcaaaaaccatgctattggtgcttgtaggtctgatatttatatctttttgtattgtaagatccgattgacaagtcagtccgccgtctgtacaggtgagatctcctctaactacagtattttctgtagttacttttcccccaacagtaaatgtcgtttttttttgatcttcagtcaaattgatagattgaatattaaatctaacaaaagtcggaattgaaatttttgttttcggtgtaggatttgacattaatctacctccgcaaaattagcttgaaatggaaaccaaataacacatgttgacatggatttaatatctaaaccaatagtagtttctaagaataaccaagggtaatcatgagggggggtagcaacaatttctgttaaagtaaacgtgcctgttacagcaatactagtcctatgtcctcctgagtaacctctcgtatctgaagcacaaagcagcgtcttattattcccaatcattaagttcagatataaattaggattatcaagtccactatgttgcccgctctcgcgacgtatttgtattgtgacttgatagattccaggtgccttgaactgaatataggggaatctcgttacagcatcataaattttagctgaagcgctaatgcgatacgtctctggattcgggttttgacacaccgtttcgattggtttacctacagtagtaggctgagatgaactatagtaggtatacagattaagggcctggcatccagtgttcctataatagttatatgttaaagcatctcttggagattggggatcgctaacatttgtaaacttaggaactcggccatcctgatcttcagaagtgatctccaaacctttagaaagtgttgtcgctttaaattgagaactttctgctgataatccgcccccgacagtaaattcacatggagaagtgattgtatctgcaacttttaaatctcgagtctctaaaaagttttctatatcgacattgccatccacattaagagtcgcttgatcaagaaataagttctgatcttttattccagtattttcggctacatttgtagacggagtagaagcattaggtagaattttttgtaggtttcttcttttcataactacaccttatcccccgcaaaataaagaagtgtaaaggaatagttccctattaccgcgctgtgatctccattgcgaacaaacaaaaaattattcatatatttgtcacttggattgttcgggtcaggatctatatcactatgatctctatatactgcggtacttaaataccctatcgttgaataccctccgccactatacactgtgctcccgcacaacattgttccatcgccagtgtatttcccttcaaatagacgaatcgatcctccccaaccattgttccatccccagcgcttaccaatagtaaaagttaggatataggttcctgcagcaagaagttgtatggctgtgttccccccaagtgtaattttttcgaattttgatcccaatctacaaaacgaaaaacatcaccagccttgcttgactgatacaaagtatagtttgatccatctccagttataggtaagtatcgactacttccatcaaacataaaagtcccttctattggcttggcacagaaaaaatattggggagaacggacatagttcgcgggaacaggatcgcatgggtttttcggtaatgcgggattactaagacgattattcttcatatcgattgttattgaggaaggcgccgggcctgtagcatttaacttataggtagatgccgaagtcaaacctgttgctgaaactttctctttaaatgtcgcgttcccctgaacagaaaatgtttcagtcgatgagattcctttagcttgcttatcaaaagtctgaatattcgaagctaataagtctccatctactgttgaatcgagtttaaaataacactcattgttatcttgattatttgttgttgtcatttcaataaaatagttataagtttttcttttaaaaacaaaatagatctatttagtcaaataattaactaataataattctcttacgaaacaagataataaataaaattcacaaaaaataggaactgttcgcaatcaaaaacctttgattatcgattgagatttggaacttttaattcaaaagttctctccccgaatccaaataattttttacattttctgagcgaattgattagatagaaactatgagatgacaattcatgaaatgcattcccaatagttataagttttatataagatccttgagaattcaagatattgaagaaaaagaagtgggggtggctggatttgaaccaacgtatccgtaaggagccggatttacagtccgatgcaattgaccactatgcgacacccccaaaaatgctggagaaaggaattgaaccctcaaccgttcgattacaaatcgaatgctctgccaattgagctactccagcagaaatagaagtgcgattatctcaaaaagaaagttttattctcaatcagaaagtaacttatctgaaattaatcttcctcaactggaggtttttgagagttttcagatatgcgaaaatcttcttgtgtagggataaaatcctcacaaacaaaattagtgtcttgattcaaagtagctgtactctccataggtggagctagattctctccagtatttagaatctcaaaattatgctgctgaagtttctctgtaaccaatttctcttcttttgcctgagctttcttaagagcttttttactcattacttctttgttcttagtaatctgatgaaacttaccaacagccgctttctgttctgaagttaaagattgagataaacgctggaacaacttcgtacaattatctcctgcttctccctgctcggatgcagagagaacttcagcagaaaatttaaattttccttcagttgtataccgagctgtttgttcttctttttttaaacaacattgcttgtactttttattagaaccacaagggcataaatcatttctattaattttttttgacacgtgatcctcttccacacaagatcttttagaaaagtctaaataagctcaaaataaaatccaaagtcaaatgcaaaaacctattgcttttttctttaaccttggaacctagtactcgttaataaaaagaagaaaaacttaatgaataattaaaggtacaaactttatgccagcctattcacctgaactataagtttctggatttttaacagcgatttcttaagaataatattcctttaaccatccattcattgttttcatgtccactttacttttaaatcctccgtggatgaaagcgggaaaacgtatagaaagcttggtccgaaaagcactctatacccataccatgttagcaaatcatcgtaaaattgtagttgctctcagtggtgggaaagatagtcttacacttcttttaatgctcaaagcaatttctggaagaggattcccagatttagatctccacgcggtcaatatcggaggaaaatactcttgtggagcagaagttaataaaccttatttaacccgcatctgtgatcaactgtgcattccgtttagaacaattccctctccttatgcacccgaaaccccagaatgttatccatgctctcaagcaaggagacgtttacttttccaagccgctaaagaaataggagcttcggctatcgcttttggtcatcaccgagatgacctcgtccaaaccgccttattaaatcttctacataaagcagagtttgctggaatgcttcccgttttggatatggtccatttcggagttaccattttgcgccccttaattttcactcccgaattctggattcgcaagttcgctaaggaaaacgcttcgcaagagtcacttgccgttgtcccgtggtttcattaagaagcaaagcggaacaaagtttaaagttattagaagaggtattccctttagcacgtcataatatcgctttggcaattcaagaacatgggtcatccaaatcacaaaaaatttgagagacactttgttattaattaatttttaatataaataaggnagtaaaagtttacttggttctcatgaataaaagattaaagataattctaactaatgatgatggaatcacagctaaaggnatgagttgcctagtctctgctctattggaagcaaatattggtgatatttatattgcagctccccaagccgaacagtcggggaaaagcatggcaatctctctgaaccaagtagtctgcgcctctccgtatgcatacccgcaacccgttaaagaagcatgggcagtaggaggctctcctacagattgcgttagactcggccttagaacactttttgaatcggtttcccctgatttagtgatttcaggaattaactgtgggaacaacatatgcaagaatgcttggtattcaggaaccataggcgctgcaaaacaagccttggtcgatggcattccatcgatggcactttctcaggataaccatatttctttctttcaacaagacaaggctcctgaaattttaaaagcattagtgatttatctcttgtctcaaccctttccttgtttaactgggttaaatattaactttcctaccagtcctgggggttcctcttgggaaggtatgcgacttgtgcctccaggagatgaatttttttacgaggaacctcaatacctaggctctgtaaacaaaaatcaatattatgtagggaaaatttctggagtacggattggagagcatccatcagaagaactcgcttgcatgctagaaaaccatatcagcgtgtctcctatattttcacaaaactctcctatcggcttaatgactctagaggaatttcaaaagacacaagaaaatttcaatgcatcgcttttaagctctgagctgaccactaaaattttctaaaagccccctagtctttggtatcagaggtctttttttacaaaagatctcttgtttaatcgagatttaatcacttaaattgaaagaaaaataattgtgattaaactatttcttctggtaagtttatgctcctatcttattggatgcgtagctcagcggttagagcacctgtcttacacacagggggtcataggttcaaatcctgtcgtgtccatttgcgggagtagttcaattggttagagcaccgccctgtcaaggcggaagttgcgggttcgacccccgtctctcgcgaagtatgctttcagaggtttcaggatgtctcacggtccacgtccaacaaaattcagtttccctctgtatttctccaaaacattaagttggtttattttaggtggctttcttgctgcttgcggagttcagatggtattagtgcctaatgaacttatcgatggtggtattgttggcctctccattatagcctcgcattttttaggtcacaaagcccttcctttttgcttagttctcttcaatcttccttttgtattcctagcatttaagcaaattgggaaatactttgtgattcaaatgttgacagccgtgattattttttcgtgttctctctggcttattgatcaactcccctcttggctcggcatgagcccctttgtttttaaaggatcagaaatggaaaccgttgtgctaggcggtgctattattggcgtgggttgtggattgattatccgccacggagggtctacagatggcacagagattctaggaatcattatcaataaaaagaaaggctacactgttggccaaatcattttatttgtaaacttctttatctttgctttatctggtattgtctacaaaaattggcacactgctttcgtttcatttctaacctatggaattgcaacaaaagtcatggatatggtgattttaggcctcgaagatacgaagtctgtcactattattacctcttctccaagaaagctaggccatattctcatggaaaccttagggattggcttaacctatattcatgcagaaggaggatactccggagaacctagaaaccttctttatgttgttgtcgaacgtcttcaactttcacaactaaaagaaatcgttcatagagaagatccctcagcatttatcgccattgagaacctccatgaggtaatcaatggtagacgaacttaatccttgaaagaatcactctggattcgaccattgtttcgttaggtcgctagggatatttagataagcaaggatttttcctactaaagcattttcaagatcttcaaccgattgaggcttaaagtaccacataggcatcggcggaaaaatcgttgccccactcttgcttaattttaagagattttctaaatggatcgtatgcaaaggggtctctctagggacaagaatcaagggtcgcctttctttaagagccacatcagcaacacgtcgcagtaaattatctgctaaacctatggaaatagctgcaactgtagtcatactgcaaggaataatgatcgtagcttctacaggacaagatcctgacgctaaagagctctctatagcttgaatgctatgagtatgaatatactctaagttttcttctgaaaataatgcgtcaaaagactgacaccctagttcataatacaacgtctttcttcctgaaggagaaataattacttcaacttgatgttttgcatttacgagttccttaataagcttaacagctagtattaccccagaggcacctgaaatgcccacaacataacgcttcatctactcaaactccaaaacaaagtcatacttacaagaaacgatagagcaatcgcaatattcgctaaaaagaatttggctctctccttcttgatcttttttactgtagttagaatacattctaactaccttaagaatcacaactagaggaatgatagctgtgaaatagaactctttatctaaagaaccaacaaaacctgaaaaaatataagcaagataacttacccataagtttacttttgcaatttcaacggctttcttttcaccgtaatgtgcaggaacactacgcaatccttcttccctatcaaattcggtatcttcaattgcatatatgatatcatttgcagctattaccatacccacactccctccccataaaagagcaagaaagcataaacgcatggaaagccccgactcagcaaaagcacaaaaattcataagaatcgctacagtgtacaccaaccctaatccccaatggcagaaaaaagtcacccttttcatatagggatagacgatcataagagtcagtgaagcgatgcccaaactaaaaatacggagaatcttgcagagaaaaagaaaaagaaaactacaaaatagagagagtacccaagcaaaatttaaagaaacaagattcgcaggaaggactcttttcgatgttcttgtattttttttatcaatgaaccggtcgatacactgattcactacaattcccgtagtccttgcaaaaacaaaggctatggctccaaaaactgaaatcttgaacccttctttaaatgataaattttgggaaatctcatttatagaaagagcaaagactgtggatgctgataaaaaaagtattgaaaatattgaatacttaaaattaactaaatttaaaaaataatttaatctcacaattattatcttctatataattatttttttatttataaaaaaaatatactcctctctattcatcgggggtgatccccccaatctttttagaaccccctatgttagggggttcgtctttttatgcctctactgtgtacatttcaggcattagtgcgatacatttttcttaaatccaaaaagttccatgttctttcgtatagagggtagttcttgtgcatcagaaatggtccttaaacaaaactcctaacgccaagacaacaagctgattatgaagtgcttgtcaaaacaaaaatccttttaaatatattgctctttaaagaaaaataatgacaagaaattcgtaaaaaagcgctgttttattaacaaaaaggaagagactttatacttatgattctagtacaaaattgcagaatcagatgaaaagaactgtactagggtttttaaaatttagttattatatcaagaaataaaattaaaaatacctttaacctaaaaagattaatcttgatttaattgatttttctaataaaattattcgatctcaaaaataaaacgagtagataatggcgttagatgaaattaataatcagaacaacccatcgcaacagatagcctcctcgacttctcaaacttctaaaatcaaccaagatcgaaaaactttcgcatgcactgttaccctacttgttgtagcaactttgatgatcctatccgggattgttttgctatttactataggttccctaggactcagcgttcctttatctggaattctagggacttttgcagtgacagtaggagctgttctctttatcacaggtctaactattctagttagaaaatccctaggaatcgaacagaaaaacgaagacttgaattttttaaagattaagaccccaactcccccagcacgccccctaatgtcaaagtttagtgttacctgctccactacaagtattgttttaggaatggctcttcttatcggtgctgtcgtctccgtattttttctcacaggatatctacaactaggcttgtgtgcaggacttgtaggtcttggaaccgccctatttgttgcaggattagcaaggatgtcccctcgtagcctagcagaccaagaaggctccggctccgccgattctcaatcaaatattgttggaataggtgagccaaaagcagctcaggaacaaaaatggtataaaatggcagtggtaaggggagaagatggtataccaacagcaattcgcctaacaccagagaaataaactattattttaagaacaaaaaagggttttaaagtaggtaaatgagaaaacttactcactataaaactcttaaaactataaaaattccgaacttttatactatatcgaaagcaattcatccaggaattacagaaaattgaaaaactatttaataatctacctaaattttctgatttaaagaactataagatgtaactttaacgatttttttagtaaactaattcggattaaaaatgaaatgagtgtcaataatgtcattgaataaaaccaatgcccttctcaatcaaccagagcctgctgtttgccttaatgcttgggaccctaaatatatcaaccaagatcgaaaaactttcgcatgcactgttaccctacttgttatagcaactctgatgatcctaacaacaggagttatcgtattacttgctatgggctctcctggattaagcgttcttgtatcaacaattataggaacctctgtaacaactttagggactgctctcttcataattggtttagttaaactaattaaaaaatcattagcatggatacagtatcagaaatactttcaagaagtcgtaaaacagaaatatgaaccctttagcattcctaaaaatgataacgtacacaaactcacttcgtgcttaccatcacctttagatattgagagtccgtctccagaagcaagtaccccagtctctaagttacgcattgcatgttcaggagtcgctattgttttaggagtgactcttcttattggtgctgtcgtctccgtatttttctgcactggatacctacaactagctctatgtgtaggattcgcttgtcttggaactgccctctttgttgggggattggcagggttgcggacccacagcttaatcgctcagggcatcatgtatctttacctgacttactatctatcatcggctctggaagaaagaaacgaaacagtcaaggatcagcgtaacgaaatcaatacatatttaaccgaggaatgcaggcagcaaaaaagggaaaaggcactgttggaatagaaacaatgggcactatctctcatgtctcaatgtcagagtagcagtacatctacctgggaatggatgaaatcttttgtgccaaactggaagaatccaactccccccttatctcctataccttctgaggacgaatttatattagcatacgagccatttgttctaccgaaaacagatccagaaaacgcacaagctaatcctccaggcacatctacaccgaatgtagaaaacgggatcgatgatctcaaccctcttctggggcaacccaacgaacaaaacaatgccaacaatccaggaacttctggatctaatcctacatctctacccgcccccgaacgactccctgaaactgaagagaacagccaagaagaagaacaaggatctcaaaataatgaggatcttataggataaaaacagtgcgaatgagttccgccctgtttaatactgtgttaagaaagagcagccattcagataaatgtccagctaaagcaagaaggacaaagactcttgcttctcctttgatacaagaaatgactcctatctttcatagtttatagcaatactataatttcacgtctgttatctttggattcacttgttctacaatgacttgctttaaaaatttctcagcccgagaagaaagtatggactctgctttccctttagaaaaaatacgatgaatcaactgatttagaacgggatgggcttccgcagaactacactcattaaaaaagaaattttcgtcttcatttgcataaaagaaatccgacccaagaacaatacttgataaaattccgagattctccgcatggaggacatgcttctccaaatcacccaaggaatctcctacataagacctcactagattcaaaccaataacaccttttcttctcacaatctccttggcatgggcatctacaaggttccttcgatgatcaagaacagatcgaaaattagaatgactggcaatcactgcgagattgggcaatttatcggcagtataatctaaaatatcttcagctaacttatcactacaatggctaagatctattggaactccaagttcgtacatgatatctaaaagaaccttaccatcattagaaagtctcttaggagcttctgtgccgcctccaaaacggttatcccctttccatacgattcctagataggcaagaggcccctgtttagttaaatgtataagctttgctaatagagtcccaaggggggcggtatcatctcccaaagctgaggcattttctatactacgaataagacttagtgattttttttgagaagaggatccgttctcttcttcttcataagataataacccaatatccggatattggttaggaagagaaaaaaacagagagttttgtttatcacaattaggttccccccgactgtgggggacaaaaatagcacacacctgctgacgtacgcctccagataggagttgttctggagaacacctcaccgcaggatctttccgacaaaaatgcggatgcgaaagtaagtcacaatgcatatcgatagtcataacacacctaaatgctactcaatataataaggggaaagaaaggggaaaagttcgggataatccgatgtatttatatcataaataaagactatagaaggagttttcttttttaaagcttcccgtaatctggtataaaaattcttaggtttaggatgttcacaaaccacacctttaaaatctaaagatccgctcaaaaaagatactaattgctcttgatttttcactgtatagatcttgatatgcttcgaaaaggcatgtgacgttctatgaaaaatcttagcttcagtccctgcaatgttttctataacactgcgagaaatcagcccctcacgataaatataaagaggatctgaggcaactactgtggactctaaaccatgggaacaagggccatcaaaaatacagagatcatgatcagcaaagtctgcgaatatctcttgagctgtaagagctgaaggaaactctgaaagattcgcagatgttccgattaaggttccacagtgatccacaatttcccgaactacagagtgatctacaatgcgaaacgctagtgtttctttagggaatctaggattgcggtgcttaactactaaagtaattgctcctgggaaaagttgagctaatttcttagctgtaggagataagggataaccagaaatgttttcgattcttcaatagaatttacataaagggcaaaagctttactaggttctctatcttttaaagcatagagtctttcttcagcttcagaggcatacaagctaagaacaaacccatagacagtgtcagtaggaagagcgacaattttcccttgatgtatagctgacataacctctggaagcgaaaaagtaatctgtgcttttttatcaggcacaataactccaaaaatagattaaagaaggtctatgttttttagaatccgcacaaaaccgcttatacatataatttgtacgctctttatcaaaaagagaattccttagattaacgcaaaaagttaatctaaatccataatttttattcagaaaatagattttttattaacttatacaaactaaacattcaaaaatccaaaactacatcttaaaatattgactacgccacttgaagacaaaaaagaaattattgatccctaattcccttcgatataacgtggtaacttcttattattaaaaataaaaacttatgacagactactctttctttcgtcgcaaaattggcaatattgaagccatagagtgccctggaaatcctcaagatcctatcattattctgtgtcatggttacggatcacttgctgataatctcaccttctttccttcgatatgttccttttcaaaattacgccccacatggatttttccaaatggaatccttcccttggagaatgacttccgaggctctcgtgcatgctttcctcttaatgttcttttattacaagaactctctaggctctatgccaatggagtagggaaccttcaagaaaaatatgatgaactatttgatgtagatctagagacaccgaaagaagctttggaagaacttatcctcaatctcaatcgaccctataatgaaattatcattggtggatttagtcaaggagccatcctggctacccaccttgtcttaacttctcagaatccttatgctggagccttaatctttgctggcgcaagactgttcaatcaaggctgggaagaaggacttaaacaatgtgctcaagtgccatttttacaaagccacggttatgaagacgaaattcttccttatcacttaggagcacaccttaatgatcttctattaacaaagttgaacgggcaatttgtttctttccatggaggacatgaaattccctctgtagtattccaaaaaatgcaagttacagttcctaattggatagatcctgcccggggctgacagaaacgagttccttttctttatactggagagataccaactgaatagctacccattctaaaacagatgctgccgatgaggagttattcaatgaccgaccaggcagattccacaattaaaagcaccttatctaaaggcagtaatggcaattgtaggatctccttaacatgctcaggatagtttaaagctgaagcctttaatcctaaattcagagtataacgatctcgatatagctctaggagcacttccatgaatcgttgcaccttgtctcttaacacctgtttatctgtctctgaagattcttttataatttgagacacttcagtaacgggaatttcacattgggcatagcgaaataaataagaaaacgtctctttggaacataagattttttctcccctctcaataaaaatagagagactccgagaaatgatagtctttggcaatctctgaacttttgctgttgtcaatatgataacagcatgtttcggaggttcttcgaagacttttaaaaatgcggaaatcgcagctaaagtcattcgatctgcttcgtgaataatgtagatcttatagtttgcttcaaaaggagatatataaatctgcttcttaattcccctaggaagatctatagagtgcagtcttccctttccttctggaaagaattgataaatatcgggatgaatcttttgagaaactttatgttcggaacctggagatgacgatagcaaaatctccgatgctaactgttctgctttatcctgtaaaacaggaagggtaaatccatgcagcagtatagctggaggcacttcctgatgataaactttcctaagtaaagcttcccagccttgattctcttcttctaggtgcataacccaagttgcgtatgtagcatcactttgtctattaaactagctagtgattcacgagcatcaagaaccaagtaacgactaggatcggcactagcaagagataaaaatccttctcggatcctgttatgatagctcaaaggctttttttcaaacttgtcaaaaaccttttgtcggtgcttcctttgtaagccaatgtctgcaggaatatccaagagtaaaacaaaattaggaaggaaaggtgtaggtcctacaaccttagaacaaaggtcggcaacaaaatcagcacccaaaccttcggctattccctgatacacaatcgtggaatcgtggaatctctcacaaatgacaatatagccatcacgcaatgcgggaatgatcacttcctgaatatgttgagcacgtgatccaagaaacaaaaagagttcacaacagcgagagagttctaagtgaggaggttccaaaattaaatctcggagtctttcgcctataaggcaccctccaggttcccttgttaacaaaaccttccgatcttgagctactagctgatctcctaaagcctttgctaaagaacttttgccagacccttcgcccccctcaatcacgataaacacaatactaccttaggcttactgtatcagaacattcttcttcggaccctgatagtacttcatcatcattttcattagaagagagtttttccatagaaacaagagcatccccttctttcaagtgaactaaacgcaccccttgagtcgatcttcccatcactctaacatcttgcatgttaatgcgaattgcctgtccctgactcgacattaataaaatactgtcgtgatccgtaacaggaatagctcctaggacattgccgtttctttcattgataaggatagaacgtacgcccacgcctccacgattggtttcgcggaaatcttcaactaaagatctcttaccaaaaccttgatcacatacaattaaaaccgactggttctcagtcacaatttgacaactgacaactttatcttcttcatttttcaaagagacaccgcgaaccccacgtgcagttctacccataggacgaactttttcatgggggaagcgaactgccataccaagatgagtaaataacattaccttctcttcatcactaacaatgtgacaagctgctatgagttcgtctccctcatctatctctaaagcacgtattccctttttcctagggttgctaaaggcgtctaaggaaacttttttcacaacaccacgtttggtggctaaaaataagaagccggcattatcaaaattcttaatattcaatatagctgcgagctcctcaccaggacgaattccctctaggaagttgatgatgggcttacctttcgccctccgctccccttctgggagctgccataccttcaaccaataacattggccaaaattggtgaagattaggagatagtctttagtaaaggcagagtatacagctttaaggaaccctgctcccttcttcatatcaaatcccgtaactccatgcccgccacgacgttgttctttgaacacttttacaggcattctctttacgtaatcatctccggatatcgtgataataacagactcattggtaatgatgtcttcaatatcacgaatatcatcagcatcgaattctatagtagtgcgtcgagctaccttatgatgcttcaaaagatcttgtaactcatttctgatgatatcttttactaaaccttcatccgataaaacttgtttataataagctatcttatttaataactcttcgtactctttttgaatcttttcagcttctaaaccagtaagttgatataaacgcagttctaaaatcgcaagagcttgaggttcggtaaaaccaaaagattcaataatccgttctttagcatgctctttattcccactctcgcggatcgtttttactaatgcatctaagcaagataaagccttaaggtatccttctaaaacatgagctcgtgtttctgctttatttaattcataacgagtcctacgacggatgacttctttacgatggcgtatccaagcggaaatcatcctatgaatactcatcgttctaggtaagttcttatccagggcaagcatatttgccccaaaagttacctgaacatcggtgaacttgtagagcctattgataatgatttccgaagattctccttttttgatttcaaggacaacacggattccatctttatcagactcatcgcgaacatctgaaatgcctgcgagagtcttttcattcacaagatttgcaatttgctcaatcaaacgtgatttattcacattataaggcatctctgtgatgatgatgctctcacgatgtttatcttcattctcttctacatgcagacgagctcgaactttaatctttcctcgtcctgtagtatacgtggagcgaattccttcagaaccgcagataattcctcctgtagggaaatcagggcctggcatgacttgtaaaatctcatccacagaagcctgtggatttgcaagcagaagaagtgtagcttctataagttcccctaaattgtgtggggggatattcgttgccatcccaacagcaattcctgaagaaccattgcaaagaagattcggaaatttagaaggaaaaactacaggctcgtgttttgtttcatcatagtttggaacaatatccacagtatctttgtccaagtcttccataagatacatagcactatgggtaagacgagcttctgtgtatcgcatagcagcaggtggatctccgtctatggagccgaagtttccttgtccgtccaccaaaggataacgcatcgcccagttctgagccatacggacaagcgtaggataaatgacgctctcaccatgtggatggtagtctccagaggtatccccacaaatttttgcacatttacgatgcttagctcctggagaaagacttagctgcttcatggcataaagaactcttctttgtgaaggcttgagtccatcccggatatctggaagagcccgagatataatcacagacatcgaataacgaaggtaactttccttcatctcttcttcaagatttttagggactataatttcatctttattgaacatagggattgtggactcctaaatatctaaattatttatcctaatggacaaagcatgactttctatgaattctcttcttggagggacttcttcccccatcaacatagtgaaaatatggtctgcttctacggcatccttcaatgacacatgaatgagtgttctctgctcaggattcatagtagtatcccaaagctggtcggcattcatctctccaagacctttatacctctgaatttctatgccttttcttccaagatttttaagatagttaatgacttcttccaaggtatagcagctatagttacagcttggggaatcttcatttccaatcacaatctcgtttttctgagggataagatagctagaaatatctaaaccatattctttgagttgattttgaatatctacgaacacagcaactttataaagctctatgattttaaacttatgagtttcttcttgagctaaagcttcttctttttcctcatcagaataaagatagcgccctccctgcattccagttgccggagcaagatagtacaaaggatagcctatcccctctttatacatctctaaaaattcagagaagggaatcgcttttttctcaagagtgtttataaagctctctacatctaaaatgacgttgataaaactctctaaagcctctccacgtaattctctttccgtagatttaaagagaatggagctctcattcgtgcctaacatgagcaaatagctgtccatttctttctctgaaagaatataacggaagtcttttttcttactcaccttgtataaaggaggttgagcaatataaacacattcattttcaataagcgctgtcatatgacgatagaagaatgtgagaagtagggtacgaatatgagaaccgtccacgtcagcatctgtcatgataatgatacgtctatagcgtaatttactgagattaaaattatcagcacctatgccacagcctaaagctgctatgatggttcctatctcttggttttggaaaattttctgtagacgagctttttctacgttcagaattttacctcgaataggcagaattgcttgaaatcttcgatctctaccttgtttcgcagatcctccagcagaatccccctccacaatgtacatctcacacttttcgggatctttttctaaacaatcaattagttttccaggtaagcgtgcgctatctaaagcacttttccttaaagtcaattctcgagctttttttgcagcttctctagcttgcgctgcaacaaaaaccttatcaacaatcatcctagcaatttgaggattctcttcaaaaaagattgtcagagcttcccctacaacctgttgagccactgagctaacatcactgtttcctaatttctgttttgtttgcccttcaaattgtggatttgggacctttacagaaatcacagctgtcagaccttctcgaatatcttctccggttaatgcaagcttattattcttcgcaaggttatgagctttaatatacgtattgattaccctagtaagcgcggtagaaaaccctgtaagatgcgttcctccttggcgtgtaggaatattattggcataggaataaacaagttcagaataccctgaattccattgtaaggctgcttcaaactcgatttctccatcatctcctactcgagttccacaaatataaatcggttcagagaaaaggctttctttattttgattcaggtaacttacaaaagattgaatccctccctcataaaagaaggtaaccttgtcaaagctaacatctcgatcatcttcaaagactattgtgatcccacgatttaagaaagcaagctctcgcaagcgtttcattaaaatagagcgatcaaaagtacaagtcgaaaatattttaggatcagggtagaaaacgatttctgttccctgccgatcactaacacttacatactgcaatggagttacaggaattcccctagagaactccatttgataacacttcttatctttaaagaccgtggcaactaatttctccgaaagagcattaacgcaagaaaccccaactccgtgcaagcctccggatactttatagctatccttatcgaattttcctccagcatgaaggactgttaaaaccacttctaaagcagagacctctctaccttgttttgcagactctctttcgtgaacttctatagggattcctcggccattatctacgatgacaatacccccgtcctctaaaatgcgaacatcaatcctagagcaataacctgccatggcttcgtcaatgctgttgtctacaacctcatagactagatggatgaagacccgtgattcccgtatctccaatgtacatcccggggcgctcacgaacagcttgtagcccttctaaaacagtaatagcggatgcatcgtaatttttttcttttgggtccataaactatcctaacaaaaactgtatttccctaatctgcacgtgagaagccacctgatacaaactcataattaaatcattttgaggcgtctgttttaacaaagcatataacgaggaattgtaaacttttactaacaaaatatgatctctgaaccctatagcttgagacatccctttatatttgtctctaaaaacctgattccaagcgtcaatagcgtcatgaggcctagctgccataattttttgaagttcctgcaaataattatggagatagtgtttagcgtgttttataggggaagctgttcctttattttgaacttgagatcctccccttttttttcgctttaagaacatatcctacctgaagaataacacagcgcatatcacaaaaacacagatttatcaaattgagagacctttatgtctcgtcttttctctgtttttctttatgatcagtttttaaataaagttttaataacatgctgcatcaaaagaaacttcttatatccacagaaacgaaaaaagtcaataagacgaagaggaattcttatgataaaaatccctttttaggggctgtaaagatgttaagagagcagtaaacacacatgtcgttacatgctaaacatatacaacggtaggataaggcttatctggagaaataagagtcttcacctctataggctctagctcttcaccttgagagcaaaaacctaggtactttacaaccaccaccacgcagaatgcaatcgctcctataatagcgactacacaaactccaaggccaaacaagcaaacgcatagaacatctatgaggcattttattaatttaatgattacttggagcactaaggctgtgatttctaacgctagtataacgatccctccgccgagaatctctacaactccacgaacccgatgtgcccaaagatttacagaagttgaggatttactatgtgttgatttctctaatttttcctgcgcaacttcctctatatcctcagcataagtgctactaattctagaacaacctataactatattcaaaataggaatagcagcttggaaattagttgaaaactgctgaacagaagtaataccaaaagctggggctctaacattaattatcattagaattacaccgtagaaaattagggggggtagattctttatgagaacttcttttccttcaataaaatatttcgggtaaaagatcgaaatattttattgaaggaaataagatcaaaaagagcgcacaagtacaacgacttattgctctaaccattgtcttgagtcattgtcaaaatattcccatgatattttgtatcaaaaaaatgttgtacagaaggagattgaaacagcttctgtaattttatcattttaggagaacctacgtcttcagaacgaatgacaacaaggtttgtatacttagataccgaaagatcctctaaacaaagactatctttctttggagaaaggtttgctgctatagcaaaatttccaggaatgacagcagcatcaacgtcaggaagagatccgacaagaagaggagctgacacctctaatatgttgatacttctattttctttcccacagacatctttagctgtcatatttaaattagcaggccctttgcaaacaatgagtccgcactcttctaacaagtgtagagcacgctgagcattcgtacgatccacaggaatcgctatagtcagtttcttctggctttttaagcgctctaaagaagaatgtttcttagaataaattgcttgaggttccaaatgaactttagcgataacaactaattcacccttacaatcataacgctcgcattcgtcatcaagaaaagcttgatgttgaaagtaatttgcatctacttgtttatccaaaagcaaacgattaggaatacgataatcatctactggaagtattttcagcttgattccaagatctttagcctcttcctgtaaactctccaataattccgcatgaggtgtcggactggctacaatacgtattttattctgagcatcttccttatggcaagaactcaaaacaaaaattaaacctacaagtaatgataatttttttttcatagaatccctctatactttaatacacgacgcccccagaaatctcctagaatacgcactgactcgataagaactaaagtgatgacaagtactgatgttgtgacagaccattcaaaacggtagtaaccatactgcaataataactgtcctagccctccgcctccaacaaatcctgcaagagtcgaacatgaaatgagatgaacaacaagagacttaagagaaaatatgagctgtggatagctttcaggtagaagtataccaaaaagaatattccttttaggaattcccaaagcaacggcagattcaagatagttaagggctgaattacgaaaagcatcaaccactatagtaacaacaaaaggaatggctccgatagtgagaggaacaatagaagccgtagggcctaaagaagtccctacaatccatcgcgtgatcggaaaaagaataacaataagaatcgcaaatggaatcgcggtaagaaaacttagaatcattgagattgttgcgtaaaggcttttcttaggattaagactcttaggcgacgtgcagaaaagccccaaacctagcatccctccaatagcacaagagaagaaaaaagcagtcgacaccatataaagtgtattgactgtttcttttaataaaatctgaataagatcggattgcataatctttttctaataaaattctttaataacgacgcctagctcaattaaaagctcttttgcttttttacgttgctcaacttccccttccaaaacaataattagaaatcccattggggattttctaaataaattaatgttgccggaaagaatattgatagagaccagtccagtctgaatcaccttactaatgatcccttgtatagcgagttctttggaaaaatttaatctaagaacttcttccctgtcttctgcaaaataacacgaactcaaagcagcaatatttatatcttcatggaacaattcatttgtaattgagttctcagaatttaaaaaaagttcttctgtagttcctagttcttcgacagcaccttgatgcattaccaaaacatgagagcatattttttttactacatcgatctcatgcgacactaaaactaaagtaattcccctttcctgattcaattgaagcagcctttcaataatattttcagtagatttaggatccaaagcagaggtaatctcatcacaaagcacaacttcaggttgacacacaattgccctggcaatggcaacttcttgtttctgaccaccacttaaatttcctggataggcgtcatgtctatgatagaggtttaaaaaattaagagtatcgtatacctgttcctcaacttcactcttagacatttctgaatgatgaatacgcaaaggataggctatgttttcaaatacggttttcgaagaaaacaacccataattttgagaaatataggcaacttttttagaaaaattacgacgtgaaaacttctgtgttggcaaagagttatcaaacccagctacacttatagagccagatgtcggcatgtcaagaaagtctaaacaacgcaaaagcgttgttttcccagaaccgctatgaccaactataccaaaaacctctccaggatagacagaaaaggagactttggagagaagaatatggtcgcctaacttcttactaacatcttgaacggaaatgataggagaatgttgttctgacacaagccacgcctctccttttatttatgaatataaaatagaatacaaagaatcttgaagattcgttaaccattaaactataatactattatatttctgcaagcaagtttactgctcttaaaattttgttatcaaactatctantataaacaaaaagagggttgaatagatgtaagttctatttcaaacgacacaacatttgatctactatacaacaagatttcatcgaaagcattttcaagacgaacttcttggtgacgatacatcacaaaaaataaatagctgcgattttaaacagacgcatcaaaaatatatagaactaagaacaacttgaaattttaacataataaaaaaaatactccttaagtcttttataatacattaaaaaactaatacttaacttaataaactcgttgataaagttccttgacaaatccctgggttaaccccaaactgagctctgaataagcttaaggagacacaccctcatgttgaatattcatgatattctaggaaatgatgacgaaaacctattgtcatatcaatgtaaacacattacaaaagacaaactaactcttccctctcatgattttgtagacaaggtatttggactctctgataggaataatcgtgttctcagatccctacaaactatgttttctcatggaaggttagcaaattcaggttatctatctatacttcctgtagaccaaggcatagagcactcggcaggagcctcttttgctattaatcctatatattttgatccagaaaacattgtgaagcttgccatagaatctggatgtagtgctgtggcctctacctatggaacactgagcttactttctaggaaatatgctcataagattccctttatgctaaagctaaaccacaacgaactcctctcctatccaacaaaatatcatcaaattttctttactcaagtagaagcagcttattcaatgggcgccgttgccgtaggagctactgtttatttcggttctgagacttctaatgaagaaattgtagcagtttctaatgcatttgctaaagctcgttccctaggtcttgcaacagtactttggtgctatctacgcaatccagcttttgttgctaatggagtagattatcatacggcagcagatctaacaggacaggctgatcatttaggcgctaccctaggagccgatattgtgaaacaaaagctccccacatgccagggaggatttaaggccatcaattttgggaaaacagacgaaagagtgtattctgaactctcttcaaatcatcccattgatctttgccgttatcaagtcttaaatagctactgtggcaaggtaggcctaattaactcgggaggaccttcagggaaaaatgattttacagaagcggctagaacagcagtgatcaacaaaagagcagggggaatgggtctcattcttggaagaaaagctttccaacgtcccctatccgaaggcatccaattattaaacctggttcaagatatctatttagatcctaatattacaatcgcttaacttttcaaagaaggtctttatgcactcccactcaaaaccaacgaaaccgttgggaacattcacggtcggcatgttatcacttgctgtagtgattagtttgcgtaatctcccgttaacagcaaaacatggtctttccactctgtttttttatggactagcagtcatatgttttatgattccgtatgctctgatttctgctgagcttgcttctttcaagcctcagggaatttatatttgggcacgtgacgctctaggcaaatggtggggattctttgctatatggatgcaatggtttcacaacatgacgtggtatcctgccgtgttagcttttatagcgagtaccattgtttataaaatcaatccagaactcgctcacaacaaagtgtacattgcaaccgtgatccttgctggtttttggatacttacattttttaattttttaggaattacttcttccgcattattcagctctatttgtgtaatcataggaacattaattccaggagtcatcttagttagtttggctctcttttggattttttctggcaatcccattgctatttctctttcttggggaaatcttcttcctaatttcagtaacgtatcttcacttgtactactagctggaatgttacttgcgttatgtggtctagaggctaatgcgaaccttgcttctgatatggtaaatcctagaaaaaattatccaaaggcagtcttcattggtgcaatagcaacactcactattttagttctgggttctttatccatagcaatagtgattccgaaagaagaaattagtttagtctctggactagtaaaaacgtttaccttgttctttgataaatataacctctcctggatgactggaatcgttgtagtcatgaccattgcaggatcgctaggcgaacttaatgcttggatgtttgcaggaacaaaggggctttttatttccactcagaatgactgtcttccccgactctttaagaaagtaaatagcaaaaatgttccaacgaacttaatgttattccaaggtattgttgtgacaatattcacacttttatttctatgccttgattcagcagacctggtgtattggattttaactgcactgagcgtgcagatgtatcttgcgatgtacatctgtctgtttcttgcaggaccgatcttacgtatcaaagaaccaagggctcaacgcctctattctgtaccaggaaagtttttgggaatctgtacgatgtctatcttaggaattctctcctgtgcgtttgctctttgggtgagcttcctgcctcctagagaacttgctcagatatctgaaggcagcaaaataggatatactacattcctgcttttagcatttagcttgaattgcttaattcctttcggaatctatttcacgcataaacgcttatctaaaaagagctaatctaaaagcatttttgggaaaagaaaagaaagaagccttccttgttgtatggcagcctggaaagcttctggattcaaatttgctctcctgcaaaaagtttcaatctctccttgacaaataagtcctgtttgaaaatatcctaaatatatcgcgtgtaaaagcttatcccataaatgtataggcattaataactttaggtatttacctacagatatgctgaattcctctgattccagtagagcctctaagaaaatgaatgggttttgtttcatcttctttctatcgatagccattagaatctctgccccctgtttgaaccgtcgagctcgcaaaagctgtggtatcgatgtaatagacaacgcaggaagaacaagttttttcaatccttccttacaagcttccttggtcttattgaagtcttcttgctgatcctcggcatctttggcacaatcctcactattaatactttgccaacagctgggatctggctcagggtatagagcattcggtactattaaatccaaccttaatgacagttggtttagcaaggcgacttcgtccccttcaaacagatgatgtaaaaatggagtaatatatttctttgttctacaaaattttgcacctcttcagaagaaaattggggacaaaattgctgaataatcttaactgcctgagacctatcatgactagatcgtaaacacaaccctgaaagtaggagattaatgcttatcaggcccaaagaacaagattctatggtttcagctgtttcactggaaatttcgatcccaagggtcgagtgtttcttcggatctagcatacttttcaatcacataggatctaaagaaaataatacttctaatatctcttctcctggagcttctaaaatttctagtaaaacttcataaagaggagcaattgaggaattctttaaatctttcttcgcaaattttataagaagcttcactgggttagggggtgattttcgaaagctaataatcttagcaacagcattttttataagatcttggaagtatgagagtcttcttccctactctcattaggccttccctgctcatctagaaaatttgaataaggaagcatcttcggcctacggaaatcatcagctggaaagttcttaagaagttcatcaattgcagacactgaatcttcttctcgacctaagagtaaattaagatcctcatcagagaaaaatactgaaggactggttatagaaaagaccttagtcttttctatagaagattgctgatagaataaataggcaacgcaaagaacagagcagaccgatagagggatcagcatgcccaaaacaaacgtcccaacactaatgatgccacaaaagtagagaacagacatcagtgtggctatagctaagatagctaaaatcaaataagtaatcggtcttaaactacttttcaatgaaagaccatagctacttgtgttgttcactacaggctcatctatgactggtacttggggagcgggtatgttcatatctaaaaatcaaataagtgttgtaataaaagatccagaatttttccagaacctatcgcttgcgttatctctttgaaaggaactcctaaatgttctgctataatcttaagttccttttttctagctatgccagaacaaagcattcccattagcataggacgaaaaagcgcagcccaattactcatcggcattgctttctctaataaaccttttaagaaagtctgacacttgggattctcgtgtagcaattctattaataaaaatgggttttgtaaaataacagattgttgatttgagaagaatgtaaataaaagggagaagtccttgtagtggctagctacagaactagtaaaattccaactggagggtgacggtatcttctcacaaaatgctaggcgctcactcaaagactttttaagaacgcttagatctttaaagtcatacatatactcagaagagttgattgccggaacgtagttgctcccatctttagctgaaggaagttcctgagcatcgcttgggaaaagagctcgaaactccctttgcatctcagaagactggaaagataaaagaaactgcactatatttcctgcttctaaatgcgcctttaactcgtcagtaagaagattagggtcgtatgcaacgattttttcaatacacttttcctctaatgaccatccatagaaccaaaaattaatagaaagtaccaacttctgcatatgaggagtgagctttcgtttttccgtttttaaagaattcaggtgcgcaatcaactgttgggtcaccatatttaaaggctctggttttgttaaaagaagaatgagtaggtcagagcttgcatattcttctactatagatcccagacgccttaaacaagcggtcaaagagtactttaccttgcgactcaagaaacgaggaagaaaaagattcttaatttcagagatgactcccctgagcaagctaccagaactcttagagctttcctccagagcgcgagggaagtcaacaattaacgttgtgatctctttttctagagactgcattcgctctgctatcggcttagaatagactttattctgatgataaaatgtactttggataacatagggcttaaaatcatcttctactattgatgggattttagccttaaaagaaacggtcttacgctctttgggaagactttgaccttcaaccggaacaggcttaagactttcagggtcttttatttcaaggtctttggtggggtctatcttttcttcgttagagggctcaattaagggttttcctcccttatacaaacacattagggaaacaatggccatcatggagcatactgaagcggcacacccccaaacaagaagacctagaggagcggcaagtacatgacaccctaccaaagcgaaaacaacacccagcaataaaagaaccgaaatggctaaaagacagagaatagtcacaggagacaatgagaaggactgattcttcctgtaaattaactcgtgacttgctgtggtctctttatttgcagtgaaaaaaaataaattaaacaattctttttaaaaaagttagttaagcaaaatcgacgaaaatattatacaaaactaattaaaaaagagaaagtttatacctccggctatcagaaaaaagattatcattgacataatatcatttagggctgtgacaatgggcccggaggctaaagccgggtctactcctagcttagcaaagaaaaatggggataaaacccctagagtcgtagctgtgagagaagctcccagaaccccagtagccaccgtaacgcctagttgaatacctcctccggagaagatatttaagcctagaaagcccattaaatagacaacaagaccacatagaatccctaaaacgactcctgtaagcagcccgatactcatttctttaaaaatggtctctcgacgccgtccgaaagaaagcgtccctgtagccatactccgcactaaaatagtgctacattgaacacctacatttcctgacattccgttaatcaaaggaataaagaagataatcagagctaaaagggcgggggaaattttttggaaatatgccatgacggaggcgctaatcaaacctgcaaatagagtcaccaaaagccagggagctcttagtaaaaatctttgcacaacatgacaggtctgataacccacatcttccgtagtacctgccatcctagctatagtctcatcagcgatgtcctcgatagcttcaacaacatcttcataagtaatagccccaatcaagaaattttcctcatcaacaaccggaagagcggcaattttatacctctctacaagatcgacgacctcttcacgggtagcatcaggaagcaccttatgttcaatctgattcataatttgctttaaagacatctcgggagggttaatgatcaaacttctatcggtaacgacaccttgcaactcgcctttaaaatccaaaacaaagaccaaacgagttaaatcaatcccaggattacttcgaatacaagcagaaacgtctttcaccgttgtttccatcaaaaaggcaaaaaactcattggtcatcagccttcctgcagtatttcttccgtgtttctgcaaatcacgaatttttagtgcttttttagaatctataagctcaagaattctccgatacctacgatcggggatatcatctaaaacccataccgcttcatctggaggcatctgttcaattaaagcgcagacctcagaatccgacaacctacgaaaaatcgcccaccgcgaagcagaatctgtattgatgataaacgcaactttagcggtaatacaagagaggttcttatataaaatagcacgcgattccgagggaagacaggaaacagcataagcaaggtctatcgggttatactcaatcacaattttagaaagatcatgagaatgtatatctgtagaaagacaagtaaatgctttttctaacttaaaactcagctcgtcatctagatgactcgtcctggaatccatcaagttcccagaactaaaagctgtatctagtttctcttcatttcggttttgttccccaaccataatcttcccttttgattctctacaacttcacgaaatgcatggatttccctgaggttagctaaataaggatcgtttaaccacttggcttctgtaatacgaacgccatactgcgcagagcgaatgaccattccccacgccttgttcacatctttgatcactgcataaaactttcccaaagtataatacgcctctggacaccccaaagaagttgccttctctaaatatgttctagcaagcttacctaaacacacattcttatttttccaaaataggaataagtatacttttcctaacagtagtaagaaattctcatcttcaagataaacttcaactagaggttctaaaatctcccgtgcttcttcagccgggtctgtatcttgtagtaatcttcctttccccaacaaaaccgcagcaagaatcaatttaaccctagaggaggataaagtaagatctaccttagttaaaagtgtgtatgcctcatcataatgaaacaaactttgttgcagttcggcaagcaaataatgagattgtccccaaagttctaggatttccagtcgaccacttaaatcccacgctctctgataatgtaacagtgactctgataagaaaatttctttataagcttcatcgattgtggcttctgccaagcattttaatgctaatcctcgatcactccaaaataaaaaagcctctggacgcaaagaacataacctacttgctacatctacagcttttcgtagcaatctagcactttttttcttgatcccccaagaaaaatatgcatcaaataatttttgccacattcctgtcgcatccaaatcccattctaaacaagactgaaaacaagaaatagcagaagcaaaatgcgagtcctcattgaaataaagtgcggagcaaagctgcacaacaccaagagcatggactaacgcactattgccaggaaacatcctcatagcagaaatcagcctgtgccgactatctttaaataaatttggttcttctaagtataaccctaaaatagcaatccctgtagctagtaaacctgaaagcgcaatgggatcattcgtctttttttgtaaagaagccagtttttctaaaccaacttcaatatacttcatattactattcaaccatcccgaacgaatgaggagctcaccccaaaccatccatagccctgaaagattaggaaacgcctgaacggtttggtaaaggatgttcatagcctgatcaaaatgctcttttttataagtcagatcgaataacttcacagaagcaagagcatagctataacgataattttgataggcaagggtgtcaccatccctgctgaaactcagaaaaatggctttagaaaaatgctccatccctctttctatgagcaaagactttccctgtctagttcctaaaactaccaggcccttagcatagtcagcatggatatgagcattattaggtgataaatctagagctaaggccagacatttcatgccgcaggccaaatcactcaattctaagtgcttgtggtataattctataaaactacggcccacagcctgatacacagaagcacttgctactaaagaaacctcttcttgcttagctcctatacggaagtgctcccatccaaaacgattcttcagttgaggatgcattttcaaaagctgttctattaaacggaaattatctacaacttcagagagaaatttcatctctcccgtctgagaataaagttcaaaattgatacaggttcttgcagagcacaaggaaagcctatcagaagcactaattcctaatttttcaaaaagaaaatctatataggtcaaaacatcaatgaaaatcgacatacttttatgttttaaaccataagagaccccatagaaaatcactctctttacaactttagggtgattgtgagtcatcattaatagagaccgagacaaagctaagtagccctcgctcggttcgtcttgttgtgccaataattcaatttcagagaaaaggaaatcaaccacatcttctggacaactgaactcatcctgcaagcccaacatatttaaggctcttttagaggaaataaaaggtaatggtgatctaatcatacaccttctttaattatcatagctaaatcaccttgaaattcatattagaaggtgttcttacccactaataaaaactagtttttgaaaagaattctaaaaaccttcttttaatcttttcaaaaacaagaacatctatttcttattgacaaagcacttcatcatttcatagcttcaaaactgagatcagtctatcctatttcatttttcaattaaaaatattttctatctctatagtgacagttatcccctttagaaaaggctgcccatcgtctttaaaacaaagagcctgtcactataaatcttgtttaaaactcgcaaaagactctaggttaaattcttttgatacttaaacaataaaatttttagcactgtcattccccgaatcagggatcacacttatatgtggatatctaccactagtgtcgagccctcgtctctcagggagctggattgagggatgggctccagaaacaatttctcctttatcaaaaaggaagacagattgtggctggcaacacaacatcaaataaaaagcatgctgtcctaaacctttacgccccccacctccttcaaatcggaataaggaatgagcctcattggctaaagatacagatcgcgcaagtatcacgttatcattccaatctctttctacactccccatcaatacacggcctgcaagagggtccaacaaactataaaaagctcctatcatacatgcagaagcataaaaaggagctttcaaaaaagcagcaagagaccgccccatctctcgagcaacatctttataaataaatctatcgtcttcgggaagatgtttacagaaaaaatgctcgtaaatcattcggaaaatgatataaaatggaaccactaaaaagcgtatcaaattgtaaatcattctaagcaaagctacaaaaggcatcgcacacggaattccaaaacaagggaatgcgcgaaataataatggtggacattgataaaccgcagctattccagaaccgtcagcactcagcgtcgatatatctagataagagcaagcactcacgtgcttttcatcgaatttttccaaagtatggctggaggatataggaacccaacaccgtctgctaaaaggtggaatacacacccctgaaattacatctactttcttccccagacgatgcagaatgtacatgcctccagtaagcaaaattgttgggataagaattgctgcagtaaccaaaggccaggaagtaattacaagtgtaccttgtatgctcgctaacattatactgaatagaatcaacacacccacgacagcaagagcgatcaccgtgagcctcacaaaaaggttcgcatcatatttattcactttacaaacagaaacggacagggtatcagatctatgctttcgcaatgctgaacgaaaatagctttgccatccttgtttggggaaagatgccttaggactaattggtcttaaactttcgtttgtagatgtaagattaaaacaagacataattacattataaaattttgctcggcattcaaacccaaagaaaagaaattcacgaattgttatacttatttaccaattaaaattttaatcgacttatgaaaaaacaacgctctcattatacaaaaaataatcttttattacttctttctatattggttggcctaggtttaggaagtgtgcaatccccatggattgtttattctgccgaatgcatagcaaatacttttctaaaattcttacgtttacttagcattcctttggtattctgcgctctcggctccaccattacttctatacaaaatttcaatactatggtgactctaggaaaaagaattttatattataccctgctgacaacagttatcgctgcttccattggacttctgctgttctttttactccgtccccaaatgataactcaagatgccctagccacaactacaaagtgtaatcccctaggatacttggatgtccttagcgacaccctcccagaaaatatctttaagccattcctccaaggaaatgtcatttcagccgcttgcctagcagtcctgctaggaaccgcgtccctatttcttcaagaaaaagaaaaacatttcgtaaatcaattttttaattcatttttttctatctttctcaacctggctagaggcggtctaaaacttctcccaatagcaatgctcgggttctctgtcatcttgttcaaagaattgaaagatcaaagcaaccttacaatgtttgccgagtatctgctttgcgttataggagcgaacctcgcccaaggttttattgttctccccatactacttaaaataaacaaagtctctcctttaaaagtcgcaaaagcaatgtctcctgcactagtgacagcttttttctcaaaatcatcggcagcaacattacccctcaccatggaacttgctgaagatgatttaaaaataaataagaatctttctcgatttagcttcccgctatgctctgtcattaacatgaacgggtgcgctgcttttattctaattactgttttgtttgttgcgacttccaatggtatgatcatttcgcctctaatgtctttaggatggatttttattgcgactctcgcagctataggaaatgcgggcgtacccatgggatgctactttcttactctttctcttctcacatctatgaatgttcctttatctatattaggtctcatcttacctttttatactgtaatagatatgatagaaacttctcttaatgtttggtctgattgctgcgtagtcagtttagcaaactaacaactctcaaaaaaactctcactataaaggagtgctttaaccatgaataaaaaacacgccagtttttcatctcgactaggatttatattctctatgatagggattgccgttggggcaggaaacatctggcgcttcccgagagttgctgctcagaacggaggtggtgcattcctaattctctggctatgttttttatttttatggtccatacccttaattattatagaactctctattgggaaactaaccaagaaagctcctataggggctttaattaaaactgcagggaaaaaatttgcttgggctgggggcttcattacccttgttaccacttgtatactcgcctactactctacaattgtaggttggggattaagctacttttattatgcagtttcaggaaaaattcacctgggaaatgactttgcaaaattatggacatcccactatcagagttctatccctctctgggcacacctcacctcattaggattagcctatcttgtcattcgtaaaggcattgtccatgggattgaaaaatgtaataaaatcctgatccccgcattctttctatgtaccatcgctctacttttacgagcagtgactcttccaggagccgttcaaggaatcaaacaactctttagttgtgataaaagttgcttttcaaactacaaagtatggatagaagctcttacgcaaaatgcttgggatacgggagccggatggggcctactgcttgtgtatgcgggctttgcctcaaaaaaaacgggagtagtgagcaatggagctctaacagctatatgtaataaccttgtttccttaatcatgggggatcattatcttttccacatgtgcttctttagacattttaggaaccacgcagctacaagatggagcaggagcntcaagcatagggattacctttatctacctaccagagttatttacccgtttgcctggaggaatttatctaaccaccctgtttagctctattttcttcctagcattttctatggcagcgctttcttccatgatttccatgcttttccttctctcacagactcttgcagaatttggaatcaagccctacatttctgaaaccctggcaacaatcattgcctttgtcctagggatcccttctgcacttagtctcacatttttctctaaccaagataccgtttggggagttgcacttattgtaaatggcttgatctttatttacgcagctttagtctatggcttccctaaactaaagaaagaagtcattaacgctgctcctggagatctccgactcaacaaagcctttgattatataatcaaatatttactcctaattgagggaattcttcttttaggatggtatttctatgaaggactcttccctgaaaatggtcagtggtggaatcctatttctctctatagtctgggcagtttagtcctgcagtggtctttaggactcataatcttatggaagttcaataaacaactttatttaagattttcccgttacaatcacgaaattctataaatccaatcgataattctactctgaatattcagggtagaatcacagcattttggaaagaaaaaaatatttaaagattgaaaataacgtttttcctggcctagtatgtttggcattaatctatttttagataggaaaaacatatgtcagcacctataccaaccccacaagaattgtcagaccaaatcacctgcttaaatgtccaataccaacaggtatccgaactagcaagagaaaacaaaggagatattgaaggcttaaaaacactgactgcggctctaaccgctgatgctggcatacagccttcagctgatgaaatttactcattgcaaacagccgcagccctaatcttatctgcttccgaaaaacctggaagcggtccctctggaagtactgaaggatctgttactgttcaatctccatgcaaattcaaaaaagtactagcagtcgtattaacgataattgctttaattgcaattgctgtacttatagcttgtattattgctgcttgcggaggtttccctctacttctatcagctcttaacctatataccataggtgcttgcgtatcactaccaattatagcttcaacctcggttgcgcttatttgcttgtgcacatttgtagcaaactctctaattaaacccgtaattactgtccgtacaacaagataataagtaaaaaacacaaaaaatagtgattttatgacctcaccgatcccctttcagtctagtggcgatgcctctttccttgccgagcagccacagcaactcccgtctacttctgaatctcagctagtaactcaattgctaaccatgatgaagcatactcaagcattatccgaaacggttcttcaacaacaacgcgatcgattacnaaccgcatctattatccttcaagtaggaggagctcctacaggaggagcgggtgcgccttttcaaccaggaccggcagatgatcatcatcatcccataccgccgcctgttgtaccagctcaaatagaaacagaaatcaccactataagatccgagttacagctcatgcgatctactctacaacaaagcacaaaaggagctcgtacaggagttctagtggttactgcaatcttaatgacgatctccttattggctattattatcataatactagctgtgcttggatttacgggcgtcttgcctcaagtagctttattgatgcagggtgaaacaaatctgatttgggctatggtgagcggttctattatttgctttattgcgctaattggaactctaggattaattttaacaaataagaacacgcctctaccggcttcttaaaaaaataaattgaattagaataagtaatagtaattttcttcatacctcccttgcaattaatcactttgttcttataaaatgtcttcttttgcttgggtaggtatggagtatgcagagagttttgcgactgctgtttaacctacatcatggggaagaaaaaagggctttccttttttttctcttgggattggtctgggggataggttgttacggcactctctctctagctgaaggcttattcattgaaaaattaggatcggcagaattaccaaaaatttatttaggttcttctctgatcctttgcgttctttcatccctaattctttacaatctttttaaaaaacacatctcagcaacagctcttttcttaattcctgtttctttatctatcctttgtaatttttatcttattctctcttctatctttgctatcgatcccccccggtctcctctgtttttctatcggattgtaatttggagtttaacgattctctcttacacgagtttttggggatttgtagatcaattttttaatttacaagatggaaaacgacacttctgtatttttaatgctatcatcttcttaggagatgctatcggcagcggaatcatagctagcctggtacacacaataggaatccagggcatcctgattttatttacagcagccctggtcctgacattccctatcgtattctatgtttcaaaatctctaaagtcgctttccgatgaccatgaccttttcatagatacaggccacccaccacccttatcaaaagcattgaaactctgtttttatgataaatatactttttatctgctttgcttttattttctcatgcaattgctagcgattgctacagagtttaactatttaaaaatctttgaaattcaatttgcctctaaggaagaattcgaactcgtcgcacacataggaaagtgttccctgtggatttctttaggaaatatgtgctttgctcttttcgcctacagtagaatagtaaagcgtcttggagtcaataatatcattttatttgctccgctatgtttcttaagcctctttctattttggacctttaaaacaaccctaagcattgctgtccttgctatggtagtacgtgaaggcgttacctacgctcttgatgacaacaacctccaactactcatctatggagtccccaacaaaatccgaaaccaaattcgcatcgtagtggaatcctttatagaacctatcgggatgttggtctggtccttagtctgtttcttgtcttctcaacaatatgtgttctgcctaatcatctcactaatcgccactattctggtttgcctcgtacgctcttattatgcgaaggcgattctcaaaaatctatctgcacaagccctacaacttacccgctctatgcaagattggatcaaatctatgacagttaaacaaaagagacaagtcgaactcttcttacttgctcatcttaaacaccccagtgagcgtcatcaaacctttgcttttcaacatctcttaaatctagcaagccgcagtgtccttccaagcctccttgcccatatgaacaagctcagcctccctaataaactcaagactatagaaatggtaaaatctagcttatgggccaaagattttctaaccttagagctcctgaaacgttggacaagtattttcccccatcctgccatcgcatcagcaatacatctttattttgcagaacacgatctcctacatatcactcatattgctgaagacctctatgatactgttggtgatagacttcttgccgcaattcttacagtaagaagacaggaagcttatgggccctatcgagaccttgcagacaagcgcctgaaagaactactcaactcggatcaacctgaagatatagtcatggggttgaccatactgaaattagaaaagaatccacagaacttcccaattcttttagacttcttgaacaccaaaaacgaagatatcttaattgtcacctgcaaagccctacacacttctgttagagctaatcataaaccttattgccccgaacttctgaaaagactacgacaatgctcgcataatgatgaagcaagtcaatatctattaaaaacaattagcattgctttagatatctcattcgtaaaagacttactgatgacaacatcacaactaaaaaacacctctagaaaatatgctgaggctatgattggagagttggataaagaagtcgccccagcatttctccaagtcctcaccgatgagggaacacacaatcgttgtcgtatccttgccgccaaagccctctgtaaaatcgataattggctgctgaaaaaacacgcgtataaaattgtgaagtctaaagcaagtaaggctctgttctattcctatcacggccattacattcaaaagaaataccccacatacaacctcagcttgctggcaaacacattaaattctaattattatgcagaagtaaacttcatgctctctctcctagggattcttggttccatggagcactctggtgtactgattcgagcattaactagtaaaaaccaaaaaatcaaagcacaagcactagaatctttagaaaaaaactgcgatagccacttattctctttactagaaccctttgttaatcaaccaggcatgtgctatagcgaaaaatactacttcaaatgtggtgtgattcctctaactcttaaagaacttttaaatatgatggaaaactccccatcatctttaaacaaactaacagcacagcaactcaaagaagaactttcctattgcgatccagactttccaatctgtaaatacaatctataaccaagaacatgaagacttcaggacagaggaatcagaaaccctaatatctttcttatctatctaaacttcaatgattccaatttagatatccacagaaaaaccttgggaaactgaagatttaaaaaaaccaagattgatttataagtttcgactgcaagaaaaatcaatttcaacggttccttcttgaaactcttctatcttaaaggtaagatctacgtatcaagtattacatctgtggtgatattaaaatctttgattttaacaacactgattcttcttaaaccattgtggaggcttttctttaaactacctgcatcgtagttattgcttctatccttcccaaaataatacaatccatctcaaggatacgtctctgtgcctttacttttgtcaaaaactaaaactatggtgtgaataaggaacttttttatgaatttgatcgatcgcgcctttctactaaaaaaaacgattatattccaatctttagacatggaccttcttttaacaattgccgataaaactgaaacgataatatttaagcctggcagcaatgtattctctataggacaacctggattcagcttttatatcattgtagaaggatacattacgatctctaaagaaaaactagagtctcctctaaatttaaaacctttagattgttttggagaggaaagcttattcaataataagcccagggaatacaatgcttctgcaaatacacaagtccgcatgctagttcttagcaaaggacaaattctaaacattgtggaagagtgcccatccgtagctttatcttttttagagctctatgctaaacaaatcaagttcagagaaccttaaaaagacaaaataaatctttctagatgagctactctatagaaaaaaaggcacgccgtaatcactattgaaaaacaatagctttaaaaaagattacgacgcacccagaatataagaaagtttattgttcagcttgacgtttcttaatataagtaaatacatccccgacagtacgaagcttctcagcatcttcttctgaaatttcaaaagcaaatttttcttctaaagtcataatcaattctgttaaatctaaactatcagcattcaagtcttcaataaaagaagagttctcattaacttcttttggatccactcctaactgctcaacaataattgctattacatcatcttctaaactcattgcttatatccttttactatttaaactatacaatacttcactattccctagggacaaagagaaagagaattagtatcgcaaaaaatcattttttattcgacggttacttaattagttctcgaagagaaattttcaaatccctttcttctattgtcttagtaagtcaatcccccatcaacaaccagtgtctgcgcggtcatatagctcgataactgcgaggctaaaaacaacgccacacgagcaacatcttctggagtgccagccctacctaaagggatcgacttaagccactcagcttttaaattgtcattcaacacgcttgtcatgtctgtttcaataaagcctggagcaaggcagttgacacgaatatttcttgcagctacttccttagctaaagattttgtgaaagcaataatcccagctttagcagcagcatagttggtctggcccgcactaccgatcttagcaacaatagaagccacatttataatagatcctgaacgcgccttaatcatatggcgaatcactgaggaacatgtataatacaaggaagtcaagttggtgctaatcaccgattgccagtcgtcctcagacatacgcatcaacaaattatccctggtaatgcctgcattatttaccaaaatatctattttgttgtgcttatctaaaaatttctgcacgcaatctttcactccaccattatgactcacatccacacgagcaaaagaaacttcgccacccaagcctgttaaactttctataacagcctgacctcgctcctcattcaatccccaaatttctacatctgctccgttctcaagaaaaagcttaactatcccgagtccaattcctcgagatcctccagttactataacttttttgcctactaatgttatatccatacaaatcatacctctgataggaatttttcaatctgagcaaaagtaccaagacttgtaatcggtttagaaatccctatagagcgatttaaaccagccaaaacttttcctggacctaattctaaaaactcatccacctctgattcgatatggtaacaactctgataccataacgtaggtgatgtcatttgccgagctaaacactctcgcatttcttcagtatttactaaagattttcctaccacgtgtgacactaagggaaggctagaatctttcatgcataaagcataaatgtctggagctaagccatcttgagcaacttgcattaaaggagtatgaaatgctccagacacctttaaacgaactgcttttttacatcctaaatcacgaaataactcaatcgcttggtctactttttctgctattccagccactacaagctgtttgggtgcattataattagcaatccaaattccttgaccaagacttgttatattttcctctataacttcagagggaagccctaataaagccgccatagcccctgggctctgattacaagcttcattcattaactgaccacgctttctaacaagctcaaggccgtcgagcacggagattctatcggaagcaactaaagcagtatactcccctaaacttaatccagagactaaagaaggctgaatagaagaacgctgggatagaacctttaccacagccatgctatgaagataaatagctagctgactatgtactgtttccatcaaaagatcctcaggaccttcaaacataattgaagtcagagaaaatcctaacctttcattagcaaaatcaaaaagctctctaacctcaggatactccatatataggtcttgtcccatacctacatattggctcccttgtcctgggaacaaaaaagcataacgttttttcatgaaattatcgtccttattagacctgctttaaaactactgcgccccaagacaaaccgcccccaaaggcaactaaaagtaaataatcatcaagcttaatggattctgtatgaactaattcatccaaagcaatgcccacagacgaggccgcagtatttccatacttatgtacactcttaaacactctagactcatcaatctcaaaacgcttcgctaaagcatctattattctttccatttagcttgatgaggtacaaaccaatctatatcctcttcctgaatgcctgccagggctatcgaatgtttagctgccgtttccatacgtctcacagcatgcttaaaaacttcttttccctccagagcaataaaatgtttgcctgattgtaaagtctctttagaagcaggacaacgactacctccagcaggaaggcttaatactctcctagcttaccatctgcgcctaaagacaacctattaatctctaaagatcctggccgactctcccctatgacacaagcagctcctccatctccaaacaacacacaggtattccgatctgtataatctacaaaagaagacaacttatcagcagcaattaacaatacatggttatatgtacctgattctacataagccttagctacagacaaaccatacaaatacccagtacaagccgcctggcaatcaaatgtagggacatcctcaatgcctaaatgtgcttgagcaagactccgcttgatgggaaaatataatctggtgctgctgtcgagaaaatgatacagtcaatctgatccttgcttaaacccgcatttgctatagctttctctgcagcgatggctcccataagagaagtgtactcctgaggtccagcaatacgacgctctttgatccccgttctggtcacgatccactcatcagaggtatctaccattttttctaaatctgcgtttgaaagaactttctcaggcaaataggaacccgttgcccaaattgctgcttttttgtttttattcacagagaaccacatgtaaagaaaaaagctagtatactattcagagagtttatactctaaccttaatttaggccccagacccgaatgtaaaaataaaattcacatcactatgacaagatatccagattacttatctaaattaattttctttttacgaaaacttccaggaattggatttaaaacagcagaaaaacttgcttttgaactcatctcttgggacagcgaacaattaaaaatattaggtaacgcttttcataatgttgctagtgagcgtagtcactgtcccctatgttttactctcaaagaatctaaagaggcagactgtcacttttgtagagaagaaagagataaccaaagtctatgtattgtcgcttctccaaaagatgttttctttctagaacgttctaaagtattcaagggacgttatcatgttcttggttcactcttatcgcccattacagggaaacatatagaaaacgagcgtctctccattttaaaatcacgcatagaaacgctatgcccaaaagaaattatcctagccattgatgcaaccttagaaggagatgctactgccctttttctaaaacaagaattacaacatttctctgtaaatatttcccgtctagctttaggtcttcctataggcttatcttttgattatgtagattcagggacactggcaagagctttttctggacgacactcctattagcagctctcttatcctaaaagtaaacaagttctcttctatgctagtctttcttactttcccctaggacacagtgaattatcgaatttgccttaaaaccatgtaatcagtagagttatttgagcgacaaggtttattaagctttttaaggaagcaaaaaacccgccgaaatattcaggctctagtctgagcacagtaataatcccggtgttaggacgggaaaaaatcaaacacaatttaaatttctttagaaatacaaaaataatctaagtagtaaggtcttgttaaaaaacttctttgtccctatttttgtgcttacctcattatctgataaacaagctttctatctagggaagactcttgggaatgctcatcatgcgaaataaagttatcttgcaaatatctattctagcgttaatccaaacccctttaactttattttctactgaaaaagttaaagaaggccatgtggtggtagactctatcacaatcataacggaaggagaaaatgcttcaaataaacatcccttacccaaattaaagaccagaagtggggctcttttttctcaattagattttgatgaagacttgagaattctagctaaagaatacgactctgttgagcctaaagtagaattttctgaagggaaaactaacatagcccttcacctaatagctaaaccctcaattcgaaatattcatatctcaggaaatcaagtcgttcctgaacataaaattcttaaaaccctacaaatttaccgtaatgatctctttgaacgagaaaaatttcttaagggtcttgatgatctaagaacgtattatctcaagcgaggatatttcgcatccagtgtagactacagtctggaacacaatcaagaaaaaggtcacatcgatgttttaattaaaatcaatgaaggtccttgcgggaaaattaaacagcttacgttctcaggaatctctcgatcagaaaaatcagatatccaagaatttattcaaaccaagcagcactctacaactacaagttggtttactggagctggactctatcacccagatattgttgaacaagatagcttggcaattacgaattacctacataataacgggtacgctgatgctatagtcaactctcactatgaccttgacgacaaagggaatattcttctttacatggatattgatcgagggtcgcgatataccttaggacacgtccatatccaagggtttgaggttttgccaaaacgccttatagaaaagcaatcccaagtcggccccaatgatctttattgccccgataaaatatgggatggggctcataagatcaaacaaacttatgcaaagtatggctacatcaataccaatgtagacgttctcttcatccctcacgcaacccgccctatttatgatgtaacttatgaggtaagtgaagggtctccttataaagttgggttaattaaaattactgggaatacccatacaaaatctgacgttattttacacgaaaccagtctcttcccaggagatacattcaatcgcttaaagctagaagatactgagcaacgtttaagaaatacaggctacttccaaagcgttagtgtctatacagttcgttctcaacttgatcctatgggcaatgcggatcaataccgagatatttttgtagaagtcaaagaaacaacaacaggaaacttaggcttattcttaggatttagttctcttgacaatctttttggaggaattgaactatctgaaagtaattttgatctatttggagctagaaatatattttctaaaggttttcgttgtctaagaggcggtggagaacatctattcttaaaagccaacttcggggacaaagtcacagactatactttgaagtggaccaaacctcattttctaaacactccttggattttaggaattgaattagataaatcaattaacagagcattatctaaagattatgctgtccaaacctatggcgggaacgtcagcacaacgtatatcttgaacgaacacctgaaatacggtctattttatcgaggaagtcaaacgagtttacatgaaaaacgtaagttcctcctagggccaaatatagacagcaataaaggatttgtctctgctgcaggtgtcaacttgaattacgattctgtagatagtcctagaactccaactacagggattcgcgggggggtgacttttgaggtttctggtttgggaggaacttatcattttacaaaactctctttaaacagctctatctatagaaaacttacgcgtaaaggtattttgaaaatcaaaggggaagctcaatttattaaaccctatagcaatactacagctgaaggagttcctgtcagtgagcgcttcttcctaggtggagagactacagttcggggatataaatcctttattatcggtccaaaatactctgctacagaacctcagggaggactctcttcgctccttatttcagaagagtttcaataccctctcatcagacaacctaatattagtgcctttgtattcttagactcaggttttgtcggtttacaagagtataagatttcgttaaaagatctacgtagtagtgctggatttggtctgcgcttcgatgtaatgaataatgttcctgttatgttaggatttggttggcccttccgtccaaccgagactttgaatggagaaaaaattgatgtatctcagcgattcttctttgctttagggggcatgttctaagatataaattaaggacttatcgaaggaaatctttgttgttttcagaaaaggcttttggtaccctttttctatacccaagtttagtacaggtaattatgaaaaaattattattttctacatttcttcttgttttaggatcaacaagcgcagctcaatgcaaatttaggctatgttaatttaaagcgatgtcttgaagaatccgatctaggtaaaaaggaaactgaagaattggaagctangaaacagcagtttgtaaaaaatgctgagaaaatagaagaagaactcacttctatttataataagttgcaagatgaagattacatggaaagcctatcggattctgcctctgaagagttgcgaaagaaattcgaagatctttcaggagagtacaatgcgtaccagtctcagtactatcaatctatcaatcaaagtaatgtaaaacgcattcaaaaactcattcaagaagtaaaaatagctgcagaatcagtgcggtccaaagaaaaactagaagctatccttaatgaagaagctgtcttagcaatagcacctgggactgataaaacaaccgaaattattgctattcttaacgaatctttcaaaaaacaaaactagtccaagtttaaggagttttctatgtccgaagcaccagtctacactcttaaacagttagctgagctactacaagtcgaagttcaaggaaatatagaaactcctatttcaggtgttgaagatattagtcaggcgcaacctcaccatattgcttttttagataatgagaaatactctagctttctaaaaaacaccaaagctggtgctattattttatctagatctcaggcaatgcaacatgcccacctaaagaaaaactttcttattaccaatgaatccccttctctaacatttcaaaagtgcatagagttgtttattgaacccgtaacatcagggtttcctggtattcatcctactgcagtgattcatcctactgcacgtattgagaaaaatgtaaccatagaaccttacgttgtcattagtcaacatgcccatatcggctctgacacatacatcggagctggaagtgtcattggagctcacagcgttctaggtgctaactgtctgattcaccctaaggtggtgattcgagaaagagtcctcatgggaaaccgtgtagttgttcaacctggagctgttttaggatcctgtggttttggttatattacaaatgcttttggtcatcacaaacctttaaagcatctaggctatgtgattgtaggtgatgatgtagaaatcggagccaacactacgatagatcgtggtcgattcaagaacaccgtgatccatgaaggaactaaaatagataaccaagtacaagtagctcatcacgtagaaattggaaagcatagtattattgttgcccaagcaggcattgcaggttctacaaaaattggtgaacatgtcatcattggagggcaaaccggaattactgggcatatttctattgcagaccatgtgatcatgattgctcaaactggagtcacaaaatctatcacctctccaggcatttatggaggcgctccagcacgaccttatcaagaaacacatcggttgattgctaaaattcggaaccttcctaaaactgaagaaagactaagtaagttagaaaaacaagtaagagatctatcgactcccagccttgctgagattccttcagagatctaaaattctatttattttattagttttgaaatcaaaaaaaagaccaaataattaaatatataaagaacgtactcttctttttatcatgagaattttcatgatatttttatttaaaatttctgggctaatcttccctgtccgcaatagttgcatgactattttcattccaagattgaattcatccagattagaaaagataaaacattctccgccagagtttaaagcttttgcagtgtgctctgtattggaaagtatagacgggcttataaacttcaatgaagaaaaatctacatgtaaagcaaggccccgaattgtattcgctaagctatatctcaacgcaataggactcgatgaaactgaaggtaaagtaggcacatcattatcataaatacgtgcttgaatatttccactacgcttgagtccttgaattagtttcacatagtttaataaatctatatccacaatctctttaaaaattaaagtgaaagcaactccatgttgctttaaaacatccccgagctccttgcctagctcactcatgctctgacaattcaaaagagagatattcctataggttaaataataacgtagactatttacaacggtagttcctaaaagaagcggtaggtctagctttttattcacagtaacaacatgctcacactgttgttcgaataatccgcaacacagtaaaacccctcccaaacctatagaatcatttaaatgacaaattacttcggtaaattctacccagtcgctactacatccgggagaataaaaaaataactgagctatttttttatccatcgaagttaacatggcaaacaattccttagtttgctccaactcttcatttttgaatggcaaccattgagttttttttaagtagtagtttttagagtccgtcttacgattctgaaattcttgagcagaagcaacaatacgttttgttatagttaaaagcttttcctctaattcttcatgatctcgagatttatcttcactaggcttatgatcaaagtttttgatgacaccgtctatcgaatccacgtaaaactgagtgtgtcgattaattttacgagaaacgtccatgtgatgtaatcctttttgttctctttaaattgccacgagaaacatattaaaattttttcgattttttaaaaaaacttaattattttttcttcggatagcccttgtcttttgaaacctaggctcctataatgagatcaaaaaccgctcccgaagcgtctcccttataaaaaagttatggatagttcagcaccttataatatagcttctcagggcacagagaaatccacagtagaaaggatcttagacctttacgggcccgcttcctgtattaaatttttaaaacagatggttctgattcgtgaattcgaagcccgaggagaagaagcctatctagaagggctagtgggtggattttaccactcttacgctggccaagaagctgtagcaactgctgcaatcgcaaacacaggactagatccctgggtgttctcttcataccgctgccacgcacttgcgattcttctcaacattccccttcaagaaattgctgctgaacttttagggaaagaaactggatgcgctttaggtcgtggaggatccatgcatatgtgtgggcctaatttccctggaggatttggtattgtcggaggacaaattcccctcgcagctggagccgcatttaccatcaaatatcaagaacaaaaaaatagagtttctctatgctttatcggagatggtgcggtagctcaaggtgtattccatgaaactctgaactttgtttctcttcaccaactccctctaatgcttattattgaaaataacggctggagtatgggaacgtcattaaatcgtgctgttgcaaaacagcccatagcagagtctcaaggaagttcctacgatatccgtgcagtcacagtcaatggttttgatctatttaactctcttttaggatttagagaggcttatcgctatatggttgataccgaatctccggttttagttgagtgtctctgctcccgatttcgagggcattctatatcagatcctaatttatatagatcgaaagaagaaatgcagtgtttatttaaaaaagatcctattgtcctagctaaagattggctaattcgattagaggttctgactgaagaggaatttcaaaatatacgccaagaatgcaaaactgctgttttagaagcgttctctaacgcaaaactctcatcagatccatccgtcaccacattagaggaaggagtctatgcctaaacataaaacattagaaattcgagaagctctccgagaagcaattgacgaagagatgtctcgcgatcctaatgtctgtattcttggtgaagaggttggtgactacaatggtgcttataaagtcaccaaaggcttattagataaatggggccctaagagagtcattgatgctcctattagtgaagcagccttctctggaattggaataggagccgcattgtcaggcctgcgccctattatagaatttatgagctggaacttttcctttgtagccttagaccaaatcatttctcatgcagctaagatgcattttatgactggagggaagttttccgttcctatagtttttcgtggccctaatggtgctgcagcccaggtatcttgccagcattctcattgcgttgagtcgttgtatgctaatattccaggtcttaattattatagccccttcgaacccttacgacgctaaaggcttattaaaatcagcaatcagaaataaanaaccccgttctttttttagaaaacgagctagaatataactttaaaaggggaagtccccaccgaagaatatctcgttcctattgggaaagcacatagagttcaagaaggaaatgaccttacaattattacttatagccgtatggtttccattacaaaagaagcgtgttctctagccaaaaaacgttggggcttgtctatagaaattattgatctaagaacgatcaaacctttagacatatcaacaattttatcatcggtacgaaaaacttcacgctgtattgtaattgaagagggccactacttcgctgggatttcttctgaaattattgccctgattactgagcatgtttttgattctcttgatgctccccccttaagggtatgccaaaaagaaacgcctatgccctatagtaaaatcttagaacaggccactttgcctaatgttaaccgaatcttagataccattgaaaaagtcatgaggtaagtttgtgatctccttattgaaaatgccaaagctttctccaactatggaagtgggcactatagtgaaatggcataaaaaaagtaatgatcaggtcagttttggagacgtcattgtagagatctctacagacaaagctattttagaacatacagcaaatgaagatggctggattcgtgaaatcttacgtcatgaaggcgagaaaatcgttataggcacccctattgcggtactctctacagaagccaacgagccctttaatctagaagaacttcttcctaagacagaaccttctaaccttgaagcatctccaaaaggttcttctgaagaggtctcgcctgcaacaactccacaagctgcctcagcaacattcacagcagtaacttttaagccagagccacctctctcctcgcctttagtcttcaaacacgtaggcactacgaataatctctctccattagctagacaactagcaaaagagaaaaacatagatgtctcatcaattcaagggagtggtcctggaggacgtatagtaaaaaaagatttagagaaagctcctcctaaaagcattgctggttttggctatcctgagtctcccgaagtgcctccaggttcctatcatgaggagaatctctctccgattcgggaagtgattgctgcacgcctacaagctgctaagatctctattcctcacttctatgtaaggcagcaggtctacgcctcacctctccttaatctgctcaaagaacttcaagctcagggaatcaaactctctattaacgattgcattgtacgtgcctgtgctctggcgctcaaagagttcccttctatcaattcaggatttaacagtgtcgataataaaatcgtccgttttgatactatcgatatctcgatagctgtggccattccagatggaattattacgccaattatacgctgcgcagaccgtaaaaatctcggcatgatttcagcagaaattaagagcttagcgttaaaagcaagaaatcaatctcttcaagacactgaatacaaaggagggtccttctgtgtctctaacttaggaatgacaggaatcactgaatttacagcgattgtcaatcctcctcaagcggcgattcttgccgtaggaagtgttacagaacaagctcttgttcttgacggagaaattactataggatctacctgcaatcttaccctatctgtagatcatagagtgattgatggttatcctgctgcgatgtttatgaaacgattacaaaagatcttagaagctccggctgtcctactattaaactagcaatctttgaacaaaaaggactctttctatagctccttggctatggaaagagtccctgattccatcctgtctatttcttaatttccttctccagagcaagattttgtaggaacatgccaaatatctctggcataatcctgaatggctctgtcactagagaaaaagcccattcctgcagtattataaatagaaatcttagtccatgaatctggttccttaaagagtttgttcacattttcatgggcagcgatataagactccaagtcagccaagacaaaaaagggatctccttcatgcagtaggcgatgtactatcggtttaaacagatctttatcattgctattgaaaaatccctgttctagcaaatctaaaacctgacggatcttaggattcttatcacaaattgtctgaggacagtattccctccgcagttgtacaatttgctcctccaaaagaccaaaaataaacatattctccttaccaatatgctctgccatttctatatttgcaccgtccatagttcctatagtcagagctccattcaaagcaaatttcatatttcctgttccagaagcctccattccagctgtagaaatctgttctgaaagatctgtaccaggaatgatatgctcagccatagaaactcgatagttaggtaaaaaaagaaccttaagcttatcattaactcgagaatcttgatttacaacgtcagcaacgctattgattaacttgataatgagtttggccatgacatagccaggagccgccttaccagaaaaaattactgttgtagggacgacatcttgattagggttttctttcaagtcattataaacatagatgactctaagaatattcattagttgtcgtttatactcatgaatacgcttaatatgacagtcaaagagagaattagggtctactatttctccaacttcattataaattctacttgttagatcctgcttattttttaattttacccctttccaatgatctcggaaaccactatcttcggcaaaggaacggatcaatgaaagatgagaaagatcaatgatataacgatcccctatagtttcattgagaagcttactcaaacgaggattacagagagcaatccatcgtcgtggagtcaccccattggtcacattgataaacttctcagggaaaaactcataaaactctttaaagagagtatctttaatcagctgagagtggaatgacgaaactccatttacttttgcagaacctactacggcaaggtttgccatattgatacgcttttgatacccttcttcaacaatggataaagaccggcgcttatcatcatttttaggatagcgagagccaactttttctaaccaacgggaatttatttcataaataatctctaaatgccgaggtaataacttagagaataaatcgagaggccatctctctaaagcctctgggaggattgtatgattggtatagttaaagatgactgtagtcatctcccaagccttatcccaaggtaattcttccctatcgactaaaatatgcatcatttcagcaatccctagagcgggatgggtatcgtttaattgtactacgactttatccgcaaggttatccaaacaaatatgtgtctttgtatatctgcggataatatcttgaatggttgctgaaactaaaaaatactcttgtttgagacgcaattcctgcccctcagtaatagaatcattaggatagaggacgcgagagatgttttctatcaaggcgatatcttctatagcctggatatagttcccgtggttaaaatagctgaattcaaagcctcgcggagattgtgcttgccatagccttagagaatttacagtatcattaccgtacccaggaatcggaatatcataagccatcgccaatacctcttgggtatcgacaagatctgccacctgtttccctcgagaatcggtataatgaatgacccttccataaaatcgtacgggatagaggtactctcccctacagatttcccaaggatttccataacgtagccactcgtcaggagcttcctcttgatacccgttgacgatcctctgatcaaaaataccataatcatagcgtataccgtagccgtaggctggaactgctaatgtagccatagaatccaagtaacaagctgccagtctccccaaaccaccatttcctaatcctgcatcggattccatttctacaaggtggtcaaagtcataatttaaagtttttagtgccttccttactaaatctagaattcctaaattcaaaagattgcttgttagacttctccctaaaagaaattccatggaaaggtaataaactctttttacatcatttttatagtagccattttgagttttcagccaccccttggccaaccattccataacagtttttgcaacagctgtgaagatatctctaggagatgcggactctggtgattgtacaacacttaaatacagacgatctaaaatcgcccgtttcatagagtcaacactgactttgttcttatcaaaactcgaaaaatcttccacaatgcaaccatttcaaataccatctagaaccctccatatgcgaaatttgaaaaaaaaaaaagaacttcgccttggtaaataaaagagagcctattaagagagcttaatagttctgaactagagaaagactataaataaaattagttgataaattttaataaaattaaaataatatctataaaaatattattgacaacaattatatagacagattaaaattatttaattttttactcaggagaacaacatggctacagtagcacaaacacctcagactacacaaccacaaccatcagtatctcacaaggcaacacatcgttattgttcctgggtattttttaagcctattttagttagtctaggtctcctccttgcttccttaaccaccctaggactggttattgccagtggagtcaccctatccttaggaatcggccattgttcttgctatacagatagtactgctggtattgctcttgtccttgctttcaatcatattagacaatttaaacaagctagaacagcggagttgaactcaatgaaaatgatatctgcgccggctgctgcaactgtccagaagcaaaaattagaggatcgttactcctctaaataatcatctcttcgctagggaaaaattccaaactcttatgcaaggaatttaaattctnnagaaatatcttgaatagccatgtgaatatcatggctattttcttctattttttgttcaatcaatcgtatggatgagattaccgtcgaatgatctcttgaaaagacatcgcctattctcacgtatgatagtgaaagcttctgacgacaaaagtacatggctacctgacgtggcaatacatattctcgggactgagaacgtcctaaaatactctcctgagagaccccataatattgagcaacattacgaataatctttaaaggagttaaacgaacgcttcctgctgcttctaaaacatcttttaaaagagttttcacatcatcttcatatagtaattggtgagagagttttttatacattaccctctttgctaaaagattcagtgcatgcagtaaggtctttacgttggaagatagcgcataaattaaaaaatctaaggccgtttcttgaatgcgaatagataagcgctctacctgtctcattaagaaactgcgcaatccttcctgaaccaaaggatgtatcggaattgcaactccccattcaaacctgctgatcaatctatcttcaacagcaacgagatccacaggcgcataggatgaagacactacaatcaacttcccttcagaatgaagagaattaaacgtatggaagaactcttcttgagttgccgactttcctgaaaaaacctcgatatcctcaatgaatagagcatcaatattgcggtaaaaagaacggaatttttgcatttctcctgaacggatagcagagactaagtgctctgtaaacaaatccgaagaaacatagagaatcttacctccagattcacgaagaacactgatagctgactgcattaagtgagtttttccagatccctcaggtccaaacagataaattggattaaaagtaactcctccgttttcatcaggactcttagtaaattcctgtaaaacacgaaaaggaagatcattttcaggggtaactaaaaaattagagaaggtcatctcaggattcacacttccataatgcatggtaaagtatgctgtcttctcttgctgcatctgcttctccttataaaaaggagctgctttatctaccgaagtaacgtgaacacgaatgggcttattgttattatttacaagaccagatttaaccttatgtcttatatgctcctcaaaccaagtaatttgaaaagaatcttgagcttcaagatacaaattacaagcatcaaaacataagacctttaaagatcgcaaccacttgtctacagtatttgtgccaatttctttctcttgtagcaaaagaaattcttcccatgctcgcataaactatgagctcatataaatcgcttgtttcaataagcctgtattaagacaattcgacttttttttcagtattatcgatgttttttattatttaaaaccacttcatttttaagatgtttgctatctaatatcttattagtgatccactgctggacgactcctaaaatcatagacgaaagccaatagatgtttaatcctgaagggaagttatagaacatagcggtaaataaaatcgccatcatgttccccataacttgttgctgtttctgctgatccgtaacaggtcctttcttatgcaaactcgtgaccttctgttgtaagaacatcactatacctaatagaataggaagtaagtggaactcatttccaataaaccatatcgatgtctgccaagaaaacaacacatcaggagctgttaagttatcaatccacccaggaataaacgaggctcctcgtaataagaatgatgactttaataaatcaaacatcgcaattaggaaaggaagctgtatcaataaaggtaaacaacccgtgataggattcactttgtttgtcttatacaagcccatgatttccatctgagcacgcttaggttcgttcttatacttttgctgaatttgctgaatataaggagataaaatcngcatacgcctccnagatcgtatggaccatgcagataaaggatagagaagcaatttcaaaaatacagtaagtaaaataatggaaattccccaagaacccgtaaccaatttgaagaacttcataataataaataggagtgctgcaaaaggagctgtaataaatgcaaaaacaccacggaaagaaatgctatcaagatactcaggattttctcccttctcctgagtaattgtcttatctaatactttaagtgtaggctctgccaagggacctgcatacactaaaaatcgatgtgtccctgcatcttttggcaaaggaagcaaggtctcatatccaggatattttgatactggatacagttgatttttaggagaaatagcagacaatcttgtcggagccgtagaacccgaaatgtagagagatccatagccagaagcaatttcagacaacggagttaaaataataccgaaatatccattcgaatttaaaatccattgaggataaacaccacgacgtacagctaaaggctcttttacttttggaagcttaactttatctaaagaccccttattttttttgataaccctgtatttaatggttggggctgaagcatttgacatgatctccacttcaggaactcctgaagttacccatacatcttcggtttctttcgttaaagtaattgcagtttcaaaaacatagggcttttcttccggattctctggaagtttgtataccttctgaaccgatctatctaagctttccaattgaatggaatggggggtataggaaagaactcggtatcttaaagccacaggagtcgctagctctcttcctgaaaccacatttaatgcgtgatactctagaggaagtaatttcttagaatcacttaataatcccctgcgcaataaagggtagtaacctccaatcgagtttttggcttgttggccatcaggaagttttgaagacagcccagggaaaagagcttcaggagatttctctgaagctaaatccctatcaaaaccaatttcattcacaatgcttttattatttgttgaagcaaaaggtaaattgataccttctatagaaccactctcttcagaaacaataatctgcatgtaatcattaaataaaacatagtggttcgcagtatctgacgactttgccgaatcttggtcattaccaaaaattacagctcgtgtaataggaagatccaaagaaactaacttttcttctcgagaatcatagagacctaaaggaatatagtcgcttcctgatctccaaaagacaagcgctgtaccaaagatcgtgctatctttattggaaattcttccttgtgcgtactcacctagaaatactaaaggctctttattgttacgaaactcaacaactagtacaggtaaaccttcatgattcgtaggaagaaaaacttttcccgtattcgtaggattgaaagaggaaccctgctgacgatataaagccaagtgaatattatcgaaaccacacttgtgatctacaaagctccaagattccccagaagaataaacagactgagcagcttctccattatgtaataaaaataacttgtctccaacacgaactgcgtagttattcttatgttcttctccgtttacatcggtgtcccatgaagctacacttaaccctacagattctactgcagctagcgtctgttctgaaatctttctttgtttctctgctagatttttgcaggaacgaaattcattataaccaaaaaatatttgacatcctacaaaagcaatcccaattaaagaaacaaaaagcaaagtgcgtttattcatttgataaactctaaaaattaaacttaagaggtcaaaatatcataaacccacattatctcccaaaggagaatctctcaatacaggtctcttattgtgatagactgtaaaattctaaagtctcatgccaaaaagatgctgctatatgtgtgaacggtgccttcgagctttcaatgagcaaatgataagtaaggccacaccaaatagaaataaaggtatagataaaatttgaccaattgtaagtagacaatcctctgctaaaactttcccttgatggctttttacatactccgcaaaaaaacgaatgaaagcgacagaaatacaggctatagaagtcacatatcccttacctaaatgcaaataacgcttataggaaagaaaatataaaattccagagacgaccaagtaactgattccctcataaagctgcacaggatgcacaggaactccctggacaccttgcataggatcagaaaaaaccaccccccaaggcaaagaagtcggtgttcctacaatttcttgattccaaaaattacccaaacgaataaaaaacgctgcaattccgaaaactgatccacacaagtctgtaaggaagagaaaagtcaattttgaaatcttttttttatatatccaagaaaaaatggccgcccacaaaagaaagccaaagaacgcctccatgactcgacaagcctccgtgccatatttgaatgatctcttcaggatgttgtaagtaaaaactccatccataaaaaatcacataggcaagtctagctccagggacaataaataaaatagagtatataaaaaagttttctaaagccacgcgtagctggcttttggaaaaacttaaatgatctttcaaaccataataggaaagagccaaataccttgctgagagacatgctagaaaaatccctacagtaaaaaagacgccataccaagtaagtcttagagaccatggctcgaaagaccagacaatttttgagcgatcccaatagatcacagccatctcagctcgcatatcttaataccagttagcaaaaaattcatactccaagtaaaatagagtatttagaaattaagtgtaatgcactatggcaagaaacatcaaatatttcctgatactatttcctggtattttgtggatatcagcaggaatgaaactcttgctaaaagctaccgcaatagccctagaccccctttcttctttttttacctactgtcttctatctatggtttcttggggattagcatccctaaaacatcgctacttgctaagcaaaactataaggaaacagctgagtctatcttctgaattcttttcacaaaaaattacatggattgcctatataaagcagacctttatctctagaaggtttctcatcatggtcattatgattgccttctctttagtccttcgtcgttatatcagcaatcctcaagccttattcgtgattcgagctacagtgggctatgctctcattaaaactgccatcgcttacttctcaaaattacagaatgccctaatggaaaatcctgaaggaaattagtgcgaactctatggaaatcattcatataggaaccgatattattgaaattagccgcattcgcgaggcaattgcaactcacggcaatcgactactcaatagaatctttacagaagcagaacagaaatattgcttagaaaagaccgatcccatcccttcatttgcaggtcgctttgctggaaaagaagctgtagcaaaagctttaggaactggcatagggagcgttgttgcctggaaagacatcgaagtctttaaagtatctcacggacccgaagttctcctcccttcgcatgtctatgcaaaaattggaatttctaaagtcattctctctataagccactgcaaagagtatgccacagcaactgcaatcgcattagcctaagaatctttcagcatctagtgctgctatacaaccacctcctgcagaagtaaccgcctgacgatagtacttatcctgaacatctccagcagcaaatactccagggacagaagtcttggacgttcctttctcagtcacaatatagcccgactcatctaacgtcagctgtcctccgagaaaatccgtatttggcttatggcctatagcaaagaacacccccgcagcttctctagttgtaatttcttgagtctgaacattcttaatatctacggaacggacaatgctatctccagaaatttttacaatctcgctattccataaaaatgtaattttttcattgttttgcgcccgagcttccatagctttagaagcccgcagtttatctctacgatgaactacatatacgtggcttccataacgagtcaggtaaagagcttcttctaaagcagaatcccctcccccaatcacataaagatctttatttttaaaaataggagaagccccatcgcaaacggcacaagcagtcactcctttttgccaaaattcatcgtttcctgctccaggaatttctaaacgtttagcagaagctcctgtagctatgatacaggcatcacaagaataggtttcttcttttgatttcaaaataaaagggcgaacagaaaaatctacggaaataatatcttgagctagtgtcttggtcccaaaccgcacagcctgctccttcatattattcataagttttggcccaagaatcccttcaggaaaccctggaaaattctcaacttctgttgtagtcataagctggccaccagagatcccagagaaaaacccctcaaataaaagaggatgcaaaagcgctcttgatgcataaattgccgctgtatatccagatggacctgaaccaataataattaaccgggaatgaatcatttataatttccttatctaactttagaaattgagaacactgttcttgatctactagaaaaaagacacttaattctagcctatctaataaacaacacttagcgtctatgcgtcagtttctctatgcaaaaaacttgcttttgaatagcttttgtctagttttaatttatacggatttaagactaaagtttcaaatctcaagatcttcatcttccagtaataacacctacatttctgtgattaatctttagaattttcttagagctaagaaaccaagacccatcctattatttaaccctcaataagtatggttctacttctgaatgcacttggttcttgagcagcaaccaaaaagatctatcaggcttaagaacaaagctgatgtagcccatctgggacgagaatttatggggtgcttatgaaaaaaacgatatgttttctatgcgccaaatcctgtttctctacatatgacaaggcacatttatgataattaccacacgtattttataaaatctggtaatatagaaaagttaaaaaagaggccttatacatctctagaacggaagtataggattttacgattaattcgattatatagaactaatcgtctcctgcaagggaggtcttgccttttttaaggtttatatttacactgtcttttttgactttgtagtttttaggagaataacaataaatgccaaaacaagctgaatatacttggggatctaaaaaaattctggacaatatagaatgcctcacagaagacgttgccgaatttaaagatttgctttatacggcacacagaattacttcgagcgaagaagaatctgataacgaaatacagcctggcgccatcctaaaaggtaccgtagttgatattaataaagactttgtcgtagttgatgttggtctgaagtctgagggagtgatccctatgtcagagttcatagactcttcagaaggtttagtgcttggagctgaagtagaagtctatctcgaccaagccgaagacgaagagggcaaagttgtcctttctagagaaaaagccacacgacaacgtcaatgggaatacatcttagctcattgtgaagaaggttctattgttaaaggtcaaattacacgtaaagtcaaaggcggccttattgtagatattggaatggaagccttcctacctggatcacaaattgacaacaagaaaatcaaaaatttagatgattatgtcggaaaagtttgtgaattcaaaattttaaaaattaacgttgaacgtcgcaatattgttgtctcaagaagagaactcttagaagctgagagaatctctaagaaagccgaacttattgaacaaatttctatcggagaataccgcaaaggagttgttaaaaacattactgactttggtgtattcttagatctcgatggtattgacggtcttctccacattaccgatatgacctggaagcgcatacgacatccttccgaaatggtcgaattgaatcaagagttggaagtaattattttaagcgtagataaagaaaaaggacgagttgctctaggtctcaaacaaaaagagcataatccttgggaagatattgagaagaaataccctcctggaaaacgagttcttggtaaaattgtgaagcttctcccctacggagctttcattgaaattgaagagggcattgaaggtctaattcacatttctgaaatgtcttgggtgaaaaatattgtagatcctagtgaagtcgtaaataaaggcgatgaagttgaagccattgttctatctattcagaaggacgaaggaaaaatttctctaggattaaagcaaacagaacgtaatccttgggacaatatcgaagaaaaatatcctataggtctccatgtcaatgctgaaatcaagaacttaaccaattacggtgctttcgttgaattagaaccaggaattgagggtctgattcatatttctgacatgagttggattaaaaaagtctctcacccttcagaactattcaaaaaaggaaattctgtagaggctgttattttatcagtagacaaagaaagtaaaaaaattactttaggagttaagcaattaagttctaatccttggaatgaaattgaagctatgttccctgctggcacagtaatttcaggagttgtgactaaaatcactgcatttggagcctttgttgagctacaaaacgggattgaaggattgattcacgtttcagaactttctgacaagccctttgcaaaaattgaagatattatctccattggagaaaatgtttccgcaaaagtaattaagctagatccagatcataaaaaagtttctctttctgtaaaagaatacttagctgacaatgcttatgatcaagactctaggactgaattagatttcaaggattctcaaggccctaaagagagaaagaaaaaaggaaaatagcatctaatgctggtaatgcagaggatcgtattatttagttctaaataatacgtccttaatttagctatttactgatttccttatttacaagaggagtataatgaataaaaatcttgtagctatttttgactacatggagaaagaaaaagggattcagcgctctactattataggagctatcgaatctgctttaaaaattgctgctaaaaaaaccttaagagatgacgcgaacatatctgtaaacattaattctcgtactggtgacatcgaagtcttttgtgaaaaggaaatagtagaaatttgtcagaatcctagcaaagaaattcctttagataaagccagagaatacgatccggactgtcagattggtcagtacatggatgtcccttttgtttctgataattttggaagaatagctgctcacgcagcacgacaaattatcggtcaaaagctaagacatgctgagagagacgttatttatgaagaatatcgccatcgcgtaaatgaaactttatctggtgttgtcaaacgttttgctaaaggttctaatttaattattgacttaggaaaagttgaagcaattcttcctacccggttttatcctaaaacagaaaaacataagatcggtgataaaatttacgccctactctatgaagttcaagagtctgaaaatggtggagcggaagttatcctcagtcgtagtcacgcagaatttgttaaacaattatttatttcaagaagtcccagaactagaagaaggttctgtggagattgttaagatagctcgtgaagctgggtaccgcacgaaactagctgtaaagatcgtcagaccctaaaactgatcctgttggagcttttgtaggtatgcgaggttctcgagtaaaaaatatcatttcgagaattgaacgatgagaaaattgacattgtcaattactcccccgtctctacagagttattacagaatcttctttatccaatagaaatccaaaagattgctattttagaagacgacaaagtgattgcaattgtcgttaatgatgcagactacgctactgttattggtaaacgaggaattaacgctcgtttaattagccacattctagactacgagctcgaagtacaacgtatgagtgagtacaataagttgctagaaattcaacgccttcaattagcagaattcgatagtccgcacttagatcaacccttagaaatggaagggattagtaagctagtcatccaaaatttagaacatgctggatatgacacaattagaagagtattattagcgagtgctaatgatctggcatctgttcctgggatcagtttagagcttgcttataagatccttgagcaagtcagcaaatatggagaaagtaaagttgacgaaaaacctgaaattgaagattaagaatgctcaattaacgaaagccgcggggctggataagctaaaacaaaaacttgcccaagcaggatcttctgaagctaaatcttcttcagaaaaaccttctgcgaaagaaaagtctgtaaaagtagctcttgccgcaacttctacccctacggcaagtgcggaacaagcttcaccagagtctacttcacgtcgcattcgtgctaaaaatcgttcgtcgttctcatcatccgaagaagagtcttctgctcatattccagtggatacatctgaacctgctccagtctccatagcagatcctgagcctgagttagaagtagtcgatgaggtttgtgacgaaagtcctgaggttcatccagttgctgaagttcttcctgagcaacccgtattgcccgaaaccccacctcaagaaaaagaattagagcctaagcctgtgaagcctgctgaacctaaaagcgtcgtaatgattaaatctaagttcggccctacaggaaagcatatcaatcatctcctagcaaaaacattcaaggctcctgccaaggaagagaaagtcgtagctggctcgaaaagcacaaagcccgttgcttcagataaaacagggaaacctggaacatctgaaggtggtgaacagaataatcgagaaaaacaattcaatcctgctaaccgtagtcctgcttctggtccaaaaagagatgctgggaagaaaaatcttaccgactttcgtgatcgttctaagaaatctgatgaaagcctaaaggcttttacaggaagagatcgttacggattaaatgaaggcggagaagaagacagatggcgaaaaaaacgtgtttataagcctaaaaaacactatgacgaagcctctatccagcgacctacgcatatcaaaatttccttgccaattaccgtcaaagatctggcaacagaaatgaagctcaaggcttcagaagtcattcaaaagttattcattcatggaatgacctatgtagtcaatgatattctagacagcgaaactgcagtacaatttattggcttagagtttggatgtacaattgacatcgactattctgagcaagataagttgtgcctaagcaatgacactgtaagagacgaaattcaatctacagatcccagcaagcttgtgattcgctcccctattgttgcgtttatgggtcacgtcgaccacggaaaaacaacactcattgactccttaaggaaaagtaatgtcgctgcaacagaagctggagcgattacccaacacatgggagccttctgctgctccaccccagtgggagacataacaattttagatactcctggtcacgaagctttctctgcaatgcgagcccgtggagctgaagtttgtgatattgttgtgcttgtagtcgctggagacgaaggaattaaagnacaaactttagaggctattgaacatgcaaaagctgctgatatcgctattgttgtagctatcaacaagtgtgataagcctaattttaattccgaaaccatctatagacaactttctgaaatcaatctattgccagaagcttggggaggctcgactgttacagtaaatacctccgcaaaaacaggagaaggtctttcagaacttttagagatgttagctttacaagctgaagtcttggagctaaaagccgatccttcagcacgtgctcgaggacttgttattgaatcagaactgcacaagggtctcggacctgttgcgactgttttgattcaaaatggaagcttaaaactgggcgaagctctcgtcttcaatgattgttatggcaaagtgaaaactatgcataacgaacataatgaattgatgaaagaagctgggccatctattcctgtgttgatcacaggtctatcggacattcctaaagctggcgatcctttcttcgtcgtgaaaaacgagaaaacggctagagacattattgaagctagatccgcaggacaacagcgttttgctttacagcaaaagaagcggcctaactttgattctatgttacagaataaaaagactcttaagcttatgattaaagctgatgttcaaggttccatagaagctttggtcagttcaatatctaagattaaatcagaaaaagtagatgttgaaattttaacaaacagtgtaggagaaatttcagaatcagacattcgtttactgccgcctctaaagcagttctcatcggtttccatacaggaatagaaagtcatgcggaacctttaattaagagcttaggagtccgagttgaactatttaccgtcatctatcatgctattgatgcaattaaagaaattatgacttctctattagatcctattgctgaagaaaaagatgaaggttctgctgagattaaagaaatctttaggtcttcacaagtaggatctatttacggttgcatagttactgaaggaattatgactcgcaatcataaagtccgagtattacgtaataaagagatcctttggaaaggtacgttatcttcattaaaacgtgttaaagaagatgtcaaagaagttcgcaaaggtttagagtgtggaattttgttagaaggataccagcaagctcaaataggtgatgtcctacaatgttatgaagttatctatcatccacaaaaactataacttgaagtactgtatgacagaaaatagacgtattaaacgggtaaatgctttattacaagaagccattgcaaaggtaattttaaaagatgttaagcatcccaagatttctaatctttggatcacggtaactcgtgtttctctatctaaggatttgcactctgcacgtgtttatgtatctgtaatgcctcatgagaataccaaggaagaggctttagaagctttaaaagtctctgctggttttatcgctcatagagcttcgaaaaatgtcgtccttaaatatttcccagaacttcatttttatctcgatgatattttctcacctcaagattatatagaaaacctgctttggcagattcaagagaaagaaaagagttaataaactatattttttgggaacttgaatactattaaagacatgactatggatcttgcagtagaattaaaagagggcattcttcttgtagacaagcctcaagggagaacttcgtttagccttatccgcgctctaaccaagttaataggcgttaaaaagattggtcatgcaggaactttagatcccttcgctactggcgttatggtcatgttgattggccgtaaatttactagactttctgatattttactttttgaagacaaggaatacgaagcaattgcccatttagggacaactaccgattcttatgattgcgacggcaaagttgtaggaagatctaagaagattcctagtctcgaagaagtattatcagctgccgagtatttccaaggagagatccagcaacttcctcccatgttttccgctaaaaaagtccaagggaaaaagctgtatgaatatgctagaaaaggtttatctatagaacgtcaccattctacagttcaagttcacttgcagattacgaaatatgagtaccctttattgcattttgtagtctcttgtagcaaaggaacttatattcgcagcattgctcatgagcttggcacgatgttaggctgtggagcttatcttgagcagctacgccgtttacgcagtggccgtttttctatagatgaatgtattgatgggaatctattagaccaccccgatttcgatatttctccctacctacgagatgcccatggaaatagcctatagtttaacgtcttcgttttctgtagattctgtaactgtaggttttttcgacggatgtcatctagggcatagcaatcttttatctattcttacttcctattctggatccagtggagttattacctttgattctcatcctcaaacggtactttctttaaatcacacgaaactcatcaatacaaaagaagagcgcctccaattattgcaaacgtttcccatagactggttaggtgtccttacttttgatttaaattttgcgaatcaatcggcagaagaatttcttactttgttacatcgtaacttgaaatgcaaacgcctcatcttaggttatgattcttgcatagggaaagaacagcaaagcaataccgaggctctcgatactataggcaagccgttaggtatagaggtcatcaagattcctccttaccgtatggataacatagttgtctccagcaaagcaatccgccagtttctgtccgcagggaatcttgaatgtgctcatcgttttttgggtcatccctatgccatttctggaaaaataaccgagggctccggaataggaggttctctaggattcgccactataaatcttcctagagaagaaagtttaattcccctaggagtttatgcttgtgaaatacgttatgatagcactacctgtcagggtgttatgaatttaggaactgcccctacttttggaagagagtctttatatgcagaggcgcatatcttttcctttgcggaaaatctatacggcaaagaagtgagcattatcccgagaaaatttcttagagaagaaaaaaagtttcaatcaaaagaaactctaatacgagcaattgaaaaagacattttggatgctcaagattggtttgcaaagggttcctttaattatgaaggaacagcatagtatcaccgtcctggacgatataatcacgtccttctatatgtaatttccctaattctcgagcagctgcacgaccttgacactctatcatatcttcaaaagtaatcacttcagcacgaataaagcccttttgaatatccgtatggatttctccagcagcttcccaagcagaagaccctcgaaccactgtccatgcacgagattcttgaggacctgtagtaaaataagaaatcagtcctaaagtgtcatacgcagcacgcactaatctatgaagtcctgatttttcaagacctaagctcataagaaattctaagcgctcttcaataggtaaggaaacgatttcttcttctatacgaacacagataggaaccactttagaattttcttttgcagcaacttcccgaacagcggcaacataatcattatccatatctggtagagaactctcgtcaacattagctatataaaacataggcttcatggtcaaaaacggatagggctttaatgccacaatttgttctggagttaattctaaagtacgtagcggcagcccttttctaagtgagcaataattgtatcaaatagaggcaagagagctcctacttcacgctttcctttggctagcttttctaatttgctatggatattttttgctgaggagaagtcagaaaaaatgagctctaagttgataacttcaatatcctcaacagggttgacttttcctgaaacgtgtgtaacgtctggatcatcaaaacaacgcactacatgagcaatagcatgagtttctcgaatatgagagagaaaccgatttcccagacccgcgccatcggaagctcccttaactaaacctgcaatatctacaaatttcatatccgcatagatgatcttctgactattgctaattttagctaaggcttccagtctttcatcgataacaggaacaatacccacattaggatcgatagtacaaaacggatagttacaggaggcaacttgagctcctgttaaagcattgaataagccagactttcctacattaggaagccctacaattccacattcagtatgactcataagacatctaaaaataaaaataatgacatgctttttcgaatattagaaagacaactcttctgtttcaaaaaagcacaatagctagaaaaatagtaccttcaaaatcaagagtgctttgaaaatgataaaaaaccactataatcgattgaagttttccctacctaatactttcttcatatagaaccatcttgaagtgacctaaagtattgctaaattcaacaacttttcgttattgttctttttttctactattcttctttatctctaagattcatttataatcttactaagaacaaaacgtttgggcttcactcttgagaaaaacaagagcataaggtaatttgcagataattccgaatatagtcctcttaatcgaaccttggcaacagcatgggtgaaaaaacagaaaaggccacgccgaagcgacttagagatgctcggaaaaaaggtcaagtagcaaaatctcaggattttccttctgcggttacctttatcgtctctatgtttacggctttctccctatcgaccttttttttcaagcatttaggtggctttctggtttccatgctctcacaagctcccactcgccatgatcctgtaattaccttattttatcttaagaactgtcttatgcttattttaacagcatcacttcccttactgggagctgttgctgttgttggcgtcattgtaggttttcttatcgttggtcctacattttctaccgaagtttttaaaccagatatcaagaagttcaaccctattgagaacatcaaacaaaagtttaaaataaagactctcatagagctaatcaaatcgattttaaaaatttttggagcagccttaattttatacataacgttaaaaagcaaagtctctttaattatagaaactgcaggagtctctcctataattactgctcaaatcttcaaagaaattttttataaagcagtaacctcgataggaattttctttttgattgttgcgattcttgaccttgtctatcagcgccacaatttcgctaaagaattaaagatggagaagtttgaggttaagcaggagtttaaagacacggaaggaaatcctgagattaaaggccgtcgtcgacaaattgctcaagaaattgcctatgaagactcgtcatcacaggtgaaacatgcaagcaccgtagtctctaatcccaaagatattgctgttgctattggctacatgcctgaaaaatataaagcaccttggatcattgccatgggcatcaacttacgagctaaaaggatacttgatgaagctgaaaagtacggaattcccattatgcgaaacgtacctttagcacatcagcttttggatgaagggaaggaattaaaatttattccagaatctacttacgaagctattggagaaattctactctatatcacttcactgaatgcgcaaaatcctaataataaaaatactaaccaacctgatcatttataatgaataagctactcaatttcgtcagcagaacacttggtggcgataccgccttaaacatgatcaataagtccagcgacttaatccttgctctttggatgatgggcgttgtcttaatgatcattattcctttgcctccgcctatcgttgacttgatgatcaccatcaacttatcgatctctgtattcttattgatggtggctctttatattccaagtgctttgcagctgtctgtttttccctcgttgctcctcatcactacgatgttccgcttgggaataatatttcctcttctcgacagattctccttaaagcgtatgcgggtcatgtcattcaggcttcggagacttcgtggttggagggaactatgtggtcgggttcattatcttcctcattattacaatcattcagtttatcgtagtaactaagggtgccgagcgtgttgccgaagttgctgcccgattccgattggatgcgatgccaggtaaacagatggcgattgatgcggacttacgagctggtatgattgatgccacacaagctcgtgataaaagggctcaaatccaaaaggaaagtgaactctacggagccatggacggtgccatgaagttcatcaaaggagacgttatcgctggtatcgttatctctttgattaacattgttggcggtttgacgattggggtggctatgcacggcatggacctcgctcaagcagctcacgtctacactcttctctccattggagatggtttagtctctcaaattccttctcttttgattgcgttgacagcgggtattgtcacgactcgtgtatcgagtgacaaaaatacgaacttgggtaaagagatttctactcagctcgttaaagaaccacgagcactactccttgcaggtgctgcaactttaggggttggtttcttcaagggcttccctctatggtccttctccattttagcattaattttcgttgccttagggattctcctactgactaagaaatcagcggcaggaaaaaaaggtggtggctcaggagcttcaacaaccgtaggggctgctggtgatggcgctgctactgttggggataatcccgatgactattctctaactcttcccgtaattctagaacttggaaaagatctctctaagcttatccaacacaagacaaaatcaggacaaagctttgttgatgatatgattcctaaaatgcggcaagctctctatcaggatatcggaatccgataccctggcattcatgttcgcacagattccccttctttagaaggatacgattatatgattctgcttaatgaagtcccttatgtgcgaggaaaaattcctccgcaccatgtgttaaccaatgaggtggaggacaatctcagccgttataatctacctttcattacctataagaatgctgcgggtcttccttcagcttgggttagtgaagatgcaaaagctattctagagaaggcagcaattaaatattggacgccgctcgaagtgatcattctccatctttcgtactttttccataaaagctctcaagagtttttgggaattcaagaggtacgttctatgatcgaatttatggaacgttcattcccggacttagtgaaggaagtcacaaggcttattccattgcaaaagcttacggaaatctttaagagattggttcaagagcaaatctcaattaaagacctacgtacaatcttagaatctctgagcgagtgggcgcaaactgagaaagatacagttttgcttacagaatatgtacggtcttctttaaagctttatatcagcttcaagttctctcaaggacaatcagcaatttctgtttatctcttagatccagaaattgaagagatgattcgtggagcaattaaacagacatcggcaggttcttaccttgctctagatcctgattctgtgaacctaattttaaaatctatgaggaatacgatcacgccaacacctgcaggaggccaaccaccagtattattgacagcaattgatgtaagaagatatgtacgaaaattaatagaaacagaattccctgacattgctgtgatttcttatcaagaaatcctaccagaaatccgcatccagcctttaggaagaattcagattttctaattgatacgttgtcgctcataggaggcatatggcagcatcaggaggcacaggtggtttaggaggcactcagggtgtcaaccttgcagctgtagaagctgcagctgcaaaagcagatgcagcagaagttgtagccagccaagaaggttctgagatgaacatgattcaacaatctcaggacctgacaaatcccgcagcagcaacacgcacgaaaaaaaaggaagagaagtttcaaactctagaatctcggaaaaaaggagaagctggaaaggctgagaaaaaatctgaatctacagaagagaagcctgacacagatcttgctgataagtatgcttctgggaattctgaaatctctggtcaagaacttcgcggcctgcgtgatgcaataggagacgatgcttctccagaagacattcttgctcttgtacaagagaaaattaaagacccagctctgcaatccacagctttggactacctggttcaaacgactccaccctcccaaggtaaattaaaagaagcgcttatccaagcaaggaatactcatacggagcaattcggacgaactgctattggtgcgaaaaacatcttatttgcctctcaagaatatgcagaccaactgaatgtttctccttcaggnttcgctctttgtacttagaagtgactggagacacacatacctgtgatcagctactttctatgcttcaagaccgctatacctaccaagatatggctattgtcagctcctttctaatgaaaggaatggcaacagaattaaaaaggcagggtccctacgtacccagtgcgcaactacaagttctcatgacagaaactcgtaacctgcaagcagttcttacctcgtacgattactttgaaagtcgcgttcctattttactcgatagcttaaaagctgagggaatccaaactccttctgatctaaactttgtgaagatagctgagtcctaccataaaatcattaacgataagttcccaacagcatctaaagtagaacgagaagtccgcaatctcataggagacgatgttgattctgtgaccggtgtcttgaacttattcttttctgctttacgtcaaacgtcgtcacgccttttctcttcagcagacaaacgtcagcaattaggagctatgattgctaatgctttagatgctgtaaatataaacaatgaagattatcccaaagcatcagacttccctaaaccctatccttggtcatgattaaaaaaggattgccatgcaaaaccaatacgagcaattactagaatccttagcacccctattaaatacgacacttgctccagataaaaataactcttgtttaatccgtttcagcgatacccatgtccctgtgcaaatagaagaagatggaaattccggagatcttgcagtatcgacactactaggtactcttcctgaaaacgtatttcgcgagcgtattttcaaagctgctctctctgtaaatggctcgttccaatccagcatcaagggaattctaggctacggtgaggtcactcaacagctctatctttcagatatcctgagtatgaactacctaaatggagaaaagttattcgagtatctcaagctcttttctttgcatgctaagatttggatggaatccctaagaacagggaatcttcctgaccttcatgttttgggaatctactacgtcgcgtgaatgttttaaaatacacaaaacactcaccctcagcacatgcttggaaacttataggaacctctcctaaacacgggatttatctcccactattttcaatacacacaaaaaatagctgtggaatcggtgaatttttagatctcattcctctgatctcttggtgccaaaaacagggcttcagcgttattcagcttctccctttaaatgatactggtgaagatacgagtccctataacagcatctcttccgtagccctgaatcccctattcctttccctatcctctcttccaaatatcgataccatccctgaagttgccaagaaacttcaagatatgcatgagttatgctcgactccatcagtcagctatactcaagttaaagaaaaaaaatgggcattcttaagagagtactaccaaaaatgttgcaagtcttccctcgaaggaaactcaaatttttctgagtttctagaaagcgagcgctattggctttatccctatgggacctttcgtgcaatcaaacatcatatgcacggagaacctattaataactggccgaagtcgctcacagatcaggagaattttccggacttaactaaaaaattccatgatgaagtcctctttttttcctatctacagtttctctgttaccaacagctctgcgaagtgaaagcctatgcagatcaacaccacgtcctgcttaaaggagacctccctattcttattagcaaggatagctgtgatgtttggtatttccgagactacttttcttcatcaaggtctgtaggagctcctcctgacctctacaattctgaaggacaaaactggcatctgcctatttataatttttcacaacttgccaaagacgactacatttggtggaaagagcgtctgcgatatgctcaaaacttctattccgtctatcgcttagatcatattataggatttttccgtttgtggatttgggattcttcaggaagaggaaggttcattccagacaatcctaaagactatataaagcagggcacggagatcctttctactatgctcggagcctcttctatgttacctatcggagaagatttagggattataccccaagacgtcaaaacgacattaacacacttaggaatctgtggaacccggattccacgatgggaacgcaactgggaaagcgacagtgccttcattcccctaaaagattataatccactttctgtgaccactctctctacccacgactctgatacgtttgcccaatggtggctcaattcacctaaggaagctaagcaatttgctaaatttctacatcttccttttcaaaaaaccctgactacagaaactcaaatagacatcttaaaactttctcatgaatcagcatctatctttcatatcaacctctttaacgattatctcgccctctgccctgatttagtatcaaaaaatctacaaagagaacgcattaatacacctgggacaatttctaaaaagaattggtcgtatcgagttcggccttccttagaagaactcgctattcataaaaaatttaatggttacattgagaagatccttacaggactgtaaggatagcaataaaacatttaagtctttttatagtaagaaccttataataatttcctggaacgaccgtctttcttaaaagaattccttcattatcaacaacagacaatcacattttctaagaaaacctcttccccatatattcgaaaagctctagtatagattccttttcatagagttgctttattgagcggatgttagagaattcataggaagaatatgtcaagaaagtgcccacttacaggaaagagacctcgccgtggttatagctatacacttcgaggtattgctaaaaagaaaaaaggaattggtttgaaagtgacagggaagactaaaagaagatttttccctaatatgttgaccaagcgtctatggtctacagaagaaaaccgttttcttaagcttaaaatttctgctagcgctcttcgtcacattgataagctcggattagagaaagttctcgaaagagctaaaagtaaaaatttttaatttaacttaagtatagggaaatatttatgtctttcttaaggcgtcatatttctctttttcgttcacaaaaacaacttattgatgtttttgctcccgtaagtcctaacctcgagttagctgagattcatcgtcgtgttattgaagatcaaggccctgcccttctttttcataatgtcatcggatcgtcattcccagtcctgaccaatctctttggaacaaaacatcgtgtagaccaacttttttctcaagctcctgataacctcatcgctcgagttgcccaccttatttcttctacaccaaagctttcttctctatggaaatctcgggatctattaaaaagaataagctctttagggctcaaaaaagctcgattccgtcgctttccttttgtttctatgtcctcagttaacttagatcaccttcccttactcacaagctggcctgaagatggtggagcctttctcacacttcctcttgtctatacggaatcgccgactcttactacacccaatcttgggatgtatcgcgtgcaacggttcaatcaaaacaccatgggcctccattttcaaatccagaagggcggagggatgcatctgtatgaagcagagcaaaaaaagcaaaaccttcctgtttcggtatttttgtctggaaacccctttttaaccctttctgcgattgcccccctacctgagaatgtctcggaacttctctttgctaccttcctccaaggagcgaagctcctttataaaaaaacaaacgaccatccccaccctctactctacgatgcggaattcatcctggtcggagaatctccggccgggaaacgtcgtcctgaaggtccttttggcgatcatttcggatactacagtctccaacatgacttccctgaattccactgtcataaaatctatcacagaaaagatgcaatctatcctgctacagtagtcggcaaaccctaccaagaagatttttatatagggaacaaactccaagaatacctctcccctttatttccgttagttatgcctggtgtgcgtagacttaaaagttacggagaatcagggtttcatgcactgactgcggctgtcgttaaagaacgctattggagagaatctctaaccacagctcttagaattcttggagagggccaactttccctaacgaaattcctaatggtcacagaccaagaggtgcctctcgacaggttctccgtggttctagaaaccattttagagcgtctacagccagaccgagatcttattattttctcagaaactgcaaacgatacgttagactatacaggaccaagcttaaataagggctccaagggaatcttcatgggaataggaaaagccatccgagaccttccccatggatatcagggaggaaaaatccatggagttcaagacatcgctcccttttgtcgtggttgcctagtgttggaaacatccctcgaggaccgatgtattaaatctctccttcaccatccagatctaaaatcatggcctctgattatccttgccgataatctgagagaaaccattcaaagtgaaaaagattttctctggaggaccttcacacgatgtgccccagcaaatgatcttcacgcgctccacagccattttgctactcaccgtcctaattacaactttcccttcgttatcgatgccctgatgaagccttcctatcctaaagaagtagaggtcgacccatctacaaaacaaaaggtttccgaacgatggcacgcatatttccccaataaagaaactttttatatttaataagaatcttattctattaaacgtttaattaaattagttatttttatttttaaaaatatataaaaacaaaaaagctattttaagagtaaaaaatgaataaaagacaaaaagataaattaaaaatctgtgttattattagcacgttgattttagtaggaatttttgcaagagctcctcgtggtgacacttttaagacttttttaaagtctgaagaagctatcatctactcaaatcaatgcaatgaggacatgcgtaaaattctatgcgatgctatagaacacgctgatgaagagatcttcctacgtatttataacctctcagaacccaagatccaacagagtttaactcgacaagctcaagcaaaaaacaaagttacgatctactatcaaaaatttaaaattccccaaatcttaaagcaagccagcaatgtaactttagtcgagcaacctccagcagggcgtaaactgatgcatcaaaaagctctttccatagataagaaagatgcttggctaggatctgcgaactacaccaatctttctctacgtttagataataatctcattctaggaatgcatagctcggagctctgtgatctcattatcacaaatacctctggagacttttctataaaggatcaaacaggaaagtattttgttcttcctcaagatcgtaaaattgcaatacaagctgtactcgaaaaaatccagacagctcagaaaaccatccaagttgctatgtttgctctgacccactcggagattattcaagccttacatcaagcaaaacaacgaggaatccatgtagatattatcattgatagaagtcatagcaaacttacttttaagcaattacgacaattaaatatcaataaagactttgtttctataaataccgcaccctgtactcttcaccataagtttgcagttatagataataaaactctacttgcaggatctataaattggtctaaaggaagattctccttaaatgatgaaagcttgatcatactggaaaacctgaccaaacaacaaaatcagaaacttcgaatgatttggaaagatctagctaagcattcagaacatcctacagtagacgatgaagaaaaagaaattatagaaaaaagtcttccagtagaagagcaagaagcagcgtgatgatctaaaatagtcacagaagaaggcctagctcgtgattcaagtatgtctaggcctcttcatccttttgataaaaaagagtggaggcagtttctaagactcctttatttctagcaattacccaagcttctgctgctgctgcaattgcctgagaagcggcagcccctaaagagatgcccttttttttctttgtaactttaatagatcgcttctgtttgtttttttcgtctttttcctgatcttcttttttcttactatcgcaatatagttttttaaaatctaaatgcacatgacgcaactgagaaagcaagaccttggcttgcttttgtccgagtagcttataacgatgcctctgtttcttctcctcttgttcgcgatctccaatagctagcaaggcaagccgaatcgcttcattcgtagcaatttcctcagaaattttttctactaaaggagagttttgacgggaatctttagctatgctttgtgcagatagcgcaccataaggatcaaaacgaattatacgcatcacatcaaaccgacttaaaaccctaaatatccgtagataatttttttcccttcttttcctgacgggaagctttctggcccgaagatcctcttctttgatctccgctaaaaccaccactatttccccccccaccatcgtcatgaactgaagcagcttcaggctttccttgaaccgatagacgtgaagatcctgaaaacggctggggagaacggagaacaattggcggctcaacagcaacatttcgatactgataaatcaaaggatctggaggacctccaggacctttatgagcttcgagcttctctttatagtcatcagtagcacgaggtagaggagcgagtaaagacactccacgttgcgcaaggaaatgatatgaggaactcacagcatcacttcctaaagcccctcccgtaccactttccttagggaaaacactctccacagcaatagggagaaagttttgactgctattctctggatttttgaatgccgtagattctttaacaacggcttcaggttcctccctggaaacgatgctatctttaggaaaacgatacatactttctggatgaggcaaacttttaacctcagcactcttcacagtaccttcccgaagaggagaaaagttcgtatggttcgtactcttctctattcctggagatttatgctttgatttatctcccgatctctgggtgggtaaagttcctgaaaacttgggaggaggaaatactgtagaaggaccagaccaaacagaattactcaatacctcttgaggcgctgcccctgtaagaagcccagccatagcacgtgcaagcatcatctgatcctcactcaactgctctcgactttcttgtttctctgcttccttttccgccctttctaaagtattagaatttggaattcctgttggattcgcttctggagaatcagangaagatacctttacttttccttctactgctctgggagatgtcatggctgtactganctcttcctgtcctaaatcaganagatctatcatgccttcgttgcctgttgccattgccctgcgcactaatgatgaggtctcaacattgggatcgagaagagagctgaccatctcccctcctaaacgagccactgtccaagcatttaccttctcctcactcataggctctatggccttttggaaagatccaaacgaagccacggaactagattctgaagagcttaaacttaaactcctggcacctgaaaatgctgaagatttcaaagcctctaaagaaagctgagaaatatcagaggaactccctcccatacccgaagcatctaagaaaaatccctgcatttcaggtgaaatacggtttcccttctttagagcaacatccatctctgtcggcaataaggatgttccctcaccactatcggaagcacgctttgctgacactctcgaagcccgagatccgaatcctgacatgaatccttgcacactagcgcgcattttagaaaatgtacctttcaatttggattttggagaggttgatgatcgatcttgagctttacgatacttagccttatttatctgagattctgttgcatacattcctgtagatcctgaacgcactaagctttcctgcttcgcagcagaggaggcctgcttggtttcagaaaatatagattcttttagcggagacgggccttctgcctgctctccttgcagagcaggattccactttcctggatccgaagaaggctgaacccctccgccacctgaaactgccataatgattctctgaatttaaaaaataaaacttataactacttataattttaaaacaaaaaataattaatttaaaaaaaagaacttacaaacaaattttaaaaatctaaaaaacaaaaaaaaacgcaaggtgaaaacaccttgcgtaaaaaaacttatgggaggacagagaacagcgagtagatgcaacaaagtgcatcgctgtcgagctagagggatcactcggatccgactgtctaggtattaagattttggagatcttaataccgagacagttcctaactctaaattaattacccaggcttcctgtcgttccatcacgggatagtcccgttctgcgatttttttttaatttaaccccgcctaaagacggatagagtacttactaaaatggtccttgtcagtaaaaacaaacccattctcataattgaaaatcaaaactttatcggtgtccttcttctgagaatctaagagagagcgaactaactgatcgtattcttgagcacggtgtttaagagttttctgttccttagcaataagaaatttcgacgatttttagcttttatccgcgcaggcttcttcaacacttccgttgatttcttttgaatctcctgagccaaagccctatccgttctgctcttcttaggcttccccataaaaaatacaaaaacaaaaaaatcaacttaataaactaattttaattaaaaaacttattaagaataaactaattttaatctaaaaataaaatattatataaataattgtttaaaagcagtttagataaacataaaaaatcaagctaagaatcctatgctttgctatatacaagtctgcaaaaccttttgaaatcgataatcataattcaaagcgtaaaccatgtctgtccacataacaccgcgcaaatgctttattttgtgtattttatccatgttcacccttccaacgctcttccctaaagcacatctgatccttttttccccttatattgttctttgtttctattgtttctcaaaagataagggactggtactcgctctaggctgtggtgtcttaagtgatcttgccttaggaagccgcggtgtatttctactgctctaccctctaactgctctgatcacccataaggcacacctcattttttcaaaagagagcaaagccgccttggtcattgtgaatatgattttctatggagtctttttactcctaaccattcctatgtgcgccttgttcggacatgaagtccgttggtcaatagatgtgctaatgatacctctaaaatgttctttcttagataatctcatcttcacttctgtaatctatatacttccttgcgcaataaactcaggaatccataaaatgatatctttttttaggagattggtatgttactgagagggattcctgcagctgaaaaaatccttcagagactcaaagaggaaatctcacaaagtcctacctctccggggcttgctgtggtcctgattggcaatgaccccgcatctgaggtgtacgttggcatgaaagtcaaaaaagctacagaaatcggaattatctccaaagcgcacaagttaccctctgactctaccctctcctcagtccttaagctcatagaacgattgaatcaagatcctagcatccacggcatcctcgtgcaacttcccttgcccaaacacttggacagcgaagtgattctccaagcgatctccccagacaaagatgtggacgggcttcaccctgtgaacatgggaaagttgctccttggaaattttgatggacttctaccctgcactcctgcaggaattattgaactcctgaactattatgaaattcctcttcgaggccgccatgccgctattgtagggagaagcaacatcgtggggaaacccttagcggccctcatgatgcaaaagcatcctcaaactaactgtacagtcacagttcttcatagccagtcggaaaacctcccagaaatcttaaagacagctgatatcattattgctgctctaggagcaccgctttttataaaggaaactatggtagccccacatgctgtgatcgtagatgtaggaacaacaagagtccctgcagacaatgcgaaaggctatactcttcttggagatgtagattttaataacgttgtgacaaaatgcgcagaatcactccagttcctggaggcgttggtcccatgactgtcgctatgctcatgagcaatacatggcgatgttaccaaaatttttcttagttcttttatgtcttggactctgttcatgctctcaaaaaacgacaacaatcgaaggagagcagatgacaatcttctatcgcattgttctgggaacctctttatccgcaaaagaaaaagcatctttatcccaacaaattgatagatgctttcataagatcgactcgatttataacaactggaatccctattctgaactctcgataatcaaccgagctccagcagatgtccccataactttatctgtagaactttccgagtttctagatcaggtagatacactttacaaactttcagaaggacgttttgaccctactgtaggacctttaaaaaccctatggcttctacatctcaaaagtcaaaccctcccccctaaagacgtttgggaacaacattataaagacatgggctggcaacacttggagtttcagtcaaacacaaaaactctaatcaaaaagaatcctcatgttcaaatcgacctctgtggtgttgtcaaaggttatgccgtagattgtctaaatgaaatttgcaataccttttgtccgaacaactatgtagagtggggaggagagatcaaaacgtcagggcatcatccctcgggaagaccttggcgtattttttctgaagcagcaggtacgatcttagatatcgatgatatggcaattgcaacaagtggaaatcatattcaaaaatggtgtgttgaaggaaaaatttacacccatattcttgatactcgtacagggaaacccctagagctaagctcctatcctatccaaagtgtttcagtagtccatccgactgcgcatacgccgacgctattgccacagtcctcatgacttttgattctaaaatagaagcaaaacagtgggctgaagaacaccatatcctaacctatatcaatgatggcgcctcttcatagcagcggcaacttcacgttccttttctctttctatgatcgtacgacgcttatcataagcttttttcccacgacaacaacccaaacgtaccttaacatagccgcgactcagaaacattcccagaggaatcaaagtcatgcccttttgagcaatcttaccctctaacttacgaagttcatatctatgaagaaggagtttacgtttacgacgctcctcatggttatagatatttccaaaccgatagggagcaatactcgcgtttaataaccacccctcacctttagaaacaatgacataagcatcaccgaggtttcccccatgatcgcgcaacgacttaatctcagtcccagtcaaaacgatgcctgcttctaaagtctctataacttcatagttacgcagagccttgcgattagaaacaatttctttttgtgccataagatcctcccccataattggggacaaaaaccagtataacaaaaagcaatttttccttcttaagacaatgattagaatcctctttccttgatttccagggaagatttcctcaatctaaagccttttttattagtaaaatatctagaagaccagaaaatcactttgtagtaatatcccgatcgtacctctaccgtctctcctagagaggcgtagcccttcatataaagttagactcaggttataggaaaatatgaaattcgttgtatcccgaaatgagctaggaaaccttatcaaaaaaattcaaagtgtcgtccctcaaaacacacctattccagtactcacccatgttttgattgaaacttataatgatgaattagttttcactgctacggatctgacagtgagcacacgttgcgtcaccaaagctaaagtctatgagaaaggcgctatttccattccctccaagagattttttcaattagtaaaagaattaacagaggcaaatttagaaatttcctcttcagcaggggaaatggcacaaatcacctcgggatcttcatatttcgcctactcagcatggaaaaagaagacttccccatgctccctgatatacaaaatgctttgcgtttttccttgcctgcagagcagctaaaaaccatgctacagagaacttcattcgctgtatctagagaagaaagccgctatgttcttactggagtcctgcttgctatcgccaatggcgtggctaccatcgtagggactgacggaaagcgtttagcaaaaatagatgctgaagttactttagataaaagtttttctggggaatatattattcctatcaaagcagtagaagaaattataaagatgtgctccgatgaaggtgaagctacgatcttcttggatcaagataagattgcggttgaatgtgacaatactctcctgatcacaaaacttctttctggagaatttccagatttctcccccgtcatatctacagaaagcaacgtaaaactcgatctgcatcgcgaagaactaattactctgctcaaacaagtggctttatttacaaatgagtcctctcactccgtgaagttttctttcttacccggagagctcactctaacagccaactgtactaaggtgggtgaaggaaaggtaagcatggctgtaaattattctggcgaactcctagaaattgcctttaatccctttttctttttagatatcctgaagcatagtaaggatgaattagtcagcttagggatctcggattcctataatcctggaatcattaccgattctgcctcaggattatttgtcatcatgcctatgaggctacatgatgattaataaactccctaaggagaatcctttaggtcactaccctgccgatgtttatgaaaatctgctctctgaagctaaaaaattttcgtaaccacagtgatttagaaatctcactggctcctaaactcaattatgcccaaggaaaaacaaacctcctagaagcgctttatgttttgtccttgggaaggtcttttcgcacgcaacatctcacagataccatcaccttcggatcttcccatttcttcttagaaacacagtttgagaaagaccaccttccccaagctctctccatctatacagacaagcaaggaaaaaaaatctgctataaccaacttcctataaaaaccttatcgcagctgatagggaaagtacctattgtgcttttctcttcaaaagaccgccttctaatttcaggagctcctgcggatcgtcgccttttcctaaatctgcttttatctcaatgcgataaccactataccctctgcttatcgtactatcatcgcgctcttcagcagagaaatgctctcttaaaaagcaagcaaacctcaaccgtggcctctgggatgaacagttggtcaaacacggcacctacctatccatccaacggtttctctgtagtcagaaactttcagatttatccaaagaactttggtctaacaacctaaaagaacaattggccttaaaatttaaaagttccttaattaaaaattctgatatttctgaaactgctgttgccgaagaatttcataaacagctctctatatcacttcctagagatctcgaatggggaagcacttccgttggccctcatcgcgaagactttctactcactatgaaccaaatgcctgtgtctcaattctctagtgaagggcagaaacacagtcttttggcaatcttaaggcttgctgagtgcctatatctaaagcaatctcatcacgtctcccctctagtctgtctagatgatatccatgctggattagataatgaacgtgtcggtcaactccttgaccctgccccaactctgggtcagactctgattacttccacccatatgcatggggaacttccaaaaacaagccttgttttaagtatcgagaacgctcaagtttctgagcaaattatctaaaacaataacatcatttttcttttgcgttaaaagtaagcgaattagttatttttataaataagttttaataaacatattcttttttaataaaaaacttatttaaaataattatatcggtgacacatgaagaaatttttattaactatactctttttagctgtgggtaatcctttattctcggaaacctcggtaatccaaacccttccatctggaattgggggattaaaggaaacctcaaaacaaaaagaatccgtggtctgcgtgcatgcgtttttaagatcttatacatctttaaaacctattgctcgcgttctagaaaaagaacattacgatgtctttatttggaattatgagacgcgcaagtttactctagaaaagcatgctgaacatctcaatcgcttgctgaaaaaaatagctgaacttaagcctggagtccctataaacttcgtaactcattctattggaggagtcattgttcgtgcgcttgctgaaaaaaatagctgaacttaagcctggagtccctataaacttcgtaactcattctattggaggagtcattgttcgtgtagcactcgctcaccctgattgccccgaagaagccaaaaaaggaaaagctattctcatggctcctccgaacgcagggtctacactagctagacgctaccgctgtgtgaaattcgtacagttcgtatttggaggaaaattaggacgacagcttcttacctactgccccacaaagatgttaaatgtcgggaaactcccttcgtctttagacgttctcattcttagtgggaacagacatagcaaattccttcctttccgcctgccctatgaaaacgatggtaaggtatgcactatagagacaaagctagatactccacataaagcttacgtgatccacacgagtcatacctacatcattactaatcggaagtcgctctatcttatgaaagagtttttaaaagaaggaaatacaaccccgataatcgagcacgttcccgaagcagctttagaacaaactgttatggaagacaaacaaaagaactcaagacttaagccttaccctaaccaagacatctacgttatacactgctttggttctcgtccttacaacctttacggatttccaaaaaaatggagccttaaccaaaaaaacgaaataaatcctgaaaagttagaaaaataaagaagatgatcaataaaaaagtgaacggaaccaaaatcctttccacaatcttcatattcaaacgtcttcttgtgactatctcccacaaacatagaaggatataacctccatccaaaacaggaataggaagcaaattcaagacagccaaattcatactaattagaccgatccaaaagagcacttcagaaaaccctaccgaccatcctgtatgtaaaacctgcacaatacccacaggtcctgaaagccattgtggactcagatgtccagtaactaaagctttcaaggtgatcaaactttccttagtaatatttgataacataaccacaggtgaaggattatacctcaccttaagatctttcaaagaaatccctaaagatggtttttgcttctcagcatcaagacgctccaaatagtatctttgtttatccttgttcttaatcttcttagctacttccaactgtttatccaaactctccgaagaataaacatcaatccaaggacgaggctgaacagggtcaagaagacgataaggacccgcgacttctactgggtgagactctcctaaatggttcaaaatttgtaacagatcttcggaatgataagaggcgataaaccgcttatcagcatctcgagaattcacctcttcaagttcttgcggactcatctgctgaacaataatagagacccgatggttctgaacaagacgtaaaatatctacacttccagaaacaggagttccatcaatagctagaatgcgatccccaagctgtagcctctcttgaggttgtggcaaaggagactctggatctatagcagtaagttcaccttctatgtatccataactattgattacataaggcaatgtatataacgaagaccacttgcctttaagtccagcctcatactgcgtatctataagctcattacgaaggtagggagtgtaatgtaaaacggaagccaataccctaggttgacgagaaaagaagattttgtcattccgtgctactttcacaaaagcataagactcattgagtatctgagatatctgagccattgagaaaagaagtgtgccatccatccaaacgaaacgatcattcggacgtagctctgaattctccataggagagttcttcgttaggggcacctggttgccatacaaaagataactcgctccagaacagggaaccccgaattttgtgggatcaaactcaacatcaatagcgaactctttgctaggaactgtcaaatagccaggacgtttgatttctagattgagatgcccctctaataaagaggttgttagcatgtccttatctcccacataaggcttaccattacacgtaagaatctcgtctccagggagcaatccttctgcctgtaaaacaggatggacccaacctaccactttagaacagtcgctataatttttacttcttcccccattcatgtaaagaatgctgaaagccaagacagctaataaaatattggcaagaggaccagcaacaagaaccagaatgcgtttccaaggagacttactaaaaaatccctgaggaatatcatagacagagtctatcttccccttctcccctttttctttggtacgttccatacctctgatacgaacatagcctccaaaaggaatgcatccaatgcgatattctatgccgcctatacgctttttaaataaagcaggaccaaagcctatgctaaaactctctacagccattcctacagcttttgctactaccagatgaccaagttcatgaattaacactaaaatccctaaagctagggctgctagaataaaatagattattgtcatatacctactcgattatatttcttgagcaagagctctagcctcaccatctacttctaaaatatcttctaaagagtggcaggcataaaccttatgacattccataagagtcgttaatttgcgtaaaatgtcacaccaagaaatctcttcgcaaaggaacctccgcactaatacttcattggctgcattaaaaaagcttccagaagacccctgtttctctaatacctgttgtgctaaacggatactaggaaatcgctcctcatctaccggaaaaaattctaaagtttgtttcttcgaaaaatccataccatccctaggagatgcaaaacgctctggagctgttaaagcgtattgtattgggaagagcatatcaggcggattcatgatagaaatcacactcccatctaaaaactctaccataccatggattaagctctgaggatgaattacagccaggatttcaacattttctaaaccaaacagccaatacgcctcgataatttcgagtcccttattgaccaatgtggatgagtccacagtcacttttgaacccatattccatataggatggttcaaaacatcttgttttgttacacaagaaagctcttctaaagacttgttgagcagaggccctccagaagctgtaagaatcagtttcttgattccctcaatcgtcctgccttctaaacattgatacaaagcattatgctcgctatcaataggaagaacttttataccattttcctttgcagtcttagaaaccaattcgccagcacaaactaaaatttctttgtttgctaaagctagtgcttttccttttttcatcgactctagaatcgcgggtagcgcctcgattcctgaagaagcagcaacgacagtagtgactgtatccatgatacaaagttgggttaaaccctcctggcctaggaaaaattgcatatgggggaatcgctgacaggcctcgttataaacctcttcgttatagaccgctgcggctaacggagcaaactcctgnagttgctgaaaaataaccttagattatttccataagaagccatagaaataattttaaattctgaaggatagcgccgcacaatctctaatgtttgacggccaatactacctgttgacccaagaacggctaaatgtttcaagcatgctacctttaactaggtgaaaaagagaatccatactccgcaagtcgaggaattgtcaattctctattgatactatttctaactaaagtggactaaactctaaaatttcattcttttaaatcactgctaatattgagaacttttctcacttattttttcaaaatttttagaaaaatagcctcgaaaatagcttataaatttaaccacgatgtacatcatcgtcaagaacactacagagattcccgaagtcgataaccccaaatcataagcactaagaattgctctcgaagatgcaggagctaaaaatgctgtancaatactaaaaactaacgaccaagccataagactccttatcgattttgcaataaccttagcaataagcgatggaatgatcagaaaagcaagtgccattaatacacctacagccttaaaagctcctacaagacatgcagaaagttgaaaaataatcaaataatcaaccaaccgaataggaattcctaaagaagaggcaaatacagaatcgaaagaagaacaaactaagctacggaacgcaaaaatagtaattacagcattagccaaaatcacaatagtgacagggaaaatatcctctttcgttaaagaatctgcgtttcctaacacaagctccgttcctatatgagcattctttgtcataaagactaacaaaacaaggctcagagagaataataaagaaaagactagagcggtgctgctctcttctgaaactttaaaagtattacgaataaagtaaataagaaaccctgtcagcatagctgttgccattgctgcaagagtcaaggtacccaaagagagggtcgtcagttgatgcgtaaacaaacaaacacagaccaaaccaaaaaggacagtatgagagacagcattcgcatacatagccatctttcgcaagactaaaaaagttcctgcaaaagcacctgaacaggaaatagcaaggaatactataatctgaatatcatcaatatagagagaacccgtgaaaagacttccagaaaacagtctcgaaaaaaatactgaaaaaaattggaaaaaagatactccataataaggagaaggtcccaaagccattagacttccttttttttatttgggataatttgtcgatgaggatcataacaaggatcattgagaatctctgtcaaggtatgatccaattcttcagtaagaacatgctctatttcctcagccaactcatgaacactttccttgctaaaatctaaagaattcacaagatacgattcccataatctgtgagcacgaactaatcttaaggcctcacttcttcctttttttgtgagtcgataataatcttgttcttttttaacataaccccgccattctaaaatctgaactctccatctagggaaaggcttaggcccaaaatactcctgatacttataactacagacaaaatctcgaacactaatgttctctaaacgattatgagaaatatgccaaaacacctttaaaaggtgttcttgatcctttgaaaacgaaaagtgcttcctacggacaaaacgaatgacccacccagattttggagaaaaaagcaaacatagaccggccaataatccagcacaaatgacaaccaaaggtcccgtaggcaaggttacaggcaccgcctgttgccctataatagcacgacatgtgaatgctacagagatatagcttcctaaagctccgctaatccctccaaagaatgcagaaaggataagaattgtacttagacgatcggaaagctgacgagcacctaaagaaggagccacaaacatagcagaaattaaaacaatccctacgcttcgaactccacttacgatcaccaacgatataaaaattagactgagtgcttcataaagaacagtctttaagccacaagtaacagcaaaatctttatcaaaagtagtcacaacaatttgtcgataccaccaccataaagcaaataacgaagcacaaaagacgatcgcagccaacgtagcttcaagaaaacctaaagtggctgcttgcccatatagataggcgttaatgcgattgtatagcgtagggctactttccttgacataactggctaaaatcactccgatagcaaagaataccacaagaacaaaacaaagggcggagtctttatgtaatttacatactttccctaagaaaacaatgatccccataaccaaataccgaagcagcacacccaaacaacacaatccaaaaaatagaagcttgcaatgagaaaacatattgcgccatcaaagctccaactagaagtcctggatacgacgcgtgagataaactttcgcttaaaagaggctgcttgctaatcaagagaattgtcccccacaaagctgtggtcatacaaatcaaagtgacagctaaaaaactagataagaaaatcgtatcagaaaaaacacaactgagcataatcagcacgatccaaattgttttcctcgagagagcttcagggtttgttccaaaagttcaatttcacaaccatacgtttggaaaatagtgtctccattcagacattcatcagtagggccacaacaaatcaaacgcttattcaataaaaccacatgatcaaatagttgacgcacatgactcaagtcatgatgaacaacgacgatagtctttccctgatctcgcagctcttgcaaaacccctacagatgttttaaacgaagccatatcaatcgctgaaaacaactcatccataagatatagatctgctttttgcatcaaagcacgtgctaaaaatgctctttgttgctgtcctcctgagagctgtcctatttgtctatctgctacggattccaaaccaactctttctaaaatatgaaaggcctcccttcgatcatccgaagaaattctcccccacattcctttatagctgtaacaccccataagggctaaatctaagacagtcattggaaaatcccaatccacgctagctctctgaggcatataggctatgcgctgacgcaccttcttaaatttttgattaaaaaaataaacagtccccgaagagggtttgatcaggcctaaggaagcctttaagagagtgcttttaccagctccattaggacctaaaatagcagttaatgacccctttcccaaggaaaaggatatgtgataaagaacggctgcatgctcatagtttacacaaaggttgtgtacagaccaaaaagtctcatctttgacattcaagagccacccctcctaattcttctgtgataaggcagacattatgtttaaaggtgctaaaataattgtcgtccacattatcactatacaatggtttttgagctagacgaactaaatgacttttcttcagagaagaaacaatttttttcaacgcatcttggttcagagtatcctcagggaaaaccacactgacatcatgctcattaatataatctacaaccgccataatatcacgaacactgatttgagcttctggagatagaccctcaggagaaatacaacgagacctccatgctccggaagccacttcttcaggagtagctaaatagcgacgtgtaaagtaactgaacgcattatgacctgagacaagataccgtaaattttcaggaattgtgctcaagcattgtttcgcccaagaatctaaaatagacatttcacaaacaagttcctcactatttgctttaaattcagcagaccattcagggaacttttcaatgagaacttctgtaatttctatgacagcttccttccaaatagaaagatccatccagatatgaggatcgcaaataccgtcttcttctagaggaacaaaggccccacgcgctatcaaccgctcccctaacttgacactattgggattattttctaaatgcttccgcaaacttaatgtatgctcaagacccaggccgttacaaaaaattacggcacttccagcaatcttgtccttatcccctttaaccatctcatacgcatgagggtctaaggatcctttgatcaaaacagcggtagcaagcctattccccacgactctttcaacacaatcatgaatcatgcgattcatggatagtatacaaggacgtgaatttgcattctgaaacccagaattggtacatccaaaagttataccacatgccacgaaacagaaaatccaacgcatcactttaaatatatatcccattttcgcatccatctctctagaagcattttttaagatccattaaaaaccacttaacgaaccaccaaacatcaaagctataacccgatctaaaagatttattatttacatttttcgatcccagaaactaatgaaaaagcaaagtaccagaaaaacaagttctattcaaaatatattttatccagcaagaaatacaactaatagaaatgaaagaaatatctttgttcaggatagttttaaaaaaattagaaaacccgtttgttttataagaaaacaaaatgttatagaaaaaatcttctttactttacgatttttatgttttgaattttgttaagaaacaaaaagatcctgagaggaaaaatattgcaaaaaggagaacttgcaatataatttatgttcgctgattgattaaaacagcgctttaattttatttctctaaacattaaattgaaagtatgccacattctttcttgtaaaatatgtaagcatcaattataaaaggtgggtttcatggccgtagaacaatcacatataaaagaagaaatagaaaaactgatcggaaaagctattaaaagagtctgcggaaacaaagaaaacgatttatgtcgctatcttccaggccctagcggcggttatatgcatcatttcactctaaaaaagatgaaaagcgctgctcccgaacaacttttaaaaatgttaaaaacatttattttagaatcggaaaccccacgcacaattaatcctaagcctagagctcctagaggctctaaaaaacgtcgtgactttattaactttactaaaacagatattgaacgcgttttagaactggcaagacaagttggagacaaagacctcctcgctcgctttagccctaaaaaaccgttaacttctttaaaaagggagttaattcgttcgattcgcaacggtatcgtgagcgtagagctatggaatgcctacgtcgaagctgtgaaggctgtaagctctcccaaccttgaagttacctctcctttcgtttaattaaaaaataaattttacaggcgacttagcaataaagtcgcctaagaactcttaatcccttaggagtatccctttcctcttgtcaatagagagaaaagatggtatattataaggtctttcgaaatggaaacaattcaagttagtccacaacgaaataaaaaactatcagaatagaaaataaaagtatttcagagggtaaatatgacaaaaaccgaagaaaaaccttttggaaaattgcgctctttcttgtggccgatacatactcacgagctaaagaaagttctgccaatgttcctaatgttcttctgtattacatttaactatacggtgttacgcgatacaaaagacactcttattgtgggagctcctggttctggtgcagaggcaatacctttcatcaagttttggcttgttgtcccctgtgctattatctttatgcttatttatgcaaagctaagtaatattttaagtaagcaggccttattttatgcagtgggaacgccctttttaattttctttgccctgttcccgactgtaatttatccgctacgcgatgttttacatcctacagaatttgctgaccgtttacaggccatcctacctccaggattgctaggactcgttgccatcttaagaaactggacatttgctgcattttatgtacttgctgaactatggggaagcgtcatgctatctctaatgttctggggatttgctaatgaaattacaaaaatccacgaagcaaagcgtttctacgctcttttcggtatcggagctaatatttctttactagcttctggtcgtgcaattgtttgggcttcaaagttgagagcttccgtttctgaaggtgtagatccttggggaatttctttacgtcttttgatggctatgactattgtatctggacttgttcttatggccagttactggtggatcaataagaacgtattgaccgatcctcgcttctataatccagaagaaatgcaaaaggggaaaaaaggtgctaaacctaaaatgaatatgaaagatagcttcctctatcttgctagatctccttatattcttttattagctctcttggttattgcctatggtatttgcattaacttaatcgaagtgacttggaaaagtcagctgaaactgcaatatcctaatatgaatgactatagtgagttcatggggaacttctccttctggactggcgtagtatccgtacttatcatgctatttgttggtggtaacgtcattcgtaaatttggatggttaactggagccctagtcactcctgtcatggttctcctaacaggtatcgttttcttcgctcttgttatctttagaaaccaagcttctgggctggtcgctatgttcggtacaactcctctcatgctagctgtggttgtcggagctatacagaatattctttcgaaatccacaaaatacgctctctttgactcaactaaagaaatggcctatatccctcttgaccaagagcaaaaagtcaaaggtaaggctgctattgatgtagttgccgcccgcttcggaaaatcaggaggagctttaatccaacaaggtttgctcgttatctgtggaagtattggagctatgaccccttatcttgcagtgattcttcttttcatcattgctatttggttggtttctgcaactaagttaaacaaactattcttagcgcagtctgctcttaaagaacaagaagtggctcaagaagattcagctcctgcttcttcatagagttgcttctcttactcttgttgatccctacctgctttttagtggggtagggattttttttattaactcccatttcacgaattcgtacgcttttttcaatcaaaaaaggttataataaccgtgagacattctggttgtactatgaagtgtagtcctttaacactagttccccatatatttttaaaaaatgactgcgaatgtcatagatcttgttctttaaaaattaggacaattgcccgactcattcttgggcttgttctagctcttgttagcgcactttcttttgttttccttgctgcgccgattagctatgctattggaggaactttagctttagccgctatcgtaatcttgattataacgctagtcgtagcactgctagctaaatcaaaggttctgcccatccccaacgaacttcagaagattatttacaatcgctatcctaaagaagtcttttatttcgtgaaaacacactccctgactgttaacgaattaaaaatatttattaattgctggaaaagcggtacagacctgcctccgaatttacataaaaaagcagaggctttcgggatcgatattctaaaatctatagatttaaccctgtttccagagttcgaagagattcttcttcaaaactgcccgttatactggctctcccattttatagacaaaactgaatctgttgctggggaaatcggattaaataaaacacaaaaagtttatggtttacttgggcccttagcgtttcataaaggatatacaactattttccactcttatacacgccctctactaacattaatctcagaatcacagtataagttcctatatagtaaagcgtctaagaatcaatgggattctccttctgtgaaaaaaacctgcgaagaaatattcaaggaactcccccacaatatgattttccggaaggatgttcaaggaatctcacaattcttatttcttttcttttctcatggtatcacttgggaacaggctcagatgattcaacttataaatcctgataattggaaaatgttgtgtcagtttgataaagcaggaggccactgttccatggcaacatttggaggctttttgaatactgaaacaaatatgttcgatccagtatcctctaactatgaacctacagtgaacttcatgacgtggaaagaattgaaggttttactagagaaagtaaaagaaagtcctatgcacccagcgagtgctcttgttcagaagatatgcgtaaatacaacgcaccatcaaaatctgttaaaacgatggcaatttgttcgtaatacgagttcacaatggacatcaagcttacctcagtatgctttccacgcccaaacctacaaactagagaaaaagaatagaaagcagtctccctatacgatcttccctataaggggagtctgatcatttgcaatacctacaagcaaattgcgtttgaaagactttttataattgagatttagaaatataaaaaaatctttaatttttataaaaagaatacgttattcccaatcgggaaaagaacaaaaaggggctcgccctttttttaaaaaaagcataacaagctctctcgttattcttcttctagaagctatcttcaatgaaaacttttcatcaataatacaaaacaatttcaataaaaattttaaaaataaaaacatttctattaataggatttttgttaaatttacgatataatacgcaaattgatgagcctaggaaatgtatgagtaatataacctcgccagttattcaaaataatcgctcttgtaattattattttgaattaaagaattcaaccactattcatattgttatcagtgccatcttactctgcggactttgatagctttcttgtgtgtagcagctcctgtttcctatattctaagtggcgcattgttaggattaggattattaatagccttgattggtgtgattttaggaataaaaaaaatcacgcctatgatttcatcaaaagaacaagtattcccccaagaactcgtaaatagaatcagggcgcactatcctaaatttgtctctgattttgtttcagaagctaaaccaaatcttaaagatctcataagttttattgatcttctaaatcaattgcactctgaagttggatcatctacaaattacaacgtatctgaagaactacaacagaaaatagatacgttcgagggtatcgcacgcttaaaaaatgaagtccgtactgcttctcttaaaagacttgaaagcgctgcttcttcccgtcccctcttcccctctttaccaaaaatcttacaaaaggtatttccatttttctggttaggagagtttatttctgcaggcagcaaggttgtagagctccatcgagttaagaaaattggaggcagcctcgaagaagaccttagtgattatataaaaccagagatgcttcctacctattggttgattcctttagattttagaccaacaaattcctctattctaaatctacacacattagttttagctagagtcttaactcgtgatgtttttcaacatcttaagtatgcagcattaaatggcgagtggaacctgaatcatagtgatctaaatactatgaaacagcagctctttgctaaatatcatgcggcgtatcaatcctataaacatctatctcaaccctctcttcaagaggatgaattctataacctgctcttgtgtatttttaagcataggtactcgtggaagcagatgtccttaataaaaacagtcccggctgatttatgggaaaacctctgttgcttgactttagaccatacaggacgaccccaagacatggaatttgcctctctaattggtactctctacacacaaggcctaattcataaagaaagcgaacatttctttcttcattgacactccttagtttagatcagtttaaaacgatccgtcgtcagtcaaccaatatagcgatgttccttgagaatttagcaactcataattccacctttagaagcttaccacctataacagtccatccactcaagagaagcgtcttctcccaacctgaagaagacgagtcctccctgctgataggttagagatttctattttggaataagaaaaattctactccctctcgtagcccctttcgagactaaaaagctagttacctggtttagtctttaaagaagatactcgtcttcctatgaattctagctcctgttacaaaattgacgtcataaaccctagctctggcatttccatgctctagagctattctgtgaagaccctgtcttaatacactctctaatcgcttagaaactgaactcaaatgccttaacaagaatttacctagttctttctttggctcatcagaagcagaaaatgcttgaacagcttcttttagatcctgaatcacatacaggcctaggtttacatcaaaatcgatagaagattcgtcaagaagattttgggatgacaaagctcctacaagagcacaaagctgaaggttgtatgcggtactgttatctacaaaacacagccaatcccaagcatctctaggaagttgagtgatcagctgtagctgatcaaaagaatagccatgcaagctcaacaatagcaattccttactgattgtctcttttgtaagtccccctgcttcggtctttagagttcctcgtgccgtataggtagtgtagatacgctctacaattgctttgacttcatcagtatcccatttctcttgaagagccttgttttttaataaaagaacgtcctctttcgttaattgttgaagaatatgatgcgtctctttacaaaaaattgtagccttagctgtactgtatcccaaaggccctagccaatagtacccataacattctctagggacacctaggtctctacaaacttgtggatctcctgctgatataaatttctgaagccaatataacgggcaggtttggcttaaaagatcttcaaatattggccaattattcttttctaaatcacctgcgagcctgctaataccaaaactctctactttacttcgcaattcagaaggcaattgtttgattttctcttcaggagatatgttacacaacagggcagtagaaaattgtctaaactcggctaatgttacctgctgttctcttacaaatgcagagattgaaaggccataagcttcatctatcacgtgagtaaatctatcaggaatgattcttggtgttggtggaagcttcttctctccaaaaatcaaagctaaaattactaaagaaagaatgacaaaggcaataaaagctaaaacactcccaacaatataagaaacgggaggagccaaacagcctaaagctgctaatgcacctatacaaaagaggctggcaatggctattcttacaatagtccttgaactcaaaggaaaggtagaatgacactcgcaatgatttttaaataaagcatgtggaacgatcgtcatgctcatagccaactccttagatatagatctattgaaggcagtatagattatgtgtaaataaaaatctctaattcaagaatttcctgtaataaaaaatcccatgaaaaatagctctctcttacccttcagattaggcaaactttttacaatccccgaaaaaaatgcagatcgaacacttaaggatttcaaaaatttctgccaagctgacctaggatttttttctcactccctatctaaatggtatttaggataattcaagaaggtattttcgaacctttgatttagatctaaggaacctaggtactgtctaaacctttgaaagtgtttttcaaatacattacaaagatcttttgcaaccccgtgttttgttggtttgcttaacaaactgcatttctatcagttcttcccaggtcaatagagaaacctcaggaaggtaaaattgctcttttgcttcgtataatgcccaggacgaatgtaacagcccaaccagacgtgataactggaatccctcgccttgagaatcaaaatcacaaagccaatcccatccggactcattcatatattgaaataattgcacttgctttcaagagagcttgtgagaaaaaataaggtgaaggagggaatcaaactgttcgtaatcagcgtttaactctgcttcatctacctcttctttatcagcataatatcttgtaaaaaggttttgtctgatttgaacgagttccgaagaactccacgtgtttttcttgagaccatcttctaaaagagcaaactctccaaagctaattttctttaacaatagaagagatcgacgttcaaaaagagagggagcgttctcgtacagtcctaaaggaccacaccaatagtatccataggttcctggagtgacatccgataccatgggatataccagacgtcccaaccaatgcaatgggcaatgctgtagaagaatttcttcaaaattagggagcttacttggatgtacatctttgaacttctcaatgccaaactgtaagagtttttcttgtaaatatactggtgctttgtcgaaaacattcgtcttattaagaatagagatcaagtgatgtatctcataaatggaaacctcctgatctctaataaaatcaacaacaatacttggataatgttcttggatgagttccatgattttcttagggatcagcaactccttaggttcttgtctcatcttataaatcataaacatagcagaagcaaaaagaataagagaaactagaacaagagcagttcctaactctatggataaaagagattgactgcataccaaagctacaatagcgagtacagcagcaacaacagaaacgataatcaggctaagcgctggctggcacaccgaaaattgggtagcctgactatagttgacttgggtattcctatacacaggctgtatattaaccatagaagctccattgtgacttgagtatcagcgtgttatattattttcctaatcattttagaattcatggaattattttacttctataaatttctttcacatagactccagagcttgaaaaaatcgattgcgaagacctgaactcctactcaaatagatctcctgactttccagttcttcactacattgaagagcactatctcggacataagaacactcattcctctcttatactcttggatcgagtcgatttaactatctcaaaccccaatgctttcatgaattttattatgcttgtctaaatgactgaaaaaatgacccgcaaggactttagatgaacatatgtaaatggtaaatatttttttatctcttttagaatcggtttccctttctatagaatcctgagtgggaatcagtttcatactaacggagagcacttcttctcacttagttttttctactgctagccactctggaactctacctcaaatcagattcgactttaaacccttgtggtttctacatctcatctattatactttcatctatccaaagctaaagatgaccgcatgatcattttgctaataaagagatgcagtccgcaaaagtatttgagaagctggtctttgtctgaaggagccttctcaatgcagctttatgaaaccaggaataaacctagataacactacagtacattttgaaagaatataagatagagaacattcgcaatttttcaatcatagcgcatattgatcacgggaagtctacaattgctgatcgccttttagaaagtacgagcacagtagaagaacgggagatgcgtgagcagctcttagattccatggatcttgaaagagagcgtggcattacaattaaagctcatcctgtcaccatgacgtatctatatgaaggagaggtgtatcaactgaacctgattgatacccctggtcacgtggacttttcgtatgaagtctctcgatctctatctgcatgtgagggcgccttacttattgtagatgccgcccagggggtgcaggcacaaagtcttgctaatgtctacctggcccttgaaagagatttagagatcattcctgtattaaacaagattgatctacctgccgctgatcccgtgagaattgctcaacagattgaagattatataggcctagacactacgaacattattgcctgttctgcaaaaacaggtcaggggatccctgcaatcctgaaagcaattatcgatcttgttcctcctccaaaagcacctgcagaaacagagcttaaagctttagtctttgattctcattatgacccttacgttggcattatggtctacgtacgcattattagcggggaattaaaaaaaggagaccgcattacttttatggcggctaaaggctcctcgtttgaagtcttaggtataggggcctttctccctaaagcaacatttatagaaggttccttacgccctggtcaggtgggtttttttattgccaatctcaaaaaagtgaaggatgtgaagatcggcgatacagtcacgaaaacaaaacatcctgcaaaaactcctttggaaggcttcaaagagatcaatccggtagtttttgctggaatttatcctatagattcttctgattttgatactttgaaagatgctttaggaagactacagctcaatgattctgctttaactatagaacaagaaagcagtcactctttaggctttggttttcgttgtggcttcttaggacttcttcatcttgagattatctttgaaagaatcattcgagaatttgacttagatattattgcaacggctccaagtgtcatctataaagtcgtcttaaaaaacgggaaagttctagatattgataacccctcaggatatccggatcctgcgatcatcgagcatgtggaagagccttgggttcatgtgaatattatcacccctcaagaatatctgagcaacattatgaacctctgtttagataaacgtgggatctgcgtaaaaacagaaatgctagatcagcaccgtctagttcttgcttacgaactccctttaaatgagattgtctcggatttcaatgacaagctgaagtcagtaactaaaggttatggatcctttgactaccgtcttggggattaccgtaagggatcgatcatcaaattagaggttcttattaacgaggagcccatagatgctttttcttgtttagtccatagagataaagcagaatctcgtggaagaagtatctgcgaaaagcttgtggacgtgattccacaacaactcttcaagattcccatccaagctgccattaacaaaaaagtcattgccagagaaacgattcgtgcgctttctaagaacgtgaccgcaaagtgttatggcggagatattactaggaaacgcaagctgtgggaaaagcaaaagaaaggaaaaaaacgtatgaaggaatttggaaaagtttccattcccaatacagctttcattgaagttctaaaattagattaacattgacgcttaaaatcagcacactgcttacaattgaaaattcggtagtggtgaactaaatctcgagctacctagggtcttctcgagattttttatttttacttcactctttctgtagttttcgtgtgcacccaatcggtatgatagaactctcctcgagggcgatcgttacgctcgtaggtatgagctccaaaataatctcgcagtccttgagctaacgacattgaagagcttgctgtacgatagccatcataaaacgtgattgctgctgctaaacagggaataggtagccctgcaccaattgcagtcactactgttctacgccatcccatctccgcatggcgtaatgctccacggaaatattcttggaagatgagcgaggtattctctgggttggcagcaaatcctttatgtataacatctaaaaatgcactttgaataatgcatcccccgcgccacatcaaagcaatttctcctaggtctaatccccaattatattcttttgaagcttctcctaaaagcatgaatccctgagcatagctgatgatcttggaagcgtataaagcatgaaagacatcttgtatgaataccgagggatcatggggcatttcaaatattaagggggttcctggataattacgggcagcttgctcgcgtatctctttccaagaagaaaggaaacgagcaagaacagctcctatgattaaggaaaggggaactccagaatttaaagcatcgattgcggtccactttcctgtacctttttggcccacgacatctaaaatcgtatcaataacagggattccttccggatctttcaatgctaggacttcagaagcaatacgaattagatagctttccaactctagagtattccactctttcaaaattgtagcaacggcagttgcggagagctttaggaaatctcttaagataccgtaagttcgcatatcaactggatatcgccgtattctataccattgtgaacagcctttacatagtggcctgcaccgccagttcctacccaagaacagcagggacggccctgtacttttgctgctattgattgaaaaataggagccactaatggccacgcctcaggatttcctccaggcataattgatgggccgtgacgtgcaccttcttctcctccagaaatccccacgcctaagaagagaatccccttttcttgcaactctttacatcgtcgttcggaatctttaaaatagctattccccccatcgataatcacatcgccgggttctagaaaaggcagtaacgcatgaatgctctgatccacaggtttccctgcttgaatcatcaacatgatctttcgtggtctctccaatgaattcacaaagtcttctaaagattcaaaccctacaagctctcggtggttagggtattctttcaagaagtcccgcgttttctctggggtccgattatagacagagacagaaaaaccatgatctatcatgtttaagacaagatttttccccatgacagctaagccaataagaccaatattcgtttgcaaagctacctagcctccttaaactaatttaaatatagaacaagctttcgttttttaccttgagccaacaacacatagtgaccataacagatgtcttgttcttcacaaacactatgctcattagcgatgggcacattattaatatatacccctttttgttcaattagccttcgaatttcccctttagatttacatagtcccaaaacaagaaataggtctaaccaacgtttccctaacacctcggatttatccaatgaggcccccatccctcctgcaaacaattcatgaaaatctttttccgataaggatgaaagattccctggatgcatgctacgagttacagaaagagcctcttcaagccctagatctccatgaatagcacttaagatatcttgggctacaaattccttcactgcaactggatccgtctgtacacgcctatcaatatcttgaatttcttcattgctcaataaagttaacgtacgagcaattttagggatggtatcatcgggcaaacggagtaagtattggtacagctcaaaaggagaggttaaatctgaatcgagccatacagttcccgactctgttttccctatttttttcccctgagcattcgttaataaaggataggtaaggccgtaggcctgacccaaccctttacggcgaataaaatcgattcctgaagtaatattcccccactgatcgctaccaccgcactgcaagatcgtgccataatttttaaataagtgataaaaatcataggattgcaggattaaatagctaaactcggtatagctaattccttcatcagaatgcacccgctgctttattgtatctttcactagcatttggcctaaacgaaagtgttttcctatatcccttaagaaatcaatcagggagatctcctgcaaccagtctgcattatttacaagagtcaccccgggaagatagcgctggagacacgccgtgatcttttgactgttatcaaaaacttcacttgtctgaagtaacgatctctcgctctgtttccctgagggatctccaaccatacctgtggctcccccgactaaagctatgggggtaatccccagagcagcgagtctcttcaagaaacaaatcccaatccaatgaccaatatgtagagcaggtgcggtaggatcaaatcctaaataagcggcgataggtccctctacggattccaaacctgcggtaaaattctctaaaatatttcgctcttgtaaagattgtaaccaggattgcatgagtgatcgtacataattaagaattgccaagctctatcttatcgatcctaaagcttatatgcaaggcaccacctatctaacaataaagaaaagattgtacgctgagaataattcctttgctgagataccataacttctatcttctctaaagattaggtcgctatgtctacatctccaattggggttccgtcgatgctaaacgccgcaactagtctaaatgccacaactagcaaggcaccccttcctacctctaccctagccgaacgtattaaagaatggctgccccgcattcttctcttgattgtaggagcaatcttcacaattgctggctgcattgttatggcgttgactaaacaaattctttacggattactctgtgtcgtaggagggcttctcctagctctaggactgctcttaaaacctgagaactgtatttatcgaaatgcagagagtctgcgcgaagcttaagcaatgctttagagtgaatttgagagacgcgagactcacttaccccaaggaccttaccgatttccttaaggacaagttcttcatagtagtacagggccatgaccttgcgttccttttcctcaagttcctgaatcgcattggctaaacataaagaaaattcttgtttatctacaacatcgtaccctgtctcggcacgttcatcggggattctctcttcaagagccattccggctccttcatcactttgtgaaggccactcttcattcagagacacgattaatgcaggacgggcagatacaaaccatcccgaaagctcttgttgcgaaatattgagatactcacacagttcaagatccgtgggttccttgcctaaagactggcgaagagaatccatagctcctgacaatttattcgctttttgatggacactacgaggaacccagtcttgcttacgcagatcatcaataatggcagccttaatcagaaataccgcataaccttcaaaacgacgacttctctcaggattataacgttccaccgcacggacgagaccttcaacacccgaagcatacaaatcctcggtctttacatgggaaggcatccctgaaatcaaacgatgaaccacactttttactaaaggcaaatagaactcaattaagctatcgcgatactctatttcctgagtctcccagtagaagttccaaacctctatgatgttttgagtttgctgtgttttcacaaatttttttttatctagttatttattagattaattcaaaaaaaatttttaaacaatatttacaccaacaaaaaaaatacgaaagtaatagtgcttacagaagattaaattaaattaaggaactaaaacctcatctgaaacgatccctaagaaggaaatagggatttctttaggaagctcatcatgagataaaaccaaaagatcagggaaatgtgggtcgagcatttttttcatctcaaatcgtgtttcacagctcgtaactatggctcgaaaatctttaaataccgaccgttctaaaagactgtctactcgacggatcacattctcttgcattacaggattagactttgagtatgagctgtttatcaattcttcaacatgaaaatctatggtaattacctcaagggtttgtttctgatcccagagacttctcccaatccaatatccgagagactttcgcactttttccgcaaggatctccaagctgtctccagaattttggtataccgcaacggcctctagaatctttgggnaaagcttaagcgataccctttctctaacaaggaggcgagaaagaactacaagagagcttaaagagattttcttaggaacgatgtcttcaacagcgatgccaaacactctctctgattcctcaaggtacttttgaactacctcggcattgagagcctcatgagcgatgtttctaaggaaaggaagcacagcctctggagtcatttcatctaagtatacattctggccaaatactcggagccaaggacgctcttcaatacgtagagaagtaagcacaggcaatctaactcctaaatcttcaaatacttcttcggatgctgcacgatatacttgatagaactgtgattcttgttccttagggcaggccccctcaacataagagaacgcacgttctatacaagaatcttctgatgcaggctcttcttttcgatacgccaaccataaaagactcgcgagcaaaacgatagggaattttggagaactgggaatgcagcacaaagaaaagatcaataacgacaccaccctgaaatgctgacgcaactgtttgtagtattcgaacaggtaatttaaaaggctctcttccttatcgattttactaataagagtggctgcagcacacgaagtaagtaaagcaggtacttgactcactaaagcatctcctaaaactgtaaaccacatctgctcaagagcataacccgaagtataataaagacaagttacagaaactacgttcacgagtaaaaggatacaactaataattgcatcccctttaacaaaacgaaagaccccctccatggcagagaagaaatccccttcttctataagggcatttttttgttttttgacagccttataagaagctcttccagaaacaagatcagaatctaaagccatctgttttgctggaagagcctctaagaaaaaccgcgaacggacctctgcgattctttccgaaccctttgaaaccatcaaaaagttcacaaagaaaagaaggaggcacgcaaacgttgctgcccatagacttcctaaagagaagaaactgcctaaagaaacaatcagagaagaggcggttcctgaagagacaatccatcgtgttgatgcaagattcaatcccaaccgcaataggcaaagatataagaaaaatggaggaaaaacttcgctgaattgcttgaatttaaggtaaagacccaacagaccgttagtaaagacaatgcaaaactaatacacaatccaaaatcaagaaggatctgaggaagaggtaaaaagattagtactaggatgctaagagggacaaagatcattccccttacaccatctttcttcccagacacaaaaacagcctcctagagaatccctgccttttctcatacttccctcttccatatatctgcaagtaaaactctaaagagacgttatgaagcatctttgatcttgtcgactatttccttctatgctaacgttgatctcttttactcgaaaattttattttacggagtatagcgcagcttggttagcgcggttgctttgggagcaataggtcgggggttcgaatccctctactccgaacttcattttaatctatccgacaatacgtagaaggaaaactccatggccaagctagtcattacctctgatgatgaacaacaagagttcgagttagaagacaatagtgagatcgcagagccttgtgaatccatgggcattccctttgcttgtacagaaggtgtctgtggaacttgtgtgatagaggtcttagaaggacgtgagaatctttctgagtttacggaaccagaatacgattttctaggagaacccgaagactctaacgaacgtcttgcttgtcagtgccgcatcaaaggtggctgtgtcaaagttactttctaatcttagaaaataaaaattttatattaatacaacttctattctgacgaactcttttctaagtagttatgcgactctttgcattcaggaaaggcttgatttactcgcgagcctttcccctatctttcttgttttcaaaaaaaatttaactaaataaacttattattttttatatttacttagaaagatgacaaattaaaaaatatttttaaatgcagaaatgtttttaattatttaaatatcaataaaagagatataatttaaaggaactcaggtgaattccttaattatggctacaatctcacccatatctttaactgtagatcatcccctagtagacactaaaaaaaaatcctgcagcaactttgataagattcagtctcgaattctattgattactgcaatctttgctgtcttagttactatagggaccctacttattggtttgcttttaaatattcctgttatctatttcctcacaggaatttcatttattgctgttgttcttagcaactttatcctttataaacgagcaaccaccctcttaaaaccgcgtgcttgtggcaaacacaaagaaataaaaccaaaaagggtctccaccaacctacagtattcttctatctctatcgcaatcaatcgttctaaagaaaactgggaacaccaacccaaggacctacagaatctccccgcaccctctgcattactcacagataacccttacgagatatggaaagctaaacattcactgttttccctagtatccctcctaccgggaggcaatcccaaaacatctcttaaattcaagcttccgaaaatttacgaaagactctgttaattgaagaaacctcgcaaaatgcgcctatatcctccctacgtagataccactccctccccaaaatccttgctcaatgaggcaattcaggaaaccagggtagaaataaatacagaactccctgcgggagattcaggagaacgtttatactggcaacccgatttccgaggccgcgtcttcctcccacaaataccaacaactcctgaagccatctaccaatactactatgcactctatgtcacttatatccagactgcgatcaatacgaacacccaaattatccaaatccctttatacagcttgagggagcatctctattctagagaattgcccccgcaatcaagaatgcaacaatctttggctatgattacagcagtaaaatacatggccgagctgcacccagaatatccgctaactattgcttgtgttgaaagatccttagcccaactacctcaagaaagtattgaggatctctcttaggatctctatctcactcaaaacggctatcctaaaatcaagggtacagtagattcgcgaacgaaaaaacaaactcttggtacgcatcttttcagtttggttatctcgagatgatgagggacaaaaaggctcctaaagcctccaagatctttccatgacgcaattcaagaaaaatcaaaatagcccctcaataatagaaaaaacactctcacgacttatacaaatcaaatacgtaatattttacgcacgaattcttaggtactcttgttttaataaaagatattgcaacacttctcttctaagttaaattaaaaactcatgtttttataaaaaaatattacacaaaagaaaatatagaattttattctctaataaaaattaaattaaggtataatatctgcgcaaattttaattaaaggatattaaaataaatgggatatcttccagtatctgctacggacgttctttttgaaagtccagccgctcccttaatcaatagcgcaaacacacaaaatcagaaactcatagaactcaaggggaagcagcaagctgagtcttctccacggacaatcacttctgtcatattggaagttctcctagtgatcggatgctgcctcatagttcttagtttattggcaatccgccctgctctgcaattcactctagaaactggacatccagctgccattgcagtccttgctgtctcaggaacaattctattggtggctgttatcatcttgttttgctttctagcagctgtgccattcgctgctaagaaaacttataaatatgttaagacggttgatgactatgcttcttggcattctcatcagcaaacaccgaccctaggcactatcttttcaggtatcgtctatgcagaatcccaggcgcaattatagctctcctaaccttacaaactttcttattgagacctctacaactcacccagtttgtgattgacctcctttttgtttaagatagagattatgaagacccaaaaagcggcaattcttataagtctgactgtaccgacttatagacaaaagataagccactgcctgtgtcttcaaattaaaactcattaaattgttattaaatgaaaatatttcacaaatagttaatttctacactgttgtaaaacatcgttctccctaccccccccttttattgacctctgaagatgatatatgggccttcgaaagtaaacctgatgtcctccgttacccatgcccatgaaatacacatgtcttcaccccccattagaatctcaagtagtattgtcgatctaagaagtctttgaatcccatggctggggtagaatcgttccccataaaaccacaaacgccacccttttgaaccaagtggagaaaaaactctgtgtggcacccacttagagttctcttatgaactaaacaataaggtgcgcctctacgccttaactcattaaaattaatgaaattaaaaagaatttataaaaatctttattatcaaagaaaaagattttttgtnaaaaacaacaaattaagatataatcttttcctttaaatagatattttatgactaaaaccacttcaatcccagatgtacacgagaatcaatcacatttgtctgtagatgagagattgatctcagaatcacccgtgcttactaagaaagaagtgattgctaaaataataaaactcacagctcttattcttgctttagccatagctgtagggactgcagttgttgctggagttcttggtatgcctctcatggctatagccactggtgctgctctccttgcagcagtcgtactctcttgtcttcttttaagaagaagagagccatccaaaccgacagaagagctccttgggccccaaaaacatgtccccaaggatattgcagctcaagtgcaaccctcagtccctctggattaccaaaagctgctgagaaatgaatggaccctagtcaatactctctcagaaatcaatatatcctggactctccaagatcctaatcaaagatactatgtctgggaacatcaaggagccccaattaccttagtagccactacaggagacatcgctaaaccacgcctgaaaacctcaggaagagtcatgattgttaacgcagcgaattcgaacatgcaatctggtggagccggaaccaatgctgctctctcagcagccacacaccctacttgttggaacaatacgagaacatctgggggaaaaataaacactggcaaaggattatctgtgggtgaatgccgctcagcaccctggatcaatagagactggacgaataaatgatacgaacccaggagaagcacatttcttagcacaacttcttggtcctaaatatgaaggagaattgaaagcacatcctgagaaattaagcaatgttattaagaaagcctatttgaactgttttgatgaagctctcaataaccaagccactgtggtccaagtgcctctgatctcttcctctatatactcacctggaggaaagctggaactagaacccgtaaaccaaacaaagcctaatagcagtgcatataagctttaccacatccgtacgtagtgggtaaatgatataaagaaaggtcttatggaagctcttcgctcctttgctgcgcagcacccctcaactcccatggactataatccttacagaccacaaacagctacttatggtcccttttaactaaaaagatctatttcaataggatgcattaataaactaattttgttttataaaaaaatctaataaaaatacaaattagtaatataatagttgaaaattgatctattaataaaatattatgacagattctaatcccctaccctcttatacagacgccagtctctacagaactcctgcgaaacattcctatccgattagactccctctcaaccgtacagatagaatcgagaaaatactgaaaattgtcaccctcacactagccctagcgtgcgctttgggctttagcattgctgctggcattttggctatgcctattttttctgccgtagttgtcataacattagcaattgctgcggtctcactttactcccttttaaagaaacctaaattatacgagattcttcctcaaatcgaacccgaatctgagcaaagttctctgtctccctctccccagcctcctgagcaacaggacctccctttgcagatcgatccacttcccgatcccgaatcactccccgaagtctctcttgctgatctaaccacacccccagaagaacttaccgctatcacggtcactcctggctatgaggctcttcttgaacaaaactgggatcttcttccgagcttagccgctgtagacccatcgtttactacagaaacacctcagcagccctgttttatttggaagcttaaagactcgaagcttatctttatatctacctcaggagatattgcagttccaagaatcaaaactcaaggcagggtgatgattgttaacgcagcaaacgagaacatctcccgagaaggagggggaacgaataaagctctatccctggctacaagtctacagtgttggaacgcatctaggctccctagagcgcactctcgttctggatcccaactacagccaggagaatgccgctcagcaaaatgggaaaatagtgatcacacctcaaacgaccatgtcccaggcaaagcacacttcttagcacaactgcttggtcccgaagctgctaagtgtaacaacgatcctaagcaagcatttgaagtaagcaagaaagcgtttcataacctgttccaagaagctgaaatcataggcgttgatgtgattcaactccccctcattggatgtaatctatttgctccatcaagacttctaaacctcgggaaaacaagagcagaatggatcgaggctataaaattggcactcatcacatctcttcaagattttggatgggaacaagacaaccaggaagagcaaaaaattatcatccttacagacaaggaccagcctcccatcattccgccccgtttcgatctaacgactccctagtctatgtcggaaagcgtccgtgcttccaatcgaacagctttctaaaaacacagccaatttatcctgatcacaagcaccccctagattcttggctctaagccgcatccaatactttttaaagtgaaaatgttgtctatttattattttaaataaacaacttctatttaaaatataaataacttcacataaaaaagaatcttttttaaactttttgttttttatttaaaaagttttatgtccaccacagaacccaatttgactaacgtaaatctaaccatgctgatcagcagcgaaagcatgcccacgcaactcgcatctcataagctcaaaggtctggaccttgtcgcttttattctaattataggaattgctgtaagttctggaaccgctgctataattttaggcattcctctattatttattcttaccgctctagcagtcttggcttttagtattcttctctattttctcttaagagaacctaaaagtcctataagcgtaacgcatcagccgacgcccatcataaaagatacagaccttcctcctgtcccgcccctagcactcaccccagtgcctacggaagctgtcctagaagagcccccgcttccttcccctagaacccatcaaacactgttacaagaaaattgggaccgtatacctgatctacaggctaacacagatatgcctttcatcgctgctgacaatcaaaccggttatgcttggcatttgaaaaactcaaacctgactttgatctctacgttagggcccattgaaaagcctcgctataaaactcaaggcatcgtcatgattgtgaatgcagccaccccaaacatggcaaacaacgtaaaaggaacaagtctcgcacttgcgaaagcaactagtgtacgctgttgggaaaattcgaaaaaatctccggatcctctccgttcaaaacagcccctacaattaggagaatgccgctcagcaaaatgggaaaatctaaacggaaccacgaatgcaggtaaagcaggactaccgcaattcttaggacaacttctagggccgaaagcttctgactataactacaatcctaatgatgcgtttaccttttgtaggcaagcctaccttaactgtttgaatgaggccaagcgccgtaaaacaaccgtagttcagctccccttgctttcctcccatttccctggctctccaaaagacgaagagactactagtctacgtctgcaatggattgatggtgtgaagttagccttgatagatgctctgcagacatttggatcagaagcagaaaatcaaaatcaaccgtgggttatcattttgacaactcttgctagacatcccctcatcacaccctaatctctccccctggttaagcaaaagagagtagatgcctttttgtgaaaaggaaatcctttcttaaaaaatggtaagacttctctctttaaaacatccaaaacatagaagattttttaaaaaatcttttctaactttctaaaccacgctatactttctcaagcaaatagaaacgcctctgctctccataagacaaagcttttgcgaaataaagaaaattctaactaaaagacgatgcccgtgtcctcagcccccctacccacaagccaccgcccttcctctggaaatctaggcctcatggaaccaaattccaaagctctaaaagcaaagcatcaagataaaacgacgaagacgattaaacttttagttaaaatccttgttgccattctagtaatagaagttttaggaataattgcagctttctttattcctgggactcctcccatctgcttgattatcctaggaggccttattcttacaacagtactctgtgtgcttcttcttgttataaagcttgcccttgtaaacaaaaccgaaggaacaactgctgaacagcagataaaacgtaaactctcttctaaaagtatttcttagacaaacagcggtgtttttcactcattataaataaaatattttattccctaggtcatagaaaatatgagagtgtctcctcctattttagtaggagattaatttgtaaaacactaattacattgcatttaaaatagaaaactataaaattatagggcttgtcatagaaatataggaaatcacatgtcttctccagtagtcacaggaacatcaagtgcatctccagttgaacaaacaaagcttggagaattcctagaaaggttatcgggatcaggacgatgcataaaaattgcctttgcggcttcaactgctttactcctcctcaatacctttgtttctggaatcgttgctatagccatgatctttgtagcaacatctgtcggagcctactttacagttatagggcccttattcttgctctccctaatccttctggctatcatgttaatctcgatgtataaaatcacgcatccatcacaaaatacaccgatttcaaattagaaaaaagcgttcccaaagtacgagccccaagcactcctcttgggaactccttctctttgtcaaacttcgggattcgttctacgaacacaaaaacagattcgagttccttacgaatcgtcctctaaagcaaaatctttatccccttgataagtatgaaataattattttaattcacaataatctctccatatactctcttgatggcctgaaacactcggccatccaaggtcgtcgtttctctctgaaaattcctcttattgaggtgaagttctgtaaaattgataaatgtaggcatccttagagaagctttatcagcttcaacaaaattctctcggcttttataattgataaaactctgaaatttttgagatttttatgacactcattacccctgccatcaattcctcgcgacgcaaaacccatacagtaagaataggcaacttatacataggcagtgaccactcaataaaaacccaatcaatgacaacgacattaaccacagacattgacagtacagtagagcaaatctacgctctagcggaacataattgtgatattgtcagagtgactgtacagggaatcaaggaagcacaagcctgtgaaaaaattaaagaacgtctgattgctctagggttaaatatccctttggttgcagatatccacttcttccctcaagcagctatgttagttgctgattttgctgacaaggttcgcatcaatccaggcaactacatagataagaggaacatgttcaaggggacgaagatctatacagaggcaagctatgcccaaagtctcctgcgtcttgaagaaaagtttgctcctttagtagagaaatgtaagcgactaggcaaggctatgcgcattggagtgaaccacgggtcactttccgaaagaatcatgcaaaaatatggcgacactatcgaaggaatggtagcctcagcaattgaatatatcgctgtatgtgaaaagctgaattatagagatgttgtcttctcaatgaaatctagcaatccgaagatcatggtaactgcataccgccaacttgctaaagacttagatgctagaggctggctctatccccttcaccttggagttactgaagctggaatgggcgtggacgggatcataaaatccgcagtaggaatcggaactcttcttgccgaaggactcggggataccatacgctgctctctcacagggtgtcccactacagaaattcctgtctgtgatagcttgctacgccatacgaaaatctacttagaccttccagaaaagaaaaatcccttttccctacaacactccgaaaactttgtttctgctgcagagaagcctgcgaaaacaacactttggggagacgtctacggagtctttttaaaactctatcctcaccatcttaccgactttactcctgaagaactcttagaacacttgggggtaaatcccgtaacaaaagaaaaagcattcacaactcctgaaggggtcgtcgttccccctgagttaaaagatgctcctattacagatgtacttcgagaacactttttagttttccaccaccatcaagtgccttgcctatatgaacacaatgaggagatttgggatagccctgctgttcatcaagctccatttgtgcattttcatgcttcagaccccttcattcatacctcccgagatttctttgaaaaacaaggacaccaaggaaaaccgaccaagctagtattttcaagggactttgacaataaagaagaagctgctatttccatagcaacagagtttggagctctgcttcttgatggccttggagaagctgtggttcttgacttaccgaaccttcccctacaggacgtgctaaaaattgcctttggcactctacaaaatgcaggggtgcgccttgtaaaaacagagtacatctcctgtcctatgtgtggtcggaccctctttgatcttgaagaagtcaccacacgtatccgcaagagaacgcagcacctaccaggacttaagatcgctatcatgggttgtattgtgaatggccctggagaaatggcagatgcagattttggatttgtaggttccaaaacagggatgatcgatctttatgtaaaacatacttgtgtaaaagctcacatacccatggaagatgctgaagaagaattaattcgacttttacaagaacatggggtatggaaagaccctgaagaaactaagttgacagtatgactctatccttccacactcaccctctgaactattggactttcgaagaattcgatggtttgcctatacgccacggagtcttttcaaaacaaaaggatgccgagggcacggtcttcgcagccaagaatcctgagattgcttcagctctccaatctccgaagtattgcgaccttcatcaacgccacggcacttccgtacgttgtgttacacctacatcccccacctaccaacctgcagacggactgtgcacgcagtctccgctcctctctctccatatccgccattccgattgccaagcagctatcttttatgatcgagaacaccacgcaatcgcaaatgtacacagcggatggcgaggattgcttggcaatatctatgctgtcaccgtaggtactatgaaaaaattatttcatacaaaaccacaagatctcttcgtagctatcggcccttccatcggtccagattatgctatctatcccgattacgctacgttatttcctcgtagctttcttccctttatgaatcccaaaaaccattttgacctgcgtgcgattgctcgcaagcaacttacgaatttaggaatctctaaagaccgcatttttatctcagacctctgtacctacacggaacacgacgctttcttttcttcaaggtaccttgctcaccatcccgatcccaatctcacaggccaacattcaaaaaatagaaataatgtaaccgccgtccttctcctacccagagattaaaaagatccagccaagcttcttttcctttcccctaaggaccttagcttctagaagaacatgcttcgttccaacccactcagaattcagtaatcttcttgatgaaaaacaacatgtaaactacaatttttaggaaaaaattaagcttaaagactttctatgaaattaggcgcatcaactaatcataaagttcacgaaccagtgaagccaaaaaaagccaaactcgctgagattgaagctancaaaacccaagctacagaaggcacactcagaagtaaaagtcttgctcttcaaattgcgcgtgctgttctttacatacttttcgctgcactaatgttagcagctggaatcacgttcgttaccttcgaagctttaggcttccctctaatacaggcgtatagcattgctggtattatcacactcgtgggattagccatcgggctcgtgcttctcatcttgagcttgttgcctaaagaagacgaggaagcagatgcactttctagaaacgctcttcttccattaaccatcattgtaatcgagcaacaacccatcactcctaaacctgagatcccctattcttatttaactaaactagccctattaacatcattgttccttaccttacgacgctcttcctcccaaagaaaaactcactaaagaaatcaaaattacagaagctacgaattgtgaaattcaccatctaaagaagggtccttaatttaaggttgtcacagctaaagctcctaatctcacagaaattagagatcacggggctcgcgtaccttcgctattcctcctttcaccagaaacttcgcattggaaaggggataaggaagtctcggctcccctaaagcaactgcaagatctcttaggagaggaacagtgggaagctatgaaaactaaaatgaactctagaaaaaaagcaggtcaatgggcaattttcaattctccaactcctggtgtcagttcaactttagttttagcatggactccttggggttattacgacaaggatgtacaagatatcttagaaagaaaagatccgatgagctcttcgctttctgaaaaagactcaaaggagttcttgaaaaatctgtttgtagatctcttagaaaatggcttcacatcagtacatattcacgcagaagaagctttcactcctcttgatcataccgggaaacctcactttaaaagagacaatgtgtacttacccggaaagttgttaggcgccttgaatgaggctgcggtacaagccaatgtaagtgcggatactcaatttacattgttccttactcaagatgagtgcaatccttttcatgataagaaaagaggttaaaaaatctgaaaaggctctaaaagagcctttatgagaatcagagaaattacaagtcgagtaatgaggcaggattctctaggccttctttcactttgactaaaaacccaacagcctctttcccatcaataagacgatgatcatagcttaaagcgacatacatcatatctgcaattacaatttcattatcaagaacaacggggcgcttttctatcttatgcatccccaaaatccccacttgcgggggattgataatgggagtcgaaagtagcgatccatatacgcctccattggtaattgtgaaacctcctccctcaagctccgctattgcaagtaggccttcacgagcccgaagggaaagatctgcgagtttctgctcaatctccccgttagaaagtttatcgcaatcgcgtatcacaggaaccacaagtcctcgatcgatacctacagcaatagaaatgtcataatagtgacggtaacaatctcctcgccatcaatataggcgttcactcgtggatatgccttcaaagcctctaagacagctttcacaaagaaagacataaatcctaacttcaccccatatcgagatagaaactcttcttgtttttcctttcgcaaatgaaaaagaggtgtcatatagacctcattgaatgtcgtgagcatcgcagactcatgtaaagcagacaaaagacgccgcgaaattgtcttacgaatcgaggtcatgcgttctcgagtttctcctcgatctcctgcagaaagaccttgggatccttggtccatctgatcacgaagaggaataaacgttttattctctggaggagactgacgcaccccagactgaggaaagcaaatgatctcagcttctatagtctctttagactgagaatctccaagctcttccccttcacctgcgggctctatttttcccactaccccccctacaggaacaacatcgccttctgaaacctcccagaaaattcttcccgatactggggcataaatgagctgatttaccttatcactttcaatttctagtaagccctggttttcttgaatcagagcaccctctgtaactaacaaggaagctacggtcacctcgctaatcgactctgcaatattaggaatgcgtacttctgtagtcataatttaccttaaagaaaagagggtttccatacacgtgaccagctcttgacgactgacttcgctgatccagaagctgtggaactactccgaggacgtcctatatatagcagtttctcaggaagaatgtcttgcaacgccataaacatatagtcataggcccccatattcttggattcttcttgtagccaaacaaaatgtttcaaatgagaatacttatcgataaggctcactaaatcctcaagagctaaaggatacaagctctctatacgcaagcaagaaaagtccttacgccgatcttgaggaagcatttctgcataatcataatagatctttcccgaacacaataccaaaatagaagcatcataattaggatcggcatcttcgagaatagcacggaatcccccaggttctgtgaactcctcgatactacttacacattgtggatatctcagcagcaacttaggagtaaagatcaccaaaggcaaagaaagatctctcttagcatgctctctgagaatccgaaaatattgcacaggagtggaaggcaagaccacttgaaaattccagttcgcggctaattgcaaataacgttctatacgagatgaagaatgctcgggtccttggccctcatacccatggggaagaagcagaacaatgtcagagtgtaaatcccacttctgaattcccgaagagatatactgatcgaaaatgatttgtgcaccattagcaaaatccccaaactgcgcttcccataacactaaagtctttaatgcctgttgagcatagccatactcaaaccctaaaattgcatattcggaaagaggagaattatacatttctacagagccctgctctgcagaaagatggtacaatggagagtaggtatctccagtcacagtatcactccataccaaatgtcgttggctgaatgtcccgcgaatagaatcttgacctgagagtctcaggttgtacccttcgattaatagcgaagcaaaggctaattcttcggccatcgcccaatcataaccaaccccaccttctgccattttcattcttttttctaaaagagtcttaattttaggatggggatgaaaattgtcagggaaaccacaaagacgcgagctcatatgaaaaagagtctcgcgatccaaagaaacatcacaatcatgcaaaataagctcgccgttatttaagcgatcgcagtgatgacattcttttttaggaaagggttctggatccgtccctttcaatacttgaaactcacgattcagactctcttgaatctctttttcaatagatgccaaagtttcttcagaaatatctgcaaactgcccttccaacagatattgcctaaacagctcgcgaatactcttctttctcttaatctgatcatagagtaagggagctgttactgagggatcgtcactttcattatgtccatacttgcgataacagcagagatctatgatcacatcacaactaaatctctcacgaacttgcagagcgtactctatagcttctatacaggcaacgacgtcctcgctattcactcgaaatacaggaatccctagcattttagcaatatccgtacaataaggggtggaccttgactcccgtggcactgcggtaaaccctatgtaattattcacaacaatgtgaagcgtaccctcagtagaataccctggaacacgactcagctggagagtttcataaaccactccctgaccagaaaatgctgcatctccatgaactaaaattgctaagctgctttgctctttacctgcgtgaccttggtgttgcaaggcagccacgaccccctcgacaataggatctacagattcgagatgactagcgtttggcaacatcacaaaggtagtttccctatctttctgatgggactttagcacataccctttatggtactttacatccccaacactctctaaaccacgtgctgcaggatcgtcttcaaactccataaagacataacggtaaggctttcccaaaacattcgttaatacattcaaacgacctcgatgggccattcctaaaacgtagttagaaattcctaatgccgatccataatgaacaagatgctccaacatggggaccaaggtctctccgccctctaaagaaaaacgtttctgacctgtaaattttatctgtaagaactcttcaaaaaacgttgctttacataagtctttataggagcgaaggagctgctctgcaaagcgctccacttgtcgcttctccataagattccaaacaaactcctgcaactcaggagtacatgttagggtttctaaagtaagacttccgcaatagcatttttttaaagcttcgatcagctctcgtaccgaaacctgagctttaggaagtagacccgcagaaggcacctgctcatccagatcaatcttagcgatcttttcctgaatgaatcgagaatctgtagttggggcaagcgttgaaatttgactttgcaaatatccataataacgataaatcgtacatagaaactgagatttttgttcttgaagcatagcaatagtttcattcccagaaatcttagtactagcttctgatggagatgctgcttgaccgagctgatacccttcaaaaaaatacttccaagaaggatccaaagtctcgtgattcataaatctctgatacatagactcgatccaatccatatccgaagaatatacttgccccacaaactcggaatccataaaataattaaactcaataaatacgatctaaatgtctgcttcatagcaaatttttatttttcaaaaaaaaaaaatttttttttttttctgcagttgaaaaaacaaaaaaatgctatgcacctgctctcgaatacaggatgggaacccttggatgaaaagcgaacgtcttaaaaaattagaatcagaacttcatgaccttacgcaatggatgcagttgggtttagtgccaaaaaaagaaattagcaggcaccaagaagaaatccgaatcttagaacataaaatttacgaagaaaaagaacgtctacaactcctcaaagaaaacggagagattgaagagtacgtcacaccacgacgcagtcccgcaaagactgtctaccctgatggtcctagtatgtctgatattgaatttgtggaacccacagaaacagaaattgatatcgacccaggcgaaaccgtagaactggaactcaccgatgaaggacgtgaagatggggcagtagaagtcgactattcccacgaagacgatgaagaccctttcagcgatcgcaatcgctggagacgcggtggtatcattgatcccgatgctaatgaatggtaaggctcccctagctctttatattcatattcccttctgcacaaaaaaatgtcgctattgcagtttttatacaatcccctacaaaagtgaatctgtatcgctctattgtaatgctgtaattcaagaggggctaagaaagctagcccccatccaagagacgcatttcatagagactgtgttttttggagggggaacaccttcattagtttctcctcttgatcttaagcgcatcctcaaagagctagccccccatgcccgggaaattactttagaggccaaccccgaaaatctcaccgtaagctatctacgtcaactacaagagactccaataaatagaattagcgttggcgtacaaaccttcgacgactctatcctacagctcctcggaagaacgcattcttcatctgcggcaatcacagcactgcaagaatgccagaatcacggattctctaatctttctatagacctaatctacggactgcccacacagtctttggagatattcctaagcgacctacatcaagctctgactctccctatcactcacatttctctatacaacctcactatagatccccacacctccttctataaacaccgcaaaattctagtccccacaattgcccaagaagaaattctagctgagatgagcctccttgctgaaaatctcctactctcccaagggttccaacgctatgaacttgcttcatatgccaagccagattaccccgcaaagcacaacctctattactggacagatcgccctttcttaggcttaggagtttcagcttcgcaataccttcacggagagcggtcaaaaaattatagtcatatttctcactatctacgtgctgtacgtaagaatctccctacccaagagacctcagaaattctcccaaaaaaagaacgaatcaaagaagccttagccctgcgactccgactccttgaaggagcagacctcgcggagttcccctccacacttatctccatgcttacgcaagatgtaaaattacaaaacctattcagtgtgcatggacaatgtcttgccctaaatagacagggccgtctcttccacgatacaatagcggaagagattatgggatattccttctaatccctgcggaaggctaaaacctagactctgcccttcggactcctgatgctccgggaaacatcagagaactcttaaaggtaaagcttctttctcggtctttcttttttttgccgtgctcttatgttaaaaataccaagatgtctccaaagatacattagcgacgacgacgcctagaatggcgtaatacggacttcacaaagaaccatagatttacgaacaagacgaaagcacataagatgaagtttaatgtttggccaacagctaatacatcaccactgctccaattttcttcagcacttttattatgtagatcataaacagcagtgttatttggacgtactaagatacgtggaacttgtattgcaatctggttaagcaccataatggataccggcaaataaagtcctccatgtacagtttgtaaaaagcctatgataaagcctgcacgatcgcgataagaagctcgtactgttcctacaggcaggccacttcctataactcgttgctgcacaaattgttgtacacgatgtctaagacctcgccccatccagcgagtgcactctacaaagacaatactccctgaaattgtagacgcagaaataaaaattgctcgtaagatttcctgaggcatccatagtttacgcaggacgttgccacaatcaaaaacaagaacaaggatgcttggtaaatatagagattgtgctacgattcgtgcagtacggaatctctctctagactgaggataatttgtaaagagtaagaaaaaataccggaccgcaaacgtcgtgtgcatcaaaattaaagagtaacagatctgcaagtctaagccctcatgaacagaggctaggatccattcctgcgcaagtcctgaaactctagaaattgcataaagcgcagaaagagctacatcaggacaccgttggggatagggattgatttccatatctgatgaaggcgatccttgattcaaccattctacaagcctactcatagaactaggatccgtagaatcaatgacaacagctagatctctttcactgtgtggtaactgtgatctttcggcatcttgagaaagacctcccctatcttctacatcctcacccctattcgcaaccaagcattgctctccaaaacgcaccgcccaagtaaaagaaggacaacggatagaaggcagaaaaacaccctcaagacccgaagaatacggcagtatcgtggtgttctccgccctagttccccgacaatccagagaactaaagaagtctccagaaacacggtaattatggaccctaaagtctccttgaataaagaccgtcggggaaatccctacaacaacaatacgtggactatgcctagattgcgttaacgcctgttgtatataaggcgatgcatccccatagaaaatcactagaaactcacgattctgattttcaggagcagagaaaaactgttcccaaaccgtcaaaagggcctgacataaaggatgatcgagagtaggaagagtacgacaaggactgatgggccaaggagacatgccgcttccatcgttatagagaagacgaacggcctctccccgtacttcactaatatacagcaattcctgtacagcttcttgatgcgtttgccaacttccatttacatagagagtacgtacctcagaatctgggggctcaggatcctcatcaccgccacaaaggcaaaccaactcatacacatccgaagccacagaagcagatgaagaacttctagggcctcctgcaatgaagaccgagatatcttcagccgaagatgcaactgttgatacgtctagagaaggaggagatattgtaattctcgggatttggatatcggcgggaataggatttggggatagaggttccgtttcttcgagtagtgttggtggtgaagatcgagattctgtgggtgctgtcatcaacgctctaaacttatttggcaaagattataaaataagtattgataacacgcaatagaggattacgattattttaaaaagacgcaaacctatgattatgcgctatttagaatcatgcaacctttaatttttgcttatgatcacaagaaaaatatccccgaagagcttacatgctaagaaactcctgacaatgataccggggataaaacaagctaagaaaaaattaattcgggatgtggaaaagaaatattgttgggactttggttatactttgcttcacagaacctaagtcctcagtagttctccatgattgcacttggcgtgtgagaacaagttcactcgggcccgaaaggtcagaggcaacacaaagctccgcataggaaggtaaagtatctagaagagactcaaaagtatagacgttacgataaggagtttctatacatactgaagtagatacctctttggaggtcgctgccttttttatcgactttacacgttccttaggactttgcgggaggtatcccaaaaacgtaaagctctgggaaggcaagcctgaaagcatgagcgctaacgttatcgaacagggacctgaaaaagcctgcacaggaatccccaaagcacgtgcacgacgcactaaactcgctccaggatctgcaatacagggaagacccgcatcagagatcagtccccaattctccccgtgttttacgataggctctagataaaaatcccaagccttagggaggcgcgcatgtttactaagaatagcaagaggaaatttatgaacttcgggaattttccataaacttagaaatgccctacccccacgatcactttctacaatcagcccatctagtctatgaactaattctcctataacggaggggagagtctctacagcacgggtaccgagagtattgggaagaagatataaagtcacaggttaaccattctaatcactaaagtttccacagctactataggatcttggacattatttttaattaaggtttctgcataaaataaagaatttaaggcttggtgtagtctctcctttccataaaggacgaacattcggtgtttattttctttcgatccctcttcaatactacgtaaaccatagagacattgggtacgaaggaaagtaataatccccaagggatcttcaccatcctcgagtagaaaatgcaactgctggtgaccttctaccggatccctcttcaatagagagtctcgaaatttccatagggaagccttttcttttttgacaacgagctctttaatatcagagtgatccaaggacgttttcttgccaacagagcacagtagcttatcgaattcactgagaatatcaggaagagaggttgaagcaagtgcacgcaaaaacaaagatgccaatgattgagagcaagaaatccccacacgctcagctctttgcaacaggaggcgtatgatccttttctgacgatctgcgggccactcaccaaataaactcaaagaaagagccgatggcaaggcttttgacagttctcgaaagcattcttgttttgtggtgaagatcaaaatcgtaaggtgaggttgaggattccgagcatagcggcttagaaattccttagttgctagagggaatttctctgcatgaataatccccaaagtttcatgctcttgaaagagtgcaaacgtctcggtccaagacatgagggttgctggcatgagtccctgaccaccgagctctttgaagctctcagagactaataattcaatcagcgcatctttatcgtcttccaaagcactccctataagagctatagcgggcactttctctgcatacgcctgggaaaagtcatcaaaactcgttaaggatttttgcataggtagagtcaaaaaagtagtatcctgaacctactatacgtattttcctaccaactgtacagcatgaagcctgaagatctcgctctataaagctttttaaccttaaaaagaaaaacgggaaggaaacccaatgtttccctttcccgttaacatgagcaataatgcgaaaatcacaaattatcgagacatcattttgatcagttggtgacgccagccatnagctgtacgaacacggcttttagagccatgctttctcgtagctgttgaagaacagacacgtttacaactagatgtatgcttatggttttngtggcatgctaaagcacaggctgcagctttcttaggagaacctttagccactgtagtttttctagctacaggcttcttagcaacagtcttgcgaaccgctctcttagctgtagtcttctttgctactgtcttttttactacacgtttagcagcaactttcttaactgcaggcttcttagcaacagtcttacgaactgttctcttagctgtagtcttctttgctactgtctttttagcagccgtcttacgaactgcaggtttttttacagcggttttgcgaacagtagcttttttaaccgtacgtttagccgcaacttttttagcaggcttccgtacagctcttgaagctgtctttttaccgctttgctttttttgcgctccaatcatctttattcccctaattagacaggtaattacttacctgatctatcggcagggacgattgaaaactttaataaaaaaaatgacttttattttaaaaaaactaaaataaaagtcattactaaaacataaataaatagaaagcaactacttagaaagactattttctaagtaataaagaatagaacgaacaccaaaacctgaagcatattttggataacggtcttcttctttttcatgatatgcagtacctgcaatatcaagatgtgcccaagctaccgaagattcttccaaaaatctctgcaagaataatgctgctgtaatagcccctgcacggttactgcctagatttttcatatcagcaatatcagaatgcaatgttttatcatacttcttaactagaggaagtctccataacggctcggaggtttcggctgacgcctctaaaagatcttcagctaaaacatcgttattggaaaagaaacctgcaacctcttctcctagagagactaccatagctcctgttagagttgcaaaatctataatacgtgtcggtttacaatattttaaagcatatgtaatcgcatcagcgaggataagacgtccctcagcatcggtactacaaatctcaacagaaagccccgacattcctacatagacatctcccattttataggaggcgccatcgatagcattctctgtaagcaggaatgatccccgtgacatttataggaagctctaaaantgctaacgccgagagaatcccgaggactgtagccccacctgccatgtcttctttcatagtaagcatggattttccaggcttgaggtctaaacctccagagtcaaaagtgacccctttccctatcaagacggtgtgatctttagacttaggacgtccttgataacggacaacgataaagtgtggatccacacaagaacccttggaaacagccaataggagtcccattttctctttggcgatggcatcttttcccaagaccttagtatcaatactagggaactcttttcccagattcagagcaacctctgccaatttcttaggggtaatttcatcagcattcctgttcacaagatctcgagtgagatatacgccttcgaaaatggcggcttctttcctaaagatagcatccgccattttgggaacgataccgataaccgtgactttagaaagaggagtttcaagattacgatctaccttattataacgtgggtagtcatagtttaatgacaaaattcctgaggacaaccccactaagaattcttcggcagaaagccgcaattcagaaattgtaggtaagatgatattgactgtggaacactttgctttacgtaagacacgagttagtgtcgcataggtttggaaaacaacatcagaggtgagctcttcatttttccctaagcctaagaggacaatgcgtttttccttagctttaggactactataaaggagttcaatctccccggtttttccttgaaagttttctaaagcggggagatacgagggttcaaactcggcttcaaaagaagctgcattttttgcatccttaaaatgccaaaagggcaggactatagcatctgccttaacacgattacgcccagaggcttgagcatgaaataaaaccacaaactctcctttaatgactaggaattaaaaaggaacatcttcacagacatactgctgttcttgaccataaccagcatacatatctttatctttaatagcttctgcgtccagtgcttcaccttcaaaccctacggatacagattcatatcccacttgctgatgattgtcttctaaagatggagaacggctgccttcattgcgaccgaaaggactgaatttcaaagaatctacactaatcactaaagaagaattgcggtgaaaccatctttgctcatgtaactctctacagagatatcgccagcaacaatgactcctgagcctttcttcaagtaaggaagcatcttatcatagcgattgtgccaaatattgcatttgcaccaaacagtttcatctttcattccaactcgagtcttcactcccagtctcagagtgatcacacgttttcctttggaagtcattcgctcttcaggatctgccccaaggtaaccagcaaaatgcccaaacatcataagatagcctttagatttctattttaatacttctttaattaatacatcttaagaacttctcaaaacagattcaggacaaaaacgagaagtcaataaagtcatttcttctctaagaagagctttatcaatcttttaaattagaaaaaagatgtagtacttatatgcttaattaagcacgaatacctgtaggaggaggttgcattccaccaccgccttgaggcatttgtggcattgtatctacagaaggttctctaccagcacaaatatcagcacacacggtacgccacttaacaacagtttcaataaacaattgagcaaatgcttttagtaaattcgtttcagcatatttcatatccaaaacgcagtgcatgagaatgagctgttccttagtagcaacacctactccacctccagccatctgaccgccaagcatagatccttctaataatttctcatataaggccaatttcctctgagtattatcagggagtccatctaacagaggagcgtagacataaagacgatcagaatgttcttcataagtaaggtgaagagagaactcaccatcaacaaataaaatgcacgtgttattctgatcaaaagctacatccggcagttttaattctttagcaaaattttttagattttcctcagcattttgcctgggacatgagggaatctccttgtaatagattgttgttgtttcaagttaccataagagtgatttgttagtaaacgatttcagaggcttaaaatcaaaaactcccttgtatttctggcgccgttatgatatctgatcgacgatggaaaaagtttcttcttatccctcagttcctttacctcttggggcttctaaaatttccccaaaccgctatcgatttgctttatatgcttcacaagctaccgaagtcatccttgctttaacagacgaaaattcagaagtcatagaagtccctctttaccccgatacacaccgcacgggtgcgatttggcatatagagatcgagggtatttctgatcaatcgtcttatgcatttcgtgttcatgggcctaaaaagcatggaatgcaatactcttttaaagaatatcttgcagatccctatgcgaagaatattcattccccacagagttttggttcgcgaaagaaacagggggattatgcattttgttatttaaaggaagaaccatttccttgggatggtgatcagcctctgcatttgccgaaagaagagatgatcatctatgagatgcatgtacgttccttcacgcaatcttcttcatctagggttcatgctccgggaaccttcctaggaatcattgaaaagatcgaccatctgcataagctgggaatcaacgctgttgaactcttacctatctttgagttcgatgagactgcgcatccttttagaaattcgaaattcccttatctgtgcaattattggggttatgctcccctaaatttcttttctccttgccgacgttatgcttatgcctctgatccttgcgctccaagtagagagtttaaaactttagtaaagaccttgcatcaagaaggtattgaggtcattcttgatgttgtttttaatcatacgggcttgcaagggacgacctgctctttgccttggatagacactccgagctattatattttagatgcacaaggtcactttacaaattattcaggctgtggaaacactctcaatacaaaccgcgcccccacgacccaatggattctcgacatcttacgttattgggtagaagaaatgcatgtcgatgggttccgatttgatcttgcttctgtcttttctcgtggtccttcgggatctcccctacaattcgctcctgttttagaggcgatttcttttgatcctttacttgcgagcacaaagattatagctgagccttgggatgctggcggtttgtatcaggtgggctatttccccacactgtctccaagatggagtgaatggaacggtccgtatcgtgataacgtgaaagcatttcttaatggggatcaaaatctcataggaacctttgcttctagaatttcaggatctcaagacatctatcctcacggctcgcctacaaattcgattaactatgtcagttgccatgatggttttacgttatgtgacactgtgacttataaccacaaacataatgaggctaacggagaggataatcgtgacggcacagatgcgaactacagctacaatttcggaacggaagggaaaacagaagaccctggcattcttgaagttcgtgaaagacagttacgaaattttttccttactttgatggtctcgcaaggcattccgatgattcaatcaggagatgagtatgcccataccgcggaaggcaataacaaccgttgggctttggattcgaatgcgaattacttcctttgggatcagcttaccgcaaagcctacactgatgcactttctctgtgatctcattgcgtttcgaaaaaaatataaaacactttttaatcgaggctttctttccaataaggaaatcagttgggtagatgctatgggaaatcccatgacatggcgccctggaaatttcttagcatttaaaataaaatcgccaaaagcgcatgtatatgttgcttttcacgtgggagctcaagaccaacttgcgaccttacctaaagcctccagcaactttcttccttatcaaatagttgccgagagtcagcaagggtttgtccctcaaaatgtagcaacgccgacagtgtcgctacagccccataccacgctaattgcgatcagccatgcgaaagaggttacctgatctctccgtccagttcttcattccaggattctataactacaaaatccacatccttgtagaacttctcaagaatctgacgtgcattgaatccttctatagcaagacgatctacgttggactgcaagagcccttgtgcatctataattaatccttgagggctatccacaactaaacgagctgtccagtctatagcctcttctacaccatagaactgcttggtcacaccaaatcctgcatacccttcttcttcagctttaacatgccaaaagttttgaggatttcttgcaaggagcttttcgtatagagcggttctttctagaatgatgcaagcagatagagcttctttatctagctcttcaaggtactttatagaaagtacagatttcagataatcttcgattgtaacttcgttagaaaccatgatgcaatggttgtctttacgatgaacgtatagggaaccttgatactgaatcccgttaaaaaaaagagaagcagtgtcatctacaggctcgatctttaaacactggagtccgggataaaattctccccaacggatcccttcgtatagagcgtggaccacgcaacgctggccttgaatcgctgtgtctaataagacattatctccataaatgcgataaggacctttggcttctatgagagctgtggtgctttcattagataaaaggacacgaattttaggttcaacgacagtatcctgcttcacaaaagtatcggatacctttacttctgagaatcctgagatactcatactgaagaaaagacctaaaagtacgtttttcaatagtttcactgtccttctcctaaactcaataagttctttgcatgtctttttaaatggtcgtaagcaagttgtgttaccattctgcctctgggagtctttttgataaaaccttttaaaattaaaaacggttcataaacatcttcaagagttttgatatcttctcccacagctaccgataaggttttaattccaacgggaccaccttggtagtagtcgatgattgtagtgagaagtttgatatcaatttcattcaatccccaatcatctattaatagcatagccaaagctttttctgctacgtccccattgatacagtttccttctcggatctgagcaaaatctctgacccaacgtagaagatgatttgccagtcgtggcgtccctcgggatctcttagcaatttctagtaatgcggagctgtcagcttcgattccgagtaaatgtgaggagcggactaaaatctcttttagatcttgatccgagtaataggaaagtctcgcactaaaagcaaagcgtgttcttaaaggttcgcttagcattcctgatcgagtcgttgctcccactaaagtgaaaggagcaagatcgacacggaccgagcgagctccgggtcctgaatctatagtaatatcgactttgaaatcttccattgcagaatacaggtattcctcagcaactttccccatacgatggatctcatcgatgaaaaacacgtccccttcttgcaaactagttaaaagtcctaacaggtccgagggtttgattaactgaggccctgatgccaagaccagccctttccccacggtgtaggcaacgatgtgagcaagtgaggttttccctaagcctgggggtccaaaaaacaagcaatgtcctggaacttctcctcgttgcaatgctgcgcaaagaaatagatctaggcgttcttttaaatgatgctgtccataaaattcttctaaccctttaggtcttaacgaaacatcaaattttttatcctgatgcaagacagctacttgatgcgtcatgtacgaaccttctctatcgctttttctttaggtggattttatatttttttgaaactctcatcgataacgccgatcggttatactcggcatagtacacgagatactatatagaagtacactatggacctcttctttctatcaaggagagcagggccaaagtacgagcactagaacctctccatcattttcattttatgatttaaacttcctgtggtgatctagatttcttttgtcttaaaacagataaattaaagatggcgaactatttttaaaaacattttccactgagaagttggtagtaaaaattctctagcttatcaataaggagatgttaatctttttatgaatccaagaagttcttatcaaggtcctcgcatgaatgcattcaagagaaccaagattcttctactataagagtaaagagcagacctacctgaagttctccctaaaaataaggtttgcctttttcccttaggattatctaacattacctctaggtttcgtgataaaattgtagcctttgggataggcttttcttgtttatacaactggtcttttcaagagataatcaaagtctatcttatacttagaaaagttccccccaaaaaccagtaaattgaaaaacagaatatcattaagaaagcaatttcaaactgttaaggtttctaaatgagcataaaagaagataagtggatacgagagatggccctaaatgccgatatgatccatccctttgttaatggccaagtgaacgtaaatgaggagacaggcgaaaaacttataagttacggcctatcgagttatggttacgacctccgcctatctcgagaattcaaagtgttcaccaatgtctataactctgttgttgatccaaaatgctttactgaggatatcttcatctctattactgatgacgtctgtattgttcctccaaattcttttgctctagctcgtagcgttgagtatttccgaattcctagaaatgtcttaacaatgtgtataggaaagtctacatatgcacgctgtggaattatcgtaaatgtcacaccttttgagcctgaatgggaagggcatgtgactatagaaatttctaacactacgccattgccagcgaaaatttacgctaatgaagggattgcccaggtcttattctttgagtctagtacgacctgcgaggtttcttatgcagacagaaaaggaaagtatcaaaagcaacaaggcatcaccgtaccttgtgtctaaagtttcagtaagaaaaaaaaactggggttttagattactagaagaagtgatgatcaaatcctggtgggtgatctttagcatcttaattggaggctttgtttatgatcgtgctatccaggagttacgtacagaagagctacgcttacaaagcaaggtctcttctttatgccaagacattctttctgctcaagaaaagcagcgtcaactccaattacatctgcaacactggcaagactccgctgctatagaagctgctttaatccagcgtctgggtctcattcctaaaggctataagaaactctgtgtctccccaaagcaacaatcagaaaataaggactgaaaagagaccatgattcctaccatgttaatgttcttcattatctgttttactttatgctcgggattcatttcgttatctcaaattgctttgttttctttgcctacgagtttgatctcgcactataagcgctctaaatctaagaaacagcagcgagtagctacccttcttctacatccccaccacctgctcatcaccttaattttttgtgatatcggactgaatattgctattcaaaactgttttgccattctatttggagatgcagcttcgtggtggtttactgtaggtcttcctttagcaattactttgatcttaggtgagattctccctaaagcagtagctcttccttttaatacacagattgctagttccgtagcccctcttattctttgtgttactaaaatcttcaaacccctactccactggggtatcgtaggaattaattatgtggtccaatggattttatcgaagcaacagattgatatcatccaaccccaagagctgaaggaagtattgcaaagttgtaaggatttcggcgtagtcaatcaagaagaaagccgtttactctatggttatctttctcttagtgattgtagtgttaaagagcgtatgcagccacgccaggatattttattttatgatatccaaacccctttagagaacctctatcttttattttctaaacagcattgctcacgagttcctatatgtaacgataacctccaaaaccttctgggcatttgcacagcgcgctctcttcttttacatgacaagccactgcaatcttcggatgatctcctccccttgctgaaaaaaccgtattatatgccagaaaccatctctgcaaaaatggctttatgtcagatggcagctgaagacgaaaccctagggatgatcattgatgaatacggatctattgaaggattgatcactcaagaagacctctttgaaattgttgctggagaaattgtagaccagagagataataaaatactctataccacctcaggagctgatgttattattgcctcaggaactttagaactccgtgagtttagtgagatcttcgatatcaacctaccgacgaacaataatattgcgactataggaggctggttaatagagcaaatcggaacgattccgacaacaggaatgaaactctcttggaataacttgcttttccaggtattagacgctgctccgaatcgcattcgccgtgtgtatataaggaaattgtatgactaattctgctctcttttggataggagtcaacattatctgtattgtcttacaaggattctattcgatgatggaaatggcctgcgtgtcatttaaccgtgtacgattgcaatactatctgactaaagatcataagaaagctcgctacattaatttcctgattcgccgcccctatcgtttatttggaacggtgatgttaggagtgaatatcgctctacaagtcgggtctgagtcctcaagaaattgctatcgagctttaggaatcactccagattacgctcctttcactcaaatttttatagttgtgatttttgcagaacttctacctctaacaatatcacggaagattcctgaaaaattagcactttggggagcaccgattctctattattcccactatattttctatcctctgattcagctcataggaagtctcactgagggtctttactatcttctaaatattaggaaagaaaaattgaactctacattaagtagagacgagttccaaaaagctttagagactcaccatgaagaacaagatttcaatacaattgctacaaatattttctctttaagtgcgacttgtgcagatcaggtatgccaacctttagaacaggttaccatgcttccttcttctgcaaatgttaaagatttttgccggactataaaaaatacagatatcaactttattcctgtctatcacaaggcccgaaaaaacgttattgggattgcccatcctaaagactttgtcaataaagctcttgatgaacccctaatcaataatctacactcgccttggtttatcactgcaaaatcaaaacttattcgtatcctcaaagagtttcgagacaaccgttcgagtgttgctgttgtcctcaatgcttctggtgaacctataggtattcttagtttaaatgcaattttcaaaatcttattcaacactacaaacattgctcatttaaaacccaagaccatctctgttattgaaagaacgtttcctggcaactctcgcataaaagatctgcaaaaagaactcgatattcaatttccgcaatatcctgtagaaaccctagcccaattggtattgcaactgctagacagtcctgcagaagtaggaacttctgtaattatcaacaacttgcttttagaagttaaagagatgtctttatctgggataaaaaccgtatcgattaaaaacttactctcatagattctgcaataagagtcaggagtgttctttcagcttagaaacatgttctcttttaagacttaggaatttttcaaacgttctacgactttttctataattccaacggctctttcaacatcttcttgcaagagaagatggctaaaagaaaacctgagtgttgccagggtcaactcttcatcaacacccatgctgacaagagatttaaagggtgcggtagcacctgaagagcatgcggatccataaccacaagccactccttctatatctaaggcgatttgcaatacctcaccttccaacggagggaaagcaattgctgagacgttgtttgcccgtggttgatccgcacaatgaatatggacatcaggaatgcgtgctttgattgccttttcaaaaccatttctatgggtaagaatttcctgagagatacgctcttgatgaagatctaggtatttgaaaatataaagcagagaggcgattccccaaagattttctgtgcctgcgcgcagccctccttgctgacctcctccccacagctgaggatgtagtttgactcctggagagaccagaagagctccgattccagagagtgcatgaaatttatgtccactgaatgctgccatagtgacaccagagggaagaactatcctctccttacctacatttgcagtcgcatccacaataaattgcaattgtcgttcttgcgcgaagtgggctatagcagctatatcagctttggcaccagtctcactattgacccaacctaagatgattgctgaagttttaggagtcacagctctttcaatctgctctatagtaagaacacatctcccttcttcgggatttaaataagaaacggaaagcgaggaatgttttaaaggctctaagatggcggggtgttcgctacctgaggtgataacatgactgtctttagggaggcttgctattgctaaatttaaactctcagtagcccctgaggtatagaggacacggccctgaaacgaaaggaccttttgcatccagtgtgaagcttctagaaccagttgacgagattttttacctaattgatggacgctcgaaggattcgcgtacgtcccttctataaggaaggttttttggagaaattccaaaagtcccctctctgggggtgtcatcgcattgttatccaaatagatcatggaatactatccttagcaaaggaactattgtattcggactaatacgacagtagcgttgtcatcgcctccacgagtattggctagagaaattaatgcattcccccgttcttctagggtggcgggctggttcaagatatcacgaatatcgatatctggaaccatgtttgtcaatccatccgaacagaggcagtacaaatcttccttttcacaaggaagattccgaatgtcaggcatgacatagggacgacttcccaaaacattagtcagaatatggcgataagaatacaccttatctgattgtttaggaagcccataacgattttttaattgattttctaaagaatggtcttcggtaaggcggcgcagttctccctcacgaatacgataaattcgactatctcccacatgaaatagccatgccctatccttccggaattggatgaagctaagagtggttcccataccctggagatgctcttccatttggccgtgttcatagaccacaccattgacctctaaaaggatcttttttaaagtctccttatactggtcatcctcataccccatcaattttgactgttgctcatcaatcagctccataaggctagtcactgcctcttgagaagcaatgtctccaccaagacgccccccaacaccgtcagcaatagcaaccacttgagacatgaggtttacctgccaaaaatcttcatttctagcgcgcaccctaccaatatcactcagaccaaaataatcaaaatccacaaagtgctcctaaagagatcctggatcacaaatagagtccgcccctatagacattctctaatttcatatcattattataaagaattgaattttcctgacgaaatcataatttatcgctaaattaatggtcgcatgatcgttaattacaaagaaaaatttgataaataatcgccctagagctaggctggaaaggtcaattaacctaaggatgaataatgaaaaaagcattctctttactattatcttgtttagtattgttagctcttagtggttgcgtccctcctcaataagggttcaactacgcaccatgagttttaatcacaaactcatggtgttccttagaagttcactaagaaccttttcatcatagtttttatgatgataaagtaaaaattgctataaatcgaagaactgcctatgcaaatagaaaatagtagtattctttttgcagaggtagtcatgaagtggtttattttttctgtgatctcagctccagttgtattcctcccagggtgcacattgattcctaaagaaaaagttaccaaagttccctcacaactttggtcagaatccctttctcaaccttgagtttctaaactaaaactgagacggtctctttgcttgtttttatttttttctttgatataagctaatgagagttttaaatggaaaatctctcaattgcgaaagtattgatcttaaaagtaaaaactttcccagggctagaatcttttgcaaaataagcaatttaaggacagtgactatgcgaaaaatgttggtattattggcatctttaggacttctatccccaaccctatccagctgcactcacttaggctcttcaggaagttatcatcctaagctatacacttcagggagcaaaactaaaggtgtgattgcgatgcttcctgtatttcatcgcccaggaaagagtcttgaacctttaccttggaacctccaaggagaatttactgaagagatcagcaaaaggttttatgcttcggaaaaggtcttcctgatcaagcacaatgcttcacctcagacagtctctcagttctatgctccgattgcgaatcgtctacccgaaacaattattgagcaatttcttcctgcagaattcattgttgctacagaactgttagaacaaaagacagggaaagaagcaggtgtcgattctgtaacagcgtctgtacgtgttcgcgtttttgatatccgtcatcataaaatagctctcatttatcaagagattatcgaatgcagccagcctttaactaccctagtcaatgattatcatcgctatggctggaactcaaaacattttgattcaacgcccatgggcttaatgcatagccgtcttttccgcgaagttgttgccagagttgagggctatgtttgtgctaactactcgtagtctaaggaaatgtccaagtttattcttctcttgtcccttggcgtcgctgctctagcttccaaaaacttctttatctggccagcaccctctgggaaaacacctttaaantccgccaagttttatttggtggtgctcttcttgttttttcttcccttgtagctcttagcgtgagctcacaaactgcggaattactttccaccatgacaggaattagccttgcctttgcatttctgttctacctgcnttttctccccaaggatatcacacgtgctatacttttctctggagaaagancggttaaaacttcatggcgtgctctaggatctgccatcagaatgtggatcatcatcatcccagtaacacaactgattgggattatgatgagtaaatttataactttggttcttcctacgcaagagattcacacacaagaagtcactcaagaagttcagaactctctgcctataacaggacactacattagcatgattctaaatttaggcgtcctcactccatttggagaagaggtattttttagaggaattctacagacattcttgaaaaacaaaatgacgcgcatagctgcggtactatgctcttctattattttctctttcattcacattgaacactctttaggaagttgggtcttttgtccccgtgctctttgtttttcccttatctgcagggtttctatatgaaaaagatcggcacattctttctcccattgcactgcacgggttgtttaacctcacctcattgctatttttgggaataaagtaaaaagagtaagttggagaacattcttttagcaaaagaaaactctccttagggctgctaccttccagtcctgacccgattcgcaggttccttctcttaaaaggcccccaacttacccttctttgatagcatatattctgttttttcaaaagcaccatatgcttaaaaatagaccaaaacttcaactatgtagattcatttttctctcggtgcttagcaagctcccaaaggcgatcggcctcttcaatcgagaccggcttgtaatcttcagcgaatatataaggagcacggcgacgcaatttttccatagcctcattggcaacgtcttcggaagcaagtacgccctctcgttctaacagaaaacataaaattagaactaaagttaagacatccccggcttcggaaccaacctcttgtaccgtcttaccttgtaagacggcctcgtgaaattcctgacactctccaagaatatgctctaccatagagactagggattgctgaagtgaccaaggacaacgtccttcaactaccatggcacggacagtccctatcaatttagaaaaagcgtgatctcgcatctatactcctattgattctctagacctgacatccccgaggtagattagcaaagcatctttaatctttttgtgtcctgaagaaaaagctaagtgatctatatcactcaaaagatgcaattccccgaactgaggcagagaagtggctttaaaaattataggacacaaatgaaccttatgattagtaaacgcatgccgctgttctttaaggttacctaagaattccaaagggctttctaaagaaagctccatcttcttagtaaatccttctatatcttgaagaccttcctctggttcaacttcaatataaggaaattcatataagcctgccatcatttctttaggacgtctcttctcgacaaccaaagagccatcgtacaatacaatcgctaccaaacgatgcaaaaagatgaccttttttctggcatgacgtaccggcaatacgaactgtttgttctccctccaagctccacatgcttgacggacaggacaacgatgacattgaggaacttttttacagatacaagctcccaactctatcagagcctcagctataacctcgggactcttatgaggaagaagcgcttgagcaatcctagaaacccaagtacgagttgattctaagtctatagaagtttctatcaaaaatatccggctaagaacacgcaagacattgccatccacagcagcagcacgcctcttaaaagcaaaggctagaatagcatgaaccgtataaggaccaactccacgaatttgagctaaggaaatggcatcatcagggatctttccatgaaactcctccataaccatgcgagctccctctaaaagatggcgcgctcgagaataataacccaatccctcccataacttaatgacatcttcttcttttgctgcagctaaagactctatggtaggaaatctctccatccactgattaaaataatctataacaacttcagctcgcgtttgctgtagcataacttcggaaacccacacactatagggagtcgggttatctctccaaggaagagatcgtttatttttttcaaaccatttttttaatgcctctacaggaaaattctttgccttttcagaaaaagctatctttgtcatacaaaatctcttaaaattttatgcaattatcaaatgataaaagggctgctttacaatattttatggaaaatttttcctggcttgccacacaagtctcaagattatcttcttttcttagatctcaactgcctaatcatagcaagcaagaaatcttggcgtctattcgccaacatcgatgtcgagtgaacgggttcatagaaagatttgaatcctacaaggtacaacctggcgaccgtgtttccctatctctgatcccctcaacaaaacaacaacctagcatcctctgggaggatgactatagcattatctacgaaaaacctccccatcttactactgaacaaatggcacacatgacacggttttttactgtgcataggttagacaaaggcacctctgggtgtcttctcatgggaaagtctaaacaagcggctactgagctcatgaaattgttcaagcaaagaaaaatccataaacaatacatagctttcgtttttggtcatcctaaaaaaaaatttggaaccgtaaaatcttatacggcccccgtataccggaggtgtggagctgtgatttttggagccgcaggcccatcacagggagaacccatcaaatccgcttacaaatgggattgctgggtcatcctattgtcggagatgtcgactacggacctaaagaacagcctccccagatcttccgccctctcctccatgctcactccctagaatttatctccccattcacaaatcttcccctaaaaatttgtgcgtcatcaaccgaagatcctagagaatgtgctcggcacttacttcaagaaaaacccctagaactttacaattagagattcataaaactgtaattggagtcgtttacactgcttcaaaacataacctcctcttcttcatcttctaaatcccgcctttctacccttccggggtgcgacctaggagaaatcacacttaaaggtaaaactacaggaaaacgccctctagaagacacaggggaacgctctctagcacctaataaagaaggttgagacgtaaccacaggatctggttgaggttgcggatgtgccgtgactccagaaggtgtgggtacaggggggcgttgtaaatttagtcccgccgtatgcatcaatgaagttgacatctgtagtaggcacttatctctttcttgaacattgttagcatcgcttaacaaacttgttttcgtaagagaattctcaaaacatcgtgcagctaattctaaatagcgtgacgaggaagattctccccctcgcttcctttccagatcgacacgcatgcccatcccccgagccaaaatagcattgacttctggattacctaaaatgttgccacgttggggatctcctgtggctgggacaaaataacattgatagtgagataaaaccaaagcaactaacgccatcagattttctttggtgatccaaatcggagtgcttcctccattggtagctacaaagaaaatagacattaatagattcatgcaggatgcagacaactggattcccatgttctcgcacccgttctttttaagggagaagaccttaagtgatgggaaagacatacatatcctctctaggttaaaagggctacaaacctgtgctccttgctctccccatgaagaaagaaccatcactttgctttcacactcgaattccgtttcctgaagagaagacttagcaatccctgaggcaattgctgtactccaaaaaggatcctgtaataaaccatccacacaactcgccgcatccgcccacagatccatgctttgagacttcaagatctcacaaaagtccatagaacaccggtcacatgcagccatgacctccgcgattggaggaaatccctcgagtcgatgtcctgataataagctcatggtatcaatgccaagctcacttaacgcaattaaaagaacagccttgccatatttctgttctaaagcctcgagttcttataaagggattgcgggttcttgggatccctctcctatcccgcaacaatttttccatacaccacagaaaaaacggccaaatcctccacaaccgcactgtccgtctggacagccacaggtaggacaaccgcagttgccttggcaggtctctccacaataattataacaaaattcgctagttttctttgctccaggacttgttactgctgcataaatgatctgtgccaacgatgcagctgtccctaaaggatttgctgctgcagatcctgttgccgataacaaattcaacagtaccgaagcggcctgtcctgcctgagttccaccacttcctccttgagacgtagtcatctggctcaccaagctaaggagttgctgtaattgctctgaactcacggacgatccgccacttcctgttgtcttgtctaagataagttgcaaaagctgttgctgcatacttgcactggaagaggaggctcccgaagttcctgctgaagttgatggttgtcccactgatggttgtcccacatttaataaattagtaagcaacgcttgcacttgatcaggtgaaagtcctaatgcagaggctccggatgcggtagtagttgtcgctgtagaggaggcagctcctccggtttgaagaaaaccttgaactgcagatgagactgcttgtggtgttgtggaagaaggcgctatcgtaacaacctgtggattctgtggtgaggggaatttccctaaaggattcgtcaaacaacctcctaagtaatcagtgaaacccaaactacgataagttcggatcgtaaattcttttgaaaatttttttagcagtacgcgggagtgagaagtttggatattctataaaatatgtaaagaaaaaaatttaaagaatttacgtttctatttacattggaggcaggatctcccctgttgaggcaccaaaaggttttcttaataatcgaaagatttgttactctccttccaataagcttcaaaagtataaggcggattcatgctaaagattgatctaacaggaaaggtagcatttgttgcgggcattggtgatgaccaaggatatggctggggtattgctaaacttcttgcagaagcaggagctacgattattgtaggaacatgggtaccgatttacaaaattttctctcagtcttgggaattaggaaaattcaatgaatctagaaaattatcgaatggcactctcttagagattgctaagatctatcccatggacgcaagttttgatagccctgaagatgttcctgaagatattgctgaaaataaacgttacaagggcattacgggattcacgatatcagaagtcgcagaacaggtaaaaaaagattttggtcatattgacattcttgtccactcgctggcaaatagtcctgaaatttctaagtctctattagaaacatcaagaaaaggttacttagcggctctcagtgcctctagttattcttttgttagccttctctctcactttggaagtatcatgaaccgtggtggatcgacaatatcgctcacctatttggcttctatgcgcgctgttcctggatacggagggggcatgagttcggcaaaagcagctttggaaagtgacaccaaaactcttgcttgggaagcgggacgccgttggggcatacgtgtcaataccatctctgcaggacctttagcaagccgagctggaaaagcaattggttttattgaaagaatggtagactattaccaagagtgggcgcctattcccgaggctatgaatgccgagcaggtgggtgccgttgcagctttcttagcatcacctctagcttcagcaattactggtgagaccttatacgtagatcacggagccaatgtgatgggaattggtcctgagatgttccctaaagactcataaggtcgtcataatagcggacaccagcttcccaagctgaaagaatgccattcttatctgctgggggagctagaaagtccgcatgaacgtgcatctcttcaggtgcggaactcatcacaattttaaaatctcctctctcaataagatcgagatcattagcatcatctcctgaagccatgacaaagggtttctttccatcataaagtatattgacaacacgatctaaggctttgcctttagagacgcttttatctgttaaaaacaagatggcatagcgaaagtcaaagggccagcgcattaacgtcatcgtcgcgactgaagtcagtgcttcttggcgttccagctccttttgaattctgatgacctcatctcgcagtccaaagacttttgctgcagcaaaactaggaaaagcatagtcgtcttttaaagagcgcgtttcaaataggatctctctttccttagcattaggaaagtacctaggatctacatattcgtgtaaatcttgagctataggagtcggtgaaaagcgatagtagtgatccccgtaaggagctcctgattccacggaaaaaagagccgttgccccctccatacaatcttgtaaaatacataataaatctgagggtaaacttttagaatagagaagatttgatgatgttgaagaccatacagaagcgccgttttggcatcctaataaatatggagcatcaaaatcagaaaacaagcgtgcagcatatttataataccttcccgtcaagaaaaacaacttccaaccagcttggtgcagcgcatagagccgctcatacacctttttatctaaatgatgagattgatgggtaattgtaccgtcaatatcagtcactagtaacttttccatagcatcaccatagttttattaagcgctgccaaggaatttctcaggcaacttgaaaaaattctttgcatccaccgacagactgctgtcgttttgtctatgaaagacaagagcttgggctctgtggaacgagcacaccctagaagggtataaaggagtctgtgaattacccaaatcatctaggggagctctctagacggtacttgcaggaatatacatgattacggtttaatctgtacttggaaatcattgtactataatttatatagcatcgactaaaactatacttcattattacttgtatgtagttggatacaaatcgggctaccactataattttatagagatgatcgcgggtcttacacatgttttttaatcttttttctttagtttttaagctttctgatgagcttgctcttgcagaaacgatccaagagcccatttctgtacatgaaatgttcccaggaagcatgaaattagaaatgtttaaaatgctaggatctttgattctacttttaacaatttttggctttggagtttgggcgtttaaaaagtttgtgagatcaagaagtcacggttttggaggctcgtctcaaatcaaaatcctagaacgacgttccctaacgccgaaaacttctatttacctcattcgagttgtgaataaaactcttgtgattgcagaaacaccagaaaaaattacgctactgacagagtttcctcccgacactgatatcaatcatctacttcaagaaaataataagcagtcttcttcctctgcaacctctgatttcctcagtaaagcaatacaaaagatacaaaaaaaacaacagacgaatcaagattagatctagtattatcagccagcaatgatgcaggctctaggaacaacttggagtatttcctaaatgacgacatggacattaaatcaaaataatctcacaaaatttcttaaaagttcggatgaagaacctttcttagaaagagaaagcggtcttacttacattaacattcaagctaatggcaatgaactccctttattttttgtaatccgcagtgagggagaaatactgcagttgatttgttaccttccctaccaattgcatgaatctcataaggcatcaacagctcgtttactccatctcttaaatagggacattgatattcccggctttggcatggatgaagaacagggattgatattttatcggcttgtgttgccctgcctaaacggagaaattcatgacacactattacggatatatatcgatacaataaagctagtctgtgatagtttttctcatgctattgggttgatctcttctgggaatatgaatttggatgaactaagacgtcaggctcttcaagagcaacaagaaaaacgtaatgagtagtcaaactatggatgttcttattttctatgatacggagaccacaggaacacaaatagaaagagatcgcattatagaaattgctgcctacaatagtgtcacagatgagtcctttcttacttatgtgaatccggaaattcccattcctgatgaggcatccaaaattcatggaatcactacggatgcggtactttctgctcccaaatttcctgaagcctacgagggatttaggaaattttgcggagaggacagcatcttagtggctcataataatgacggttttgatttccccctactcggtaaggaatgtcgcagacattccttagagcctctgacaaaccgtacaatagactctctaaaatgggcacaaaaatatcgccccgatctaccaaaacataatttacaatacctaagacaagtttacggttttgctgaaaatcaagcacaccgagctctagatgacgtagtgatattgcacaaggtatttacttctttaatcggtgatttaccgccccagcaagtcctcgacttgctgcaacagagctatcacccgaaagtcttcaaaatgccttttggcaaatacaaagggcagcctcttgtggatattcctaagtcttacttcgaatggctggaaaaccaaggagctttggataagcctgaaaataaagacatcaaagccgctatagctctattacatcaaccgacatgatactgactgctgccttttctccttgcccgaatgatattttcctttttcgttctttcttaaaagacccccaattcaggcctcttcttaaccaggtaacaattgcggatattgaaactttgaataccctagctctgcagcgacggctctccctaatgaaaatgtcagcagcgctcttccctctagtttctgattattataatcttatggacgtaggaaataccttaggatacaacagcggtcctatcgtcctctccttagatcctgaatgttctctagataccttggcaactcctggagagatgacaaccgctcatgctctctgtaaactttactatcccaaggcaaaactcattcccatgccttatgacaaaattctatccgcgatactgcaagggaaagtcgatggaggcgctctgattcatgaagagcgcttcagctacgatctccaattgacattgcgggcagactttggagagctatggcgccgtaagaccatctttccccttcctttaggatgtttagccattgcgaaatatgttcctatggctacagtggatgctctaacagcagcattaagaaagtctttaatttgctccctgaaagatcctataactgcgggagcaaaagcagtagaatactctaaaaataaaaacgtgaccgtgattcatagattcataggaacctatatcaacaaagaaacctttcaactatctaaaactgggaaaaaagctttacatatgctctggaaggccaatgaatgctgtcaatacacctaaaaaaatcctttgcattgttgcagactatagagaaatttctcctctaattgaacaacttgattttacacagatcaacgagcatctctatagttatcgttgtactgactaccatctagatctctatattgtccatgtttggggaagtacagccgttttaaatgctcttcaaagctattgccaagcatatacagattacgatctgtggatcaatccaggttttgtgggggcatgttctcccgagattcctttaggtcaatgttacactattgagaaaattgcaaacctcactacggatacacctcctgttctctctgaagatcccccttatatctttgacgctctaccggattctctacctaaaagctctctggttacctctccagtattgtaccattatgggtttcaataagacgtttaaacttctagatatggaaaggctatgctaatagcctcacaagcagcagaacatcacatcccctgttcttttctcaagatcacttctgattatactgttccaggagactgtcccttcagcagattggaggaggtatcacaaaagctaactcagacacttgtagagttgttggcctgagctcatggagagagcgatcccacctaagttgttattgccatgtccgtaggatttgcgactaatttgtgatcaggaacaaagaccctgttatattctttagtccctgagagctcccacatttttaaaaattcaggacacgtctgtaagagttcttcttttgtgccttcggcaattttttgaccattttctatgtagagcacgcgatctacatgttcaagagtggtcagcttatgggcaataatgatttgtgtgcactgtcctttaagctctccaatgatattcttaatgtaattttcactaatggcatctagagctgacgttgcctcatctaaaattaagatggaggcgtttttcaacagagcacgtgctattgccaaacgttgctgctgtcctcctgagagattcttcccagattcttcgagcacgctatggactcctttagggagctttaaaataaactcatcagcgtaggcacgttttagagcttctaaaacagcctcctcctccatatccttaccacaggtaaggttattccatacagtatcatagaataagaaaggattctgtaatacacaggcgatgtgattccttaaggaccctttgttatattccgtaataggaagagagtcgataagaatctttccttgggagacttcgtagagcctaggaagtaatttaacaagtgttgtttttccagatcctgtaggtcctacaatgcctagagcttcgcctttatgtaaggtaaagcttagatttttgaggatgtgcttatcttcctgatagccgaaggaaacattctcgaatgtgattgtattagaaagtccaaggaactcgatttctctttctttttgactatgaagatcggggtgattcaagacttcataaaatctctccgcagcagcacatcccctcatgatggaggtatnttcatccccgaacttcttaatagggtcgtagattaggtagagcaaaccacaaaatacgataagttcttcgggaggaatagcaaatttataaattccgataacgacgacaaaagcaaaaaataaagaagctatggtatgcaggaggggtcgtggaagcaaaccgtaagcagcacttttctcctctaaagcagaaatcttattgttatgctcacaatattttgtgaaggcaaatttttctgtacgaaagacttttactgtcataaccccagcaagaaaatcataaagaacggaggaaaatgaatcctgactcttttgaatacgttttgctaaatttttgatctttctagcgatcacgacaatgggaaggataaagataggaaaggcaacacaaataagaattgaaaacttccatgaaatcgacagacagactcccaatgtcaatatgaaggtaattggggcttgaatgtagttaatcattaaagagtttactgctaaggcaatgcttgcagaatctgtcatgacacgattacttaaattaccgatatcatgatcatggaagaaggtcatggggagttgttgtagggccttaaagtagtcctgacgtaagtctcggcttacccgtatagcaacgacttgcccaaggaaacgttggaaaaataaggtgactgctttaaaaatagcaacgcagattaagaagattgccagtcctcgaaagcggctcacatcgatgtagttacggacaaacttagagagcttgctcgtcagagaggctgtgcttttcccatgttcggcgatgtatgtcgtggcatcagagactgtaagtgtctctgaatccttactaattgcctgccaattctctaaaatatctttctgacttagttctgaaacctttacaagttttccagattccttacgtccaaaaagtaaaaaggcgtcggggcctgttttagcaatcatccctaaagaaaaaatctccatctgagatgaaaaggtaagtcctaaaattgcgagtagagaacagcctaatataacgagatgatttttatgcctcaggaccgctttcagaagtagtttcataaagacctatagagcgaaatttttcgtaccgtttctccaacagctcttctatagctagatcttttaatcgtaaccactcttggatgataaactctcgaacattgctatataccaatgcaggatcgtggtgagctcccccaatgggctctttgataacagtatcgataatgccaaattgttttaagttttctccatgcattttcaacatggaagctgcttcgctatttttcttaggatctttccaaagaatggaggcgcatccttctggggaaattacagaataataggaatgctctaacatagctacagaatcacctacagccatgcccaaagctccacctgaacatccctcaccgataacgacaataatcacgggagtggcaagtcttgagagctcaaaaagatttttggcaattgcccatccttgtcctctctcttcagcagtcaatccaggatatgctcctggggtatcgacaagaaagaccacaggcaagccaaacttttcagcgagttttcctaagcgaagggcttttctgaaaccctcgggacataacataccgaagttcctatgaaggcgtgacgctgtatcgcatcccttttcttggccaataaggacaaaacgctgaccctggatttttacaaagccaccaacaactgcgggatcatctcggaaggtgcgatctccacaaagctcgacaaactcctcacacatcccttcaatatagttgacagtacggggacgcgaagggtggcgacatatttgtacacgctcccaaggagtcaaatccgaatagatcttttcttttaatttatctaaacgcttttccaatttctgaatctctgaagaagataagagagaatttttcttatttttttctttaaattcggctatagccttttcatattcaactacttgtttttcgtgtggaagaagttccattagaatgtgctctcctcgtataaaaagaatcattttaatacaaacaattcttaaacacaattacagacccaaaattaattcatcttcgtaaagaatcttcctttctcagaggtcacttttttttcaaaaattaacatgacgccctcttctttgtaaggaatattaatcaaaaagtctgcattccaaaatttttctttgccttgcaaagcaaaaatttccatatagggacttgcagaaacaatgttgattgcgtcattttccccaagaatcataatgtcgtttccgggacctttataagaatctagggaacaggagcgcaagcgagggccgtcaacaacctgacaattcttccccttacagaaaatagaaaacgtcatggcagaggtggcctcagccaacgcagcgtgcacgcgatattgcttgtcggaaatagtgatcttacagcggatcggcagatgtacataggaatctcgaaggtaggaaaatcccgtatttctgggatgaggctttcctgtagaggtgagaaaagaaatctctgtagtttggtgaganttttggcacacgaactctttagcgattccacaacatccaaaataataacaatcactaatgtctccagagcaaggtccataagcgataacaccgacatcccctgaggaatacgctcccaagctactttgacatcctgaagcggctacaaaagcggatgaagaacgcgttctttgcatccagaaccctagtgcaggatcctcaagactgtattctgggtgaatttgcattcctaattggaagagaaacgattggctaagagttgtcttttcttttaggagtcgagagttctcctggctccagagagagggaaagacgctcccttggtgatcaaagagtgcctgttgaaaatgactcattttagagacgtatgcctgactctcttcataaaactctgcgatctgtaacaggagtaggccaaattccgcatgttctgcaggataaggtaatcctttccaaggaaatcccccacaagaaaacagttctacagcacctgaagggtactgctgtacatttaaaaagcttaagcctaaatcctcgccttcttctaaggccatcaaaagatagacggcccgagcaatatcatgaatttttagtaaaggatggtagcggaaaatcttgagtacagactgccttaatgtcttatcttggcacgcatagataaactgttttacttgtgaatcaaagttcgaattctgggacacttctatacaatgttgtaacctggattgcagccccattatcacgcacaatttgatcagaaaagcattgcaccaaacgataataataacaaaaattagagtcaagcccggtaaaaaaccggtctgactctaacaactgagacaaagaagactacaagaattaagaatgcttattcggagtttctatcaagcgcttcattcttttccctggagtaaactttacagcgcgtctagcaggaatatgaatggggactgctgcattcctaggattacgtcctacctttggttttctttctactacttgcaacacaccaaaatctctaaactcaagcctgtcacctttaaccaaggcgtcggtcattttatctagaaaattctgaatcacggtacgtacgtgattaggatgaattttgtgatcttgtgagatcgtgctgattagtttcttctttgtcatggtagccatattagacaatgcctcctattaaagtgccctaaagtagctcgttgagtaaccgtaaataataaacttttgaagtctaagctcatcatatctattcatcctttggattcaagacattttttaaaaaatgcgcaatcactataaaccatatcgattaatgcgaataactatatttctagaacctagaaaaatcattcccacatcttgagaaaaacttcccctaaattgctagcgtgcatctaacacgtgacttctttaatctaacttggtaaagtgctggtctttgcgtcctcgtagctcagcaggatagagcggttgcctcctaagcagcaggccatgcgttcgaatcgcatcgaggacgattttttgcctttgactcctaaagtactaatttgcttgtatctgtggtttacgtattttagcgatattctgttttggtttctgaaaactaggtccagaaagaaaattatgaactccctcggcgatgcctttcgctacatgcatacgatagcgagcatcttgcagggccgcacgttcacgactattggataaaaacccggtttccaccaaaactgcaggcatagaagtatctctaatcacaacaaagttcgcagttttcaaacctcgagacttcaaaatgccatttttttccatagcagctaaaatgttttttcccagtacttctgacatgcgattcctagtcggagatccgaccttaccattataaaaatatacttcggtgccaaaggctgctgcgtttgaagaatgattacagtggatgctgataaagacatccccctgcccacggttcgacaaagcaacgcgtttccctaagtcaacgtatacatcagaagatcgggttagctgaggtttataacccatccgctttaagtaactttgaaccgtcaaagcaagagacagggtcagggacttctcttcataatgaagttccttacttgccgtgccttgatcttttcccccgtgtccaggatctataaatataacctcactgcgtcgtacacgctgaggaggattcggtgtttgagcaaaaatcgggtgacttcctaacacacataaagcaaaaaacgacagttgcttagacataggaagcgagtacctcacaaacagtctgcttatcatcgaacgcaactgtttggtgtttaaatatttggtaagcttcatgcccttttcccgctattaacactatatctctatctgaggcaatagacagagcatatgtaattgcttgttttctgtcgatttcgatgaaatagttttttgaataaaacccatcacaaatttcattcacaatatcttcaggaggctcgctcctagggttatctgaagttacaacagcaaaaccataacgctctaccacctgggccatcaacttccgtttactgcgatctctatctccaccgcaaccaaaaacaacaatcagtcttcccccctcaggaagtaactcatgcaatcctgttaagacattgtctaaagcatcgggggtgtgtgcataatcaatatatacagggcagggacccataagtacaggatccaaacgacctggaggaggttgacacaagcctatcttttctagcaaatcttcaagatcgcaacgcaaacttgcatgtactgtagagatcgcagcaagtaggttatagacgttgtactttccaataaatgaggaagagcacgcaattttttggtccccgtacaccaaggtatactttgttcccgaggaagaaagttggatatcggtggctcggtagtcagcagcactctctataccataagtgatgaccggtgcctttgcactctcaatacactgagaagcgtagggagagtctgtgttgataacaaccattcccgaagggggcacgagagagaaaagcttggctttcgccgcaacataggtttcaaatgtgccatgaaaatcgagatgatctaaggtaatattagtcagaactgctgtatcaaaattggtataggctactcttccagaggcaagtcctatagaagagacttccataacaacagcgtctctattttgacgtaccatagtggctaaatacttctgtaaaagagcgggtgtaggtgtagtaaacccatctttaatcaccccctctcctaagatatgctctatggttcctaaaagccctgaaggtttttgatagctatccaataaagctttaatcaaacatgtaactgtagttttcccattggttccagtcaccccaatggtatggagcttacttgaagggtattcgtaatactttgcagaaagctcagcctctaattcttcgagattaggagtgatgatctgaacaacggaaagaaacggattgtatagtgaagaagcaatggcaattgctccattagctaaagcatcgacagcaaaatcatttccgtcgtagcgctgtcccttatgggctataaaaatgtcgccaacactcacacaacgggaatcacgtgtcaagttgcgcacttcaagagggcgaactttcccgtagattttagcttgaaccccatggagtaactcttttaaatccatttacgctccagggactattgaaaaacaacttttttcataaaaagccctctaggggcatgctctcactctgatttttaaaaaatgcttaaaggatttctttactcgtaggtcgacaaaaaattcaatcaagatagtatacaagcaatcacaaaaaactgtccataaagttcttactcttctctgaaatataaaatttcgctctcctgtttctacgaacagaagcctcctttatcccaaatctaaatccccaaacacacagccttacctcccccttccataaacttcaatagaccgtctcatcaagactttggtctcttatttaggggaagaaagctaaagttatttctatagtttaggacctaccctagccataacataaactactcatagaggataaagaggagaacgggctctctgatagagagtctttgctcaacggtaaaagtctatagcaagatggaaatagagatcctcacctcgttcccccttgtttcggagaacgattccattcttcatagagacgctttaatgcagcagcttcttcgtcgcaatttcttagcttcttgtctggaagaatccctaaatagaggagtgtgcggtcagcaaccctagaaaaaatgggtgccgcacaacgcccccccatataatttttcgtgccgtcggctcgcaaaccatattcaggatcatctatggagacgagcatcactaaaggtgggaaatttccctccgagctctctacgggagtaaaacctataaaagaagcaatatgacggcgtttatcatattttccatgaatcatcttttctgtagttcctgttttcccagcactagagtgatgcttaggagaggctcgaaatcccgaacctccgggtaacgttgtaaaacgcatggcacgaacaacttctctagtaatttcttctgaaaagagtcgtgtcttctctttagtaggaagatgatattcctctcctgaagcagagacgatcttttttactaaagtgggccggacggcataacctccgtttgcaaggatagcgtaggcttgaaccatttgtatccctgttgccaaaatattatatcccatagccaaagaatatggagtagataaggaccattccagggaaccattaatatggaaacgatggggagaaggcaccaaaccagaggcctcactgggaagctcgatccctgtttttcttccaaatcccagagctagcaacttctgttggtaccaggccactcctaaagattgtatgatgcggtcagccagctgagctacatagacattcgaagatttctggatagccatgtacatattcaattgagagtttctagaaatatccttaagcggagatccttttcgtccagggaagagtgtcctggtcacatcgataggttcttcaggatcaaaaatctttttctgcgattttaagctagcctcttcgttagcttgtaaagcaatcgccacagtcaaaggtttcatgatcgacccgggttcaaaaacatcgctcacaaaagataccttcgtatgttcgatgcgctctttgttattgaagtattccttataatttgtgggatcgaaaaacggatattgagccagtgcaagaatctctcctgtttgggagttcattagaatgagcctacccccctgggctttagcttctagcacgccccgttcgagttcttcctctgcaatggtctggatcacaggattgatcgtaaggtagatatcagagccatctttaggcagtttgataacacgattcgtatctaaacggttcaaaggagaacgcaacagctttctctctccaacgtccccttccagaatatgattaaagtacgcctccatcccgcctgtgggaaaggcttttcctgttttctcatccttaatttctcttaaggtatggagaacttgtccaaggagcttcccaaaaggatacgagcgttggtagtccgtaataaaaaatagggcgtttgttggtaagcgatgctttgttgcatatcctttccaccaaagggatagccggtcatggacagaaacatctaataaaggatacagcttacaataccgagatttcttatctaactttagggagaggtcgtcgtaggtctgcccctcaataaattggagaatcccttggatgatctcatcacgatgacattcgggaatagctaaaggatctgcacaaaggtgaaattttgtaatatcgacagcgaaaggctgctgaaggtctttgtctcccttacgtactgtcgtgttagcaaaaaaggtgccccttcgaaaaggatcacggacacaaaattcgtgttgcccgagagcttctgcggcccagtggtctccttcacaaatttgcnttttataataacgcaatactagaagagcataaagagcaaacactcctagaacaattagagtcgaacgtttacggtagctcataggataaaagactgatactttcttctgagggatattccaaatattgatattcgggaagagctgctatttccatcaaatgatcaggtctttctattttatcaattaaaaaacgtaaagaaatattttgctgctcaagctgacgcaagcgtacagataaacaaggaatttcgaggcgtaatttcgtcagcgagttctgcttattaatatagaaataaaagagacttccacaaaagcatagacagcagcataaacgtaaaaaacgacttttgttcattgggaagctttttcaaaacaccgtagttttgctgatctcgatctaggatttcttcgtacttcttggtaggtaggttggatcactttctttgtgattaccttccccaggccagaagcttccgcctctttaaaaaaccacttcacaggacgatcctcagagctacaaaaagaaataatgacaagccgtccctgaggagccagccaagatatagcagatgttagtaaacttttcaattgtctatcctctccattcacataaacacgtagagcttgaaaaatcaaggtgagtggatgtatttttctatgaaaacgatagtgagggaaaacgccaagaagagcttcttttacatcctggatcgaaagaatttttttatgcttacgaaaatggacaacagctttagctgcagatttccattgtggttcctctccatattcacgaaaaattctccctagttcttcttcttttagggagttcaggacatcgctagcggaaagctcttgcgtttgatccatacgcatatccaactcttctttttccccttgaaagctaaaccctcgggatagagtatccagctgcatagaagagactcctaaatctgcaagaactccgtcataaagacgtggagtgggttggttcgcaagatcttcaaaagaggcgtgggaaaaggagactctatcttgaaaggtctccaaacgtttttctgcaattgccaaagcctgaagatctcgatcggagccatcataacaagttagagagggatacgcctcaagaaaagcatacgcatgtcctccagctcctaaggtgacatctcgaaaagtctgtggaggacgttgagcaaataaagctaaacattcttcaactaatacgggaatatgcgcacgttcggacataagaatttcctaagctcttggcttcaaataaggacaaagatacaggattccatagaaagaagaaagccttcccttatcttaaattctcgctagttcgccactctaaattttttgataggggtgagcttttttcttaagtgccttcgataaggagaaaaggttcaggcttctgatcaagactattgactttttcctagaccgcactatcatctagagatagagacggttttttaaggcctcgccatggtagaaatttttaattatagcacgtctatatatgagcaacatgcttccaataataggatagtcagcgactttcgcaaagaaatccagatggaaggcatctccattcgtgatgttgccaagcatgcgcaaattttggatatgaaccccaagccttcggctttgacgtctcttttacagacaaatcaaaagtcgcactgggcatgtttttcccctccaaataatttttacaaacagcgtttttccacaccctacctggcaccttctttaggatctccagaccaacaagatgaagacatagaaaaaatctcctcatttttaaaagttctcactcgagggaagttttcctatcgcagtcaaattactccctttttgtcttacaaagataaagaagaagaggaagacgaagatcctgaagaagacgatgacgatcctagagtacaacaagggaaagtgctcttaaaagctctagatcttggagtcaagtctacaaatgtgatgatagactatgtgatctctcgtatctttcaatttgttcaaggataatgtatgttggataatgaatggaaagcaatcttaggctggggagatgatgagttagaagaactcagaatctcaggatattcttttctacgccaagggcattattcaaaagcgattcttttttttgaagctctagtgatcttagatcctttaagtatctatgatcatcaaactcttggaggtctttatctccaaattggtgaaaatagtcaggcgcttgctgttttagatcaggcactccgcatgcaaggagatcatctgcctacactcttaaataaaacaaaagctctcttctgtttgggacgaattgaagaagctactgccattgccacctacctttcatcctgtcccataccagcaattgctaatgatgctgaagctctattgatgagttatagtaaagcaaccaaaaaaaatgctgcgttagttcgttaattttttctcctatagaaaacgtatttcgtgattgaagaactccggatttctttagttctttttccatttttattacaaaatttcataattattttttcctgaatttgtggttccttattgcctaacgaaaccaacgatccaatttgccttaaaacctagtaatcggtagagttattttatcggcagagcgtaccgcgtttacctgcggaggaagggtgtataggatccattcctaacaggaacttcacccagggaatgcaggatccaatctgaacgcgaagagtcattgcactcagtgcaatgaatagtcaagatgcaatgagattttctcgccatcactcatgggatgggtcgattgtatttgggaaagctttataaataaagagagcggcatgttaacctgtaacgagtgcactacttgggaacagtttttaaattatgttaagacacgttgctcgaaaacggcttttgaaaattggatttctcctattcaagttcttgaagaaactcaagagaaaattcgcttagaagtccccaacatttttgtacaaaattatcttcttgataactacaaaagagacctctgttcttttgtccccttagatgttcatggagagcctgctttagaatttgtagttgcagaacacaagaaaccttcagcccccgtggcttctcaaaaagaatcaaacgaaggaatttctgaggtctttgaagaaactaaagattttgaattaaagctgaatctctcctatcgctttgataatttcattgaaggtccctcaaatcaatttgtgaagtctgcagctgtaggtattgctgggaaacctggccgctcctacaaccctttattcatccatgggggtgtgggattaggcaaaacgcatttacttcatgccgtaggtcactacgtaagagaacatcataaaaatctacgcatccattgcatcactacagaagcgtttatcaacgatcttgtctaccatctcaaatccaagtctgttgataaaatgaaaaatttttatcgttccctagatttacttcttgttgatgatattcaatttttacagaatcgccaaaattttgaagaagagttttgcaatacctttgagactttgatcaacctgagtaagcaaattgtaattaccagtgataaacctccaagtcagctcaaactttccgagcgtatcattgctagaatggaatggggactggttgctcacgtcggcatccctgatttagaaactcgggttgcgattttacagcacaaggcggagcaaaaaggattgctcattcctaatgaaatggcattttatattgcggatcacatctatggcaatgtccgtcaattggaaggagctatcaacaagctgactgcctattgtcgtcttttcggcaagtctcttacagaaactacagtccgagaaactctaaaagagctcttccgttctccaacaaaacaaaaaatttctgtagaaacgatcttaaaaagtgttgctacagtattccaagtaaagctgaatgatcttaagggaaactcacgctctaaagatcttgtgttagctcggcaaattgctatgtatttagcaaaaactcttattacagattctttagttgcaataggagctgcttttggtaaaactcattcgacagtactttatgcctgtaaaactatagaacataaattacaaaatgacgaaactcttaagcgtcaagtaaatctctgtaaaaatcatattgttggttaatttagggggtgtcccatgttccgtagaacaggaaaaggtccttttgaagatgtgcaaacactttacgaagaagaaacttcttcaccttccagctactcgccatattcaagatccgagcgcccagagacccctccaagtctttttgacaaccctaaagcttcggaagctcgccctttgaatcacaatttaactgaagaatcttctcttcctcaatggtcctcaactccaagaacagaatctctactccctcttgaagaacctgaaactaccttaggagaaggcgtcacctttaaaggagaacttgcttttgaacgtctcctacgtattgacggaacttttgaaggcattttagtctcaaaaggaaaaattattatcggtcctaaaggagtggtaaaggcagatattcagctacaagaagccattattgaaggggttgtagaaggaaatatcacagtatctggaaaagtcgaactccgtggaggcgcaatcattaaaggagacatccaagcgaacacgttgtgtgttgatgagggcgtacgtattcttggttaccttgcaattgcaggaattactgatcattctgagagagaaagagacttatagatactagaggtgatgcactccctccaacgatagtttgcatccatttttgtgataaaggataggccgacaaaaagcagataccttcccctttaggaagtttttctatttgtcttttcttaggaagccacggccacaagggaatgcgtaaaagcttttctagtttagcaacttctactacgattttcctagaaattgtcgatgttatataggcaatacaactcggggtctcatccagtgaagctagctcaaaggcgatactcttagaaaaaaactgcagagcgggtcgcttaccttcacaagcacgagcatataccgagagggccgtttgcgaaggaaggtacaagctgaaagcttgaagttgtgaagagggtgaacactggctacatagacgtgtttcggaagaaccaagataacgaaaacaatgtagacaacgcccttctctatcttctacgagaagtttttccaagcagttggaacaaaagtaggctcctggagcttgacagccataacataactttggaaacagcaacgaaaaaagtaccatctatttttgaatcatgaaaatttttattcctaaaattttaagcagtttgctacgtttttgaacgtgtagaagcttcaacttttctctcaatcacaatgctcaaaaaattcataaattctctttggaaactatgtcaacaagacaagtatcagcgctttactcccattgtcgatgcgatagatacattttgttacgaacctattgaaaccccttccaagcctcctttcatccgcgattctgtagatgttaagcgttggatgatgcttgttgttatcgctttgtttcccgcgacctttgttgcgatctggaattcaggacttcaatctatcgtttatagctcaggcaatcctgtgctgatggagcaattcttacatatttctggatttggtagttatttatcctttgtttacaaagagatccatatagttcctatcctttgggaaggacttaagatctttattcctctacttacgattagctatgttgtcgggggtacttgtgaggtcctatttgctgtagttcgtgggcataaaatcgcagaaggactgctagtaaccggaatcctctatccccttactctccctccgacaattccttactggatggcagccttagggatcgcctttggtattgttgtcagtaaagagctcttcggaggcacagggatgaacatcctcaatcctgctctatcaggaagggcattcttattttttacgtttccagcaaagatgagtggtgacgtttgggtaggaagcaaccccggagtgattaaagatagcctcatgaagatgaactcctcgacaggaaaagtactcattgatggattttcacagtctacctgcctacaaactctaaattcgacacctccctctgtaaagcgtctgcatgtcgatgcgattgctgcaaatatgcttcacattcctcacgtccctactcaagatgtcattcactcacaattttctctttggacagagacgcatcctggttgggttttagataatctcactcttacacaacttcaaacgtttgttacagctcctgttgctgagggaggattggggctgcttcccacacagttcgattctgcctatgctattaccgatgtgatctatgggattgggaagttctcagctgggaatctcttttggggaaacattataggttctctgggggagacctccactttcgcctgtctgttgggtgcaatattccttattgttacaggcattgcctcttggagaaccatggcagcctttgggataggagcctttctcacaggctggctctttaagtttatcagcgtactcatcgtgggacaaaacggagcttgggcacctgctcgattcttcattcccgcctatcggcagcttttcctcggaggacttgcttttggtttagtctttatggctacggatcccgtatcatcgccgactatgaaattagggaaatggatttacggattctttataggatttatgactattgtgattcgtcttatcaatcctgcgtatcctgagggagtgatgttagcgatccttctgggcaatgtatttgcccctcttatcgactattttgctgttagaaagtatagaaaaaggggagtctagaatatgtctaaaggctcttcaaaacataccgtccgcataaaccaaacctggtacatcgtttcctttatcctgggcctcagcttatttgcaggagtgctgttatccacaatctactatgtgctctccccaatacaggaacaagctgctactttcgatcgcaataagcaaatgcttttagctgctcatattttagattttaaaggaagatttcaaattcaggaaaaaaaagagtgggtgcctgcgactttcgataaaaaaacacaacttcttgaagttgctacaaaaaaagtctctgaggtttcctatcctgaattagagctgtatgccgagcgctttgtccgtcctctacttacagatgcccaaggcaaggtattttcttttgaagaaaaaaatctgaatcccattgaattttttgagaaatatcaagaaagccctccgtgtcagcaatcccccctccccttttatgtcattttagagaatacctctcgcacagaaaatatgtcaggagccgacgttgcgaaagacctttctacagttcaagctttgatcttccctatatcaggattcggcctttggggccccatccatggctatctaggagtgaaaaacgacggtgacactgtattgggaaccgcatggtaccaacaaggagaaactccaggtttaggagcaaatattacaaatcccgaatggcaagagcaattctatgggaagaaaatcttcctacaagattcttctggaactacaaattttgcaacaacagacctagggcttgaggtagttaaaggttccgtgcgtactactttgggagattctccaaaagctctttctgctattgatgggatttctggagccaccttaacatgcaacggtgtcactgaagcttatgtacaatctctggcttgctatcgtcagctccttataaatttttctaatttaacccatgaaaagaaaacaggcgaatgacaagtaaaaagtcctataaaagctatttctttgatcctctatggagcaacaaccaaattctcattgcgattttggggatttgctcggctctggcagtgacaacaacagtacaaacggcaattactatgggaattgctgtcagcattgttacaggatgctcgtctttctttgtttccttattacgtaagttcactcctgacagtgtgagaatgattactcagctaattatcattagcttgtttgtgattgttatcgaccagtttttaaaagcttttttctttgatatttccaaaacactttctgtttttgtgggtcttatcatcaccaattgcatnntgatgggaaggtctgaaagtctagctaggcatgtgactcctattccagcgttcttagatgggtttgcctctggcttaggatacggctgggtcttacttgtcattggagtcatcagagaactctttggttttggaactccttatggggtttcgcatcatccctcaatttgttatgcttccgaaacccaccccgatggataccaaaatttaagtcttatggtgctagcaccgtcggcttttttcctacttggtattatgatttggcttgttaacattcgagactctaaagagaaaaangtagtttatgtggttaggtgcgtatacttggcttaatgtctttggtattcttctacaagcagcctttattcagaatatccttcttgcgaatttcttggggatgtgtagttaccttgcttgctctactagggtttctacagccaatggcttggggatgtccgtagcccttgttctcactgtaacagggagcatcaactggtttgtccatgctttcatcacgggccctaaagctctaacttggatctctccatctttagcttctgtaaacctaggttttctggagctgattattttcatcgtggtgattgcggcattcacgcaaatcttagagcttcttttagaaaaggtctccaggaatctatatctctccttagggatcttccttcccttgattgctgtgaactgcgcgatcctagggggtgtgctcttcggaatcacacgtagttatccttttattcctatgatgatcttctctttaggagcgggatgtgggtggtggctcgctattgttattttagccactatcaaagaaaaactcgcctactctgatattcccaaaaacctccagggaatggggatctccttcattacaacaggcctcattgctatggcttttatgagcttaacaggtattgatatttctaaaccttcagcaaagattcaaagagctcctctagagactgaagttgttgaaaacacgaccaatccactaaaagaatcttcgtccaaacaccagccaagtatttctaaagcacgaacgcagcgtcgctctctctaggaactttcctagagtcgagtttctagtgaacttttgtacacagagatgcttctaaacaatttcaattcgagatatggaaggcggctttttgcaagctgtggcgattttacttgcgatacaataaacaacgatcgtcagtaaaacacaaatagcaagagctatacctatatagagagcgcagagtctcagttgagaaccttcacaagaaaacaaagtcacggcgaaagctacagctaacgaagtgaggagaatagcaagcactttcgcaaaaatccgataagataaagaattctccgaatggagaaggacactagaataccgttttaggaaggtcagagtatcgggattttgtcgagaacggggaacgtacttaggtaatgtagtcatgatttttcaatcaataaaatgtccaactcagctttcatgcgctaccttagttttttctaaggcattggaaatcttataacgccaacacgcacaaactaacatagataaggtaatgcaactcgcagcaatccagatcgagagctgtagaggtgccgatcccgttaaaaataggccacaggctaccaaagaaatcgctatcaatgaaaggaccatgatggctatagtaagcttcttcacacgagataccccggaagataatgcggacaattcttcagaagatagttgcacatgatcttgtaggacatgaggggctaccggactagctggatccatagaataattctgatgtattttttaaaccttagacataaattttaaatgttttagccttaaaaaaatacctcttatcttctgaaaaaaatgagtatatctaataaaaaatttactcttcatccatcaaagaaagattagaaggatcccagtcctggtctagtcggactacagccaaccatccctcaccttctggagcttcgttaatcttctgaggattatccactaaatcaaggctgatatcgataacctctcctgatacaggacttaacacctcttatagcagatttagaagattccagaatgactaaaacctcaccttctttacatagactccctactgaaggtaaatccacatggagaatggctcctaaatttttctgcattttttctgttaacccgaggcgcaccaccctctcatggacgggcaaaatccaaacatgataatcagaataccacatcaccttacgaccccctgttctataaagcgttccatataggatcctaaaagttcttcatctagctgacttttagctaaaaatagtttatccacgctagcaggacgatcatacagtaaatgagagaggcattgataataacagggcccttcgttaggactcatgaatacagaagaatagtctcctaccttcatagagaaaatcctatcaaactcttggggcagctccttgtctcctcgggaaaaagtcttcaatgagcgatctaagctccaagagaaagacccctcgagatgccttcccaatctgtggttttccactaccttccaaagacgtcgttgccataggctagcgccttcttctcctggataccgtgtacgcaacgcagattctagacgctccatgtcaacaagatgaccatgagaagtaagtaactgtgaggccaaatctctctttaaaacctcacgataaggaagcacttcttctttttcaaaagaactattaacaataatagtataataggtctctgcatcctggctatataaatctaaaacctcgttttcaagcaacactttggctaattgctgaccgtcggatattcctggtagagcactattcttccctgcagataagagaacttcttggctctgcttaggaacttgctgtagcgattgcagaattctctcagggcgggcccttaagatttccttgcgtgtgaaaagagaaattttatctcgcagcgcaggcttaagatgttggaagtctttatacgactgacacgtctcaacgtcaggaaactgctggagaatctcctggaagtgctcagaattttgttgccagtgcagcacttcaaccataggtacagtagctgctaagtcttgcaaagcgactctcttatagtctatagaaaaccgtctgcctactaaccgaggctctttagcttttatggtcgctataggaaggatctcattaggaacatccaaactatccgatttaggtaaactcactaactttaaatagacttcgaaagcttttaactcttgttttgttttaaagctatactccttagggagtctaaagaactctacttgtatggaatcttttccttgaacgaaaaatgtagttagaggttggaagtcaaaagaaacgcctccctgcaataggagaagagctcttttgcacaacaatatgtctcgatacatattgaaaaattcggactcagagatctctaaaaactgaaaatacgagtttacaaattcttcaaatcctaaggaaaattccttattcttactgatcttagtataggcatnttcgccttatcataaaagtcgtcacgagctttcttgttttgagggcctgggaagtacttttttctgctcgtcaataaagcggatcaagagctcaacagcagcagaaaggtaggcatccccaaaccagtcttgaatcgtctggtagccaaataaccgcaagtctttcccgcgagataaggcttcatctgggggaagagcaaacatttgctgcggtactccaacatttgtcgaagcacataatgagggaaccttctctcttctaaaaagagcttggctctagcaagaaatccttcttttgatatggggttctcgatttgttgaaagaccttcaggatctctaaaagctggggagctgaagatttccaaacttcttcagaggaaataaaaggagcgtcaaaacgacgatacggctggtaagctttctccttactaaaaattttctctcccggatggtacacttttaaaaagagtttttctcccacccttgtcgttagaaaataatcagtaagtagcccctcattgataaaattccaagctctagggttccctgtaaatggatacgcttcgtgagcaaagaacttcttcatagccatgaaatctttctctacataccgcttccctgaagcggtagtaaaaacagtccgacgtgaggtggactctgcagaaccttttctagagaatcgtccccaacccactccaataccagaaacacaaactacagcaatgacaatgccgataaattttttttgatgcttatagaagaacgataacaaggtccaccctctacccaaacaataaaagcgtagtgtaaacgatagcagagaaaaaaaccaggcaggatccctgcagagcctgcagaagagatcctgttggtagattcgcacccagggacgctaggctggcatataggtcagctgcaaatgtcccaaagtgtggtgtacggaatggaaataccaagagaaaatgtcgccatgacttacaggaatcgacaatccgatatctttattgaagactttgttagcttttgcagcgacttctggagattcgataactacaatactttcgtaatcaaaggcatcacttttctttccaaaattataacttccgatcacaaaaatttcatcatcgataatcatacacttcttgtgcaactgcgtttcccaaatagcaaactcataaatagaaacccgctcataaggttttagcttttcgcaaaaccattttttccaaagaggataccgtttcccatagagcaaggcgaaatagttaatacggtttccccaagcatagggtcctgtaattgcaggacttaattcatgacagccgttcgtaattaaactcagatgaacaccgtgattatgagaaacgtcgacaagagcatttaaaagctcgtccttagggatgaaatacatgtgagcaagcttcacagaagatctagctccctggataagtttcaaatattcttgagtccaggattgggttgcttatcgtggggaccacctaaaactatcctgatcttggaagagtcgacaagaacaagatcttcatgtttgtcaaatccaggaaatactgtctcctcggcttgttctaaagtcagtggaggacaggcgcctgcaaactgttcaggattatcaatgaaccacatatgatgtgcatagtagtcccacatagcaaattgcttatgatattcttctctgagctgcaaaccgaatgctgtagaacgcaacatgatatcctgatcacgaaatgctaggggccgacgcactccactgacaaataaacgtgggttatccactttctcaggaacctcatcccctggagtgcacataaactcttcaaaattggtaccacctaaaatacaatatttcccatcgatgatagaaagtttgatatgcatttcaatgacattaggagcgaggatgcttgttgagggtgggcaccctgtaaaaacgtagaaaaaccggttgggatgacgttctttgagagctttgagtaatttttggtcttcagcatcggtaaacgtgggttggataatgatattagctacagagctctggaaccagatccatacgagcctcgaggtgatcttaccatctctttaagcgttcggcctcctgtcatgcagggacacagttctacataaaaatttgcatgatctatgcaatccaatatctgttgaaaggcctctacactattgtcataaacaagaactccaaccttctccttgtctgaagctacgattgtctttgctgaaacagaattaggaaccagcaaaataaaaaatattccaagagctgccaagcgaaaacgcaaccgactcatcataacccctcaccacaaaacaatttaataaacgcctctttgacttgctgacgcgcctcctgcagcacttcatcagcagcttccaaacctaaagggaaaaacgcgtgaatctggatttgttcaataatttcttcaagaacctcgggttttaaaaatctctggtaaaactcagaagaacttcccgataagaataaggatccttgatgtaaaaatccctgttgcaccttgcgttgggcagcgcccctatcttcttgtccccaannaagaacgtcatacttcgaagtttttgccatacaaaaatttcctgaatctctggaagaagagttttcgtcttctggagctaacattccctggatccgaaatactttctctagaaccttcgctacaaaagagtttacagtatggtagttctcaagtaccgaagaagaataggaaggatgtgtcgcagacataagaacagaaaaagcataatctcccttatggaagacaaatccccctcccgtaggccgcactgcggcgtccaatcctagatccgcatagttggaaagtaaaaatttttctggacgcataaagtgaccgtacgtcagagaacaaggattctcccactcataaaggtgtaaaatgagctccccatcttgcagagattctaataaatctctgtccttagccatgtgggaggccgctgaagattttcctgaatctacgatacgaactttcatataacaaacataaaactaattaagactgtttcaaaagaagctgaactattgtatcatatacaaaaggtttgtgcataactttcccttaaactcagaggaattttaccaaatttgctggtttagagcgaagagttgcatcattattttaaatttcgtatatgcttaaggaaagttctacccctgtcttttaggtttttatgtttgagaagttcactaatagagcaaaacaagtcattaaactggcgaaaaaggaggctcagcgtttaaatcataactacctgggtactgagcacatcctgcttggtcttctcaaacttggtcaaggggtagctgttaatgtattacgcaacctcggtatagattttgatacggcacggcaagaggtggaacgcctgattggttatggtccagaaattcaagtctacggagatgctgcccttacaggaagagtaaaaaaatcttttgaatcagcaaatgaagaggccagccttttagagcacaattatgtcgggacggagcatttactcttagggatcctacatcaatcagatagtgtcgctcttcaggtattagaaaacttacatatcgatccaagagaggttcgtaaggaaattcttaaagaattagagaccttcaatctacaacttcctccttcgtcgtcgtcttcttcctcatcctctcgaagcaacccttcatcttcaaaatctcctttaggtcaaagcttaggttctgacaaaaacgaaaagctttctgctctgaaagcatatggttatgatttaacggagatggtccgagagtctaagctcgatcctgtcattggtcgttcttcagaagtcgaacggttgattttgattctttgccgaagaagaaaaaacaatcctgtacttattggagaagctggagttggtaagactgcaattgttgagggtctggctcaaaaaatcattctgaatgaggttcctgatgccttacggaaaaagcgactgattactctagatctagcattaatgattgctggaacaaaatatcgagggcaatttgaggaacggatcaaagctgtcatggatgaagttcgcaagcatggaaacatcttgctcttcattgacgagctccacacgattgtaggagcaggagcagctgaaggtgctatcgatgcttcaaacattttaaaacctgcgttagcgcgaggtgaaattcagtgtattggagcaactacgatagatgagtatcgcaagcacatagaaaaagacgcagctttagaacgtcgtttccaaaaaatcgtggttcaccctcctagtgtagatgagactattgagattttacgtggcctcaagaaaaagtatgaagaacatcacaatgtcttcattactgaagaagctttaaaagcagctgcgactctttctgatcaatatgttcatggacgtttcctccctgataaagcaatagatcttttagatgaagctggggctcgtgtccgtgtgaatacaatgggtcagcctacagatttaatgaagctagaggctgaaatcgaaaatacaaaattggccaaagagcaggccattggaactcaagaatacgaaaaagctgcaggtttacgtgatgaagagaaaaaacttcgcgaacgtctgcaaagtatgaaacaggaatgggaaaatcataaagaagagcaccaagttcctgtagatgaagaagcagtcgctcaggtagtttctctacaaacaggaattccctcagcaaggctcacagaagctgaaagtgagaagcttctgaagttagaagacacgttaagaagaaaagtcattggtcaaaatgatgccgttaccagcatttgccgtgccatccgacgttctcgaacagggatcaaagatcctaaccgacctacgggctccttcctattccttgggcctaccggtgtagggaaaagcctgctcgcccaacaaattgctatagagatgttcggtggtgaagacgctctgattcaggtagacatgtcagagtacatggagaaatttgctgctaccaagatgatgggatcacctccaggatatgtaggtcatgaagaagggggccaccttacggaacaggtacgtcgccgtccttactgcgttgttctctttgatgagatagaaaaggcacacccagacattatggacctgatgttgcaaattttagagcaaggacgtcttactgattcttttggtcgcaaagtggatttccgtcatgccattattatcatgacctccaatttgggagctgatctcattcgtaaaagcggagaaattggttttggcttgaagtcccatatggactataaggtcatccaagagaaaatcgaacatgctatgaagaaacacttaaagcctgagttcattaaccgtttggatgaaagtgtgattttccgtcccctcgagaaagaatctctatcggagatcatccatttagagatcaacaaactggactcgagactgaaaaactaccaaatggctttgaacatcccagactctgtgatttccttcctagtaacgaaggggcattctccagaaatgggagcacgtcctctacgccgtgtcattgagcagtaccttgaagatcctctagcggagctcttgcttaaagagtcctgccgtcaagaagctcgcaagctacgagcaaccttggttgaaaatcgcgttgcctttgaaagggaagaagaggagcaggaagctgctctccctagccctcacttggaatcataggaacgtcgataactccactaccaaggcaggtatctccttgataaaacgctattgtttgtcctggagttaccgccttgacgggttgtgaaaatcgcaccttgacctcgtcacctgagctataatctatcgtgcaagcttcatcaggagaacggtagcggactttagcgctacagtgacatccggatttaggaggggtaaaccaattgagctctctagctgttaattcccgtaggtagagctggggatggtcttcccccctcacaatataaatgctattttcctctatattttttcccacaacataacnnggtttctcggatcctccaagatcaagtcctcgccgctgccctatagtataatagtgacttccctgatgttgccctacaatttccttggtatcccaatcgataacgttgcctgttttattgggaagaaacttctctaggaactctttaaaagggcgcttccctataaagcaaatgcctgtactatcttttttttctgctgtgggaagagctgcttgagctgcaatcgcacgaacttcagtcttattcatttccccaagaggaaagagcacattgtgaagagcacttttaggagttcctgataaaaaatagctctgatctttttgaggatcgcaacctctaaggagttgggtttcttggagctcggtatttaatcggcagtagtgccctgtagcgaggtaatctccgccaagttcctggactttcttttgtagaaggtcaaatttgatttctcggttacaaagaatgtcggggttaggagtgtagcctaaagagtattccttgaggaaacgagcgaacactctttctctatattctttagcaaaagatacggtgtaataagggatatcgagctgaagacataccctctcgacatcttcataatctttagtagacgagcaaaggccgccttcgctatcctcttcccaattcttcatgaagaggccaataaccttataattggtaaattttttgaataaataggcaacgacagaagaatccacgcctcctgacattgctacaattacagtttgttgcataatttctcttacttgtctcctcataggaagggtaaggttttaaaaatttgaataactaagaggcatgactcgcttactaattgactaaaaataccatttttcttaaattatttcctcaaataatagagttctctttgtgtctagtactttaaacggggtatttccctcatcccttccggaagagtctgctgatttattcattacgaataaggagatcgtagctttgggggagaagggcaatgtttttctcacccactccattcctatgcatattgctgcgattacgatcttagtgattgtagctcttgctggaatcgctattatctgtttgggttgctatagccaaagcattctgttgattgccgttggcattgttcttactattttgactcttctctgcctacaagccttggtaggatttattaaattcatccggcagctccctcagcagctccatacgacagtacaatttatcagggagaagattcgacctgaatcctctctacagcttgtaaccaatgcacagagaaaaaccactcaagatacgctaaagttatacgaagaactctgcgacctctcacaaaaagagttcaaactgcaatcaactctttatcaaaaacgttttgagctttctcacaagaatgaaaagacaaatcaaaactagttagcaacgattcgaggaaacaacatggcaacttccgtagccccatcaccagtccccgagagcagccctctctctcatgctacagaagttctcaatcttcctaatgcttatattacgcagcctcatccgattccagcggctccttgggagacctttcgctccaaactttccacaaagcatacgctctgttttgccttaacactactgttaaccttagggggaacgatctcagcaggttacgcaggatatactggaaactggatcatctgtggcatcggcttgggaattatcgtactcacactgattcttgctcttcttctagcaatccctcttaaaaataagcagacaggaacaaaactgattgatgagatatctcaagacatttcctctataggatcaggatttgttcagagatacgggttgatgttctctacaattaaaagcgtgcatcttccagagctgacaacacaaaatcaagaaaaaacaagaattttaaatgaaattgaagcgaaaaaggaatcgatccaaaatcttgagcttaaaattactgagtgccaaaacaagttagcacagaaacagccgaaacggaaatcatctcagaaatcatttatgcgtagtattaagcacctctccaagaaccctgtaattttgttcgattgctgattagaaaaattctagtcctttcatccccctaaatctagggaaatcttcttgaaagtccctcctgagtaggaaaattattagatagtaatttaaaaattacgtatattccatttcaatctctagtaacgttggagaatcttacagaacatgttcaaactgctcttccacatcgctgcatttgcgggacacgtactctcgactcctatttttattgttcaagatgcttgtggaattgatgaagaagcatgtaaaaatcctcctccacgtcctttctctgctcaggtacaatacctaaaggtgaacgatgctaaatttaaaaagctgcctcatcaaactataggctatcgtcaatacgatggaacgtttctctgcacacttccgattacagagcattctgggctactgttttctactggctatataggtgcggatattcaatggaaaagctcacttcctatttcggagacagatcctaatggacttgggtgggcgactttccaagatacttctttttataactatgttctcctctctttaggagcttatacactctccnttaaaaaattggcagtggtctatcattctttctgggcttgtggatcctaaaaatattgagatgggttatggactctatcaaggagttctttctggaaaataccaggccactgagaagctttctgctatttttggcgtcattaatgaaacaggcctccatcaagagaaggcttggcctttagtaggtgttagttacaaggctaccgaccaactaactctcaattgcatctatcctgtgaatttttctattgattaccgctcgacatctgtctgtaacttagggcttgcttaccgccttacaagattccgaaaaaaactttacaaaaatcacctaatttcttctcgcggcatctttgaatatcaaggacgtgaaatcgaagctaacgtgaagctcaccccttggccgggaagttttattaagggattttacggttggtctattgggaatgatatctcgatagctgatgatcacaacaataataaaacgtcccatacttttaaaacctccgcatttttcggtggttccgctgtaatgaacttctaatttccagtttccagaaagatttttttacaggcccatacaaaaacttcaggagattttgtctacttgtgtctctcattttcctgccttttcaggaatttcgattgtctaaaaaccactatcctcttagaatttttacataatttttcataaaatattctctttcaaacggatatgggattcaaaaatatctgcaaacaaggctctcagctatacctgaatggcatttttccggaacgaatactagctcgaaaattaaaaaactgtgcgaagagctatcccagaactgctcttaccatagaagtactggtatcctcggtcttaggagctcttaaggttatcctgatcccttgcgcttctacatatgctgccttgaccctacccctacgggctctctttaacgctataaaaacaaaaagctgccaacatcttgcttcgtatgctatggcttggctcctccacattcttacgattgctgtgattatcggtctggtctttagtctggtctttatcccccctccagttgtctttatctccttggggcttctcatgtctgtaactactagcgttaccctcttccaagtgcataaaaatcttttccccccgtatgagcctccaccctcacgacctcacacgccccctccatttgctgatgagtatgtccctctcataagcgagtcttatttcgactaaaagttccaaataaaaataacttaaagttttagttaaaaatctgttaagattttaacaaataaactttatttaataaaaaagttaagactcagaagaaaagagaactaactaaatcctattaaatcttataatagtatgaaatatatcctatgaatgaaaattcatgggcctaatgataattacagtaagttgatagtatgagccaaccccctataaaccctttaggtcaacctcaagttcctgcagcagcatccccatcagggcagccaagcgtggtaaaacgtttaaaaacgtcatccacagggttattcaaaagatttattactgttcctgataaatatcctaaaatgcgctatgtctatgacacaggcattattgcccttgcggcaattgcgatcctttcgattctcctgactgcttcaggaaacagccttatgctttatgctctcgctccggcacttgccctgggagctttgggagttactctacttatttctgatattctggacagtccgaagccaagaaaatcggtgaggcaatcactgctatcgtcgttcctatcattgtattagcgattgctgcgggtcttattgcaggggctttcgttgcctctagtgggacgatgttagtctttgccaaccctatgtttgtcatgggattgattacggtggggctatacttcatgtccttgaataagctcaccttagattatttccgtagggaacacctcttgaggatggaaaagaaaacccaagagaccgcggacctattctagtgactccatccgccgacgatgcaaaaaaaatcgcagtggaaaagaaaaaagatctttctgcatctgcccgcatggaggaacacgaagcttcacaacgccaagatgcccgtcatcgtaggatcggtcgggaggctcaaggatctttcttctattcgtcacgaaatcctgagcatagacgctccttcggcagcctctcacgttttaaaacaaaaccctcagatgcggcttctacacgacccgcatctataagtcctccatttaaggacgattttcagccttatcacttcaaagatttaagaagcagttcattcggtagtggagcgagcagtgcgtttacacccataatgcctgcaagttcccgctctcctaatttctccacggggacggttctacaccctgagccggtctaccctaagggaggaaaagaaccctcaattcctcgagtttcttcatcttcccgccgttcccctcgtgatcgccaagataaacagcagcaacagcaaaatcaagatgaagaacagaaacagcaatctaagaagaaaagcgggaaatcgaatcaatctcttaaaactccgcctccagacggaaaaagcacggctaacctcagcccctccaatccattctctgacggttatgacgaaagagaaaaacggaaacacagaaagaacaaataaggatccgtggtttagataaccatcttccttactctctccttctaaaattcaagaaggtctaaaagcaaaaccgcttgtacaccttctcccctacccttaagcatttcccttatgttttaagggactcttaaatatagaaaaataccttaaatgcttctctcccaagattgaaacttctataactgagagtcttctccagagcatttacttgatttatttaactgtattctctattggtgcaccatgctcctaaagccacatgctatgggagtatttttgataaaaagcttttccccaaagacacatgaaatattctttaccttggctacttacctcttcggctttagttttctccctacatccactaatggctgctaacacggatctctcatcatccgataactatgaaaatggtagtagtggtagcgcagcattcactgccaaggaaacttcggatgcttcaggaactacctacactctcactagcgatgtttctattacgaatgtatctgcaattactcctgcagataaaagctgttttacaaacacaggaggagcattgagttttgttggagctgatcactcattggttctgcaaaccatagcgcttacgcatgatggtgctgcaattaacaataccaacacagctctttctttctcaggattctcgtcactcttaatcgactcagctccagcaacaggaacttcgggcggcaagggtgctatttgtgtgacaaatacagagggaggtactgcgacttttactgacaatgccagtgtcaccctccaaaaaaatacttcagaaaaagatggagctgcagtttctgcctacagcatcgatcttgctaagactacgacagcagctctcttagatcaaaatactagcacaaaaaatggcggggccctctgtagtacagcaaacactacagtccaaggaaactcaggaacggtgaccttctcctcaaatactgctacagataaaggtggggggatctactcaaaagaaaaggatagcacgctagatgccaatacaggagtcgttaccttcaaatctaatactgcaaagacggggggtgcttggagctctgatgacaatcttgctcttaccggcaacactcaagtactttttcaggaaaataaaacaaccggctcagcagcacaggcaaataacccggaaggttgtggtggggcaatctgttgttatcttgctacagcaacagacaaaactggattagccatttctcagaatcaagaaatgagcttcactagtaatacaacaactgcgaatggtggagcgatctacgctactaaatgtactctggatggaaacacaactcttaccttcgatcagaatactgcgacagcaggatgtggcggagctatctatacagaaactgaagatttttctcttaagggaagtacgggaaccgtgaccttcagcacaaatacagcaaagacaggcggcgccttatattctaaagaaaacagctcgctgactggaaataccaacctgctcttttcagggaacaaagctacgggcccgagtaattcttcagcaaatcaagagggttgcggtggggcaatcctatcgtttcttgagtcagcatctgtaagtactaaaaaaggactctggattgaagataacgaaaacgtgagtctctctggtaatactgcaacagtaagtggcggtgcgatctatgcgaccaagtgtgctctgcatggaaacacgactcttacctttgatggcaatactgccgaaactgcaggaggagcgatctatacagaaaccgaagattttactcttacgggaagtacgggaaccgtgaccttcagcacaaatacagcaaagacagcaggggctctacatactaaaggaaatacttcctttaccaaaaataaggctcttgtattttctggaaattcagcaacagcaacagcaacaacaactacagatcaagaaggttgtggtggagcgatcctctgtaatatctcagagtctgacatagctacaaaaagcttaactcttactgaaaatgagagtttaagtttcattaacaatacggcaaaaagaagtggtggtggtatttatgctcctaagtgtgtaatctcaggcagtgaatccataaactttgatggcaatactgctgaaacttcgggaggagcgatttattcgaaaaacctttcgattacagctaacggtcctgtctcctttaccaataattctggaggcaagggaggcgccatttatatagccgatagcggagaactttccttagaggctattgatggggatattactttctcagggaaccgagcgactgagggaacttcaactcccaactcgatccatttaggtgcaggggctaagatcactaagcttgcagcagctcctggtcatacgatttatttttatgatcctattacgatggaagctcctgcatctggaggaacaatagaggagttagtcatcaatcctgttgtcaaagctattgttcctcctccccaaccaaaaaatggtcctatagcttcagtgcctgtagtccctgtagcacctgcaaacccaaacacgggaactatagtattttcttctggaaaactccccagtcaagatgcctcgattcctgcaaatactaccaccatactgaaccagaagatcaacttagcaggaggaaatgtcgttttaaaagaaggagccaccctacaagtatattccttcacacagcagcctgattctacagtattcatggatgcaggaacgaccttagagaccacgacaactaacaatacagatggcagcatcgatctaaagaatctctctgtaaatctggatgctttagatggcaagcgtatgataacgattgccgtaaacagcacaagtgggggattaaaaatctcaggggatctgaaattccataacaatgaaggaagtttctatgacaatcctgggttgaaagcaaacttaaatcttcctttcttagatctttcttctacttcaggaactgtaaatttagacgacttcaatccgattccttctagcatggctgctccggattatgggtatcaagggagttggactctggttcctaaagtaggagctggagggaaagtgactttggtcgcggaatggcaagcgttaggatacactcctaaaccagagcttcgtgcgactttagttcctaatagcctttggaatgcttatgtaaacatccattctatacagcaggagatcgccactgcgatgtcggacgctccctcacatccagggatttggattggaggtattggcaacgccttccatcaagacaagcaaaaggaaaatgcaggattccgtttgatttccagaggttatattgttggtggcagcatgaccacccctcaagaatatacctttgctgttgcattcagccaactctttggcaaatctaaggattacgtagtctcggatattaaatctcaagtctatgcaggatctctctgtgctcagagctcttatgtcattcccctgcatagctcattacgtcgccacgtcctctctaaggtccttccagagctcccaggagaaactccccttgttctccatggtcaagtttcctatggaagaaaccaccataatatgacgacaaagcttgcgaacaacacacaagggaaatcagactgggacagccatagttcgctgttgaagtcggtggttctcttcctgtagatctaaactacagataccttaccagctactctccctatgtgaaactccaagttgtgagtgtaaatcaaaaaggattccaagaggttgctgctgatccacgtatctttgacgctagccatctggtcaacgtgtctatccctatgggactcaccttcaaacacgaatcagcaaagccccccagtgctttgcttcttactttaggttacgctgtagatgcttaccgggatcaccctcactgcctgacctccttaacaaatggcacctcgtggtctacgtttgctacaaacttatcacgacaagctttctttgctgaggcttctggacatctgaagttacttcatggtcttgactgcttcgcttctggaagttgtgaactgcgcagctcctcaagaagctataatgcaaactgtggaactcgttattctttctaagattctccgagaatcttagaaaaacatactttttataaagatgaatacgttattgagatcgcactgtagggtatcagagggggagggcatcccctcttcatcaaagagattcttaggatccgtatgaagagaagtaaaagatccgccatccttggggttctgattctccgcatcaatcaattccttgcgtttcccttgatttctttttttctttacagtatttgctaatttaatttccttgtttcaaaaaagtgcttacaaatgaagtcctctgtctcttggttgttcttttcttcaatcccgctcttttcatcgctctctatagtcgcggcagaggtgaccttagatagcagcaataatagctatgatggatctaacggaactaccttcacggtcttttccactacggacgctgctgcaggaactacctattccttactttccgacgtatcctttcaaaatgcaggggctttaggaattcccttagcctcaggatgcttcctagaagcgggcggcgatcttactttccaaggaaatcaacatgcactgaagtttgcatttatcaatgcgggctctagcgctggaactgtagccagtacctcagcagcagataagaatcttctctttaatgatttttctagactctctattatctcttgtccctctcttcttctctctcctactggacaatgtgctttaaaatctgtggggaatctatctctaactggcaattcccaaattatatttactcagaacttctcgtcagataacggcggtgttatcaatacgaaaaacttcttattatcagggacatctcagtttgcgagcttttcgagaaaccaagccttcacagggaagcaaggcggtgtagtttacgctacaggaactataactatcgagaacagccctgggatagtttccttctctcaaaacctagcgaaaggatctggcggtgctctgtacagcactgacaactgttcgattacagataactttcaagtgatctttgacggcaatagtgcttgggaagccgctcaagctcagggcggggctatttgttgcactacgacagataaaacagtgactcttactgggaacaaaaacctctctttcacaaataatacagcattgacatatggcggagccatctctggactcaaggtcagtatttccgctggaggtcctactctatttcaaagtaatatctcaggaagtagcgccggtcagggaggaggaggagcgatcaatatagcatctgctggggaactcgctctctctgctacttctggagatattaccttcaataacaaccaagtcaccaacggaagcacaagtacaagaaacgcaataaatatcattgataccgctaaagtcacatcgatacgagctgctacggggcaatctatctatttctatgatcccatcacaaatccaggaaccgcagcttctaccgacacattgaacttaaacttagcagatgcgaacagtgagatcgagtatgggggtgcgattgtcttttctggagaaaagctttcccctacagaaaaagcaatcgctgcaaacgtcacctctactatccgacaacctgcagtattagcgcggggagatcttgtacttcgtgatggagtcaccgtaactttcaaggatctgactcaaagtccaggatcccgcatcttaatggatggggggactacacttagtgctaaagaggcaaatctttcgcttaatggcttagcagtaaatctctcctctttagatggaaccaacaaggcagctttaaaaacagaagctgcagataaaaatatcagcctatcgggaacgattgcgcttattgacacggaagggtcattctatgagaatcataacttaaaaagtgctagtacctatcctcttcttgaacttaccaccgcaggagccaacggaacgattactctgggagctctttctaccctgactcttcaagaacctgaaacccactacgggtatcaaggaaactggcagttgtcttgggcaaatgcaacatcctcaaaaataggaagcatcaactggacccgtacaggatacattcctagtcctgagagaaaaagtaatctccctctaaatagcttatggggaaactttatagatatacgctcgatcaatcagcttatagaaaccaagtccagtggggagccttttgagcgtgagtatggctttcaggaattgcgaatttcttctatagagattctatgcccacccgccatggtttccgccatatcagcgggggttatgcactagggatcacagcaacaactcctgccgaggatcagcttacttttgccttctgccagctctttgctagagatcgcaatcatattacaggtaagaaccacggagatacttacggtgcctctttgtatttccaccatacagaagggctcttcgacatcgccaatttcctctggggaaaagcaacccgagctccctgggtgctctctgagatctcccagatcattcctttatcgttcgatgctaaattcagttatctccatacagacaaccacatgaagacatattataccgataactctatcatcaagggttcttggagaaacgatgccttctgtgcagatcttggagctagcctgccttttgttatttccgttccgtatcttctgaaagaagtcgaaccttttgtcaaagtacagtatatctatgcgcatcagcaagacttctacgagcgttatgctgaaggacgcgctttcaataaaagcgagcttatcaacgtagagattcctataggcgtcaccttcgaaagagactcaaaatcagaaaagggaacttacgatcttactcttatgtatatactcgatgcttaccgacgcaatcctaaatgtcaaacttccctaatagctagcgatgctaactggatggcctatggtaccaacctcgcacgacaaggtttttctgttcgtgctgcgaaccatttccaagtgaacccccacatggaaatcttcggtcaattcgcttttgaagtacgaagttcttcacgaaattataatacaaacctaggctctaagttttgtttctagattatcgaaaacgtgttaattaattgaacccaagcatctttctatgaaaatacccttgcacaaactcctgatctcttcgactcttgtcactcccattctattgagcattgcaacttacggagcagatgcttctttatcccctacagatagctttgatggagcgggcggctctacatttactccaaaatctacagcagatgccaatggaacgaactatgtcttatcaggaaatgtctatataaacgatgctgggaaaggcacagcattaacaggctgctgctttacagaaactacgggtgatctgacatttactggaaagggatactcattttcattcaacacggtagatgcgggttcgaatgcaggagctgcggcaagcacaactgctgataaagccctaacattcacaggattttctaacctttccttcattgcagctcctggaactacagttgcttcaggaaaaagtactttaagttctgcaggagccttaaatcttaccgataatggaacgattctctttagccaaaacgtctccaatgaagctaataacaatggcggagcgatcaccgcaaaaactctttctatttctgggaatacctcttctataaccttcactagtaatagcgcaaaaaaattaggtggagcgatctatagctctgcggctgcaagtatttcaggaaacaccggccagttagtctttatgaataataaaggagaaactgggggtggggctctgggctttgaagccagctcctcgattactcaaaatagctcccttttcttctctggaaacactgcaacagatgctgcaggcaagggcggggccatttattgtgaaaaaacaggagagactcctactcttactatctctggaaataaaagtctgaccttcgccgagaactcttcagtaactcaaggcggagcaatctgtgcccatggtctagatctttccgctgctggccctaccctattttcaaataatagatgcgggaacacagctgcaggcaagggcggcgctattgcaattgccgactctggatctttaagtctctctgcaaatcaaggagacatcacgttccttggcaatactctaacctcaacctccgcgccaacatcgacacggaatgctatctacctgggatcgtcagcaaaaattacgaacttaagggcagcccaaggccaatctatctatttctatgatccgattgcatctaacaccacaggagcttcagacgttctgaccatcaaccaaccggatagcaactcgcctttagattattcaggaacgattgtattttctggggaaaagctctctgcagatgaagcgaaagctgctgataacttcacatctatattaaagcaaccattggctctagcctctggaaccttagcactcaaaggaaatgtcgagttagatgtcaatggtttcacacagactgaaggctctacactcctcatgcaaccaggaacaaagctcaaagcagatactgaagctatcagtcttaccaaacttgtcgttgatctttctgccttagagggaaataagagtgtgtccattgaaacagcaggagccaacaaaactataactctaacctctcctcttgttttccaagatagtagcggcaatttttatgaaagccatacgataaaccaagccttcacgcagcctttggtggtattcactgctgctactgctgctagcgatatttatatcgatgcgcttctcacttctccagtacaaactccagaacctcattacgggtatcagggacattgggaagccacttgggcagacacatcaactgcaaaatcaggaactatgacttgggtaactacgggctacaaccctaatcctgagcgtagagcttccgtagttcccgattcattatgggcatcctttactgacattcgcactctacagcagatcatgacatctcaagcgaatagtatctatcagcaacgaggactctgggcatcaggaactgcgaatttcttccataaggataaatcaggaactaaccaagcattccgacataaaagctacggctatattgttggaggaagtgctgaagatttttctgaaaatatcttcagtgtagctttctgccagctcttcggtaaagataaagacctgtttatagttgaaaatacctctcataactatttagcgtcgctatacctgcaacatcgagcattcctaggaggacttcccatgccctcatttggaagtatcaccgacatgctgaaagatattcctctcattttgaatgcccagctaagctacagctacactaaaaatgatatggatactcgctatacttcctatcctgaagctcaaggctcttggaccaataactctggggctctagagctcggaggatctctggctctatatctccctaaagaagcaccgttcttccagggatatttccccttcttaaagttccaggcagtctacagccgccaacaaaactttaaagagagtggcgctgaagcccgtgcttttgatgatggagacctagtgaactgctctatccctgtcggcattcggttagaaaaaatctccgaagatgaaaaaaataatttcgagatttctctagcctacattggtgatgtgtatcgtaaaaatccccgttcgcgtacttctctaatggtcagtggagcctcttggacttcgctatgtaaaaacctcgcacgacaagccttcttagcaagtgctggaagccatctgactctctcccctcatgtagaactctctggggaagctgcttatgagcttcgtggctcagcacacatctacaatgtagattgtgggctaagatactcattctagttcctactttcctccctaaacttttagggaggaattcttataaaaaccctgtagattcttaacttactagtctctcctttcctcttgctttctttaatttattgcagtatgtggtgaaataatttgttaaaccacctatagccctctacatgaaatcctctcttcattggtttttaatctcgtcatctttagcacttcccttgtcactaaatttctctgcgtttgctgctgttgttgaaatcaatctaggacctaccaatagcttctctggaccaggaacctacactcctccagcccaaacaacaaatgcagatggaactatctataatctaacaggggatgtctcaatcaccaatgcaggatctccgacagctctaaccgcttcctgctttaaagaaactactgggaatctttctttccaaggccacggctaccaatttctcctacaaaatatcgatgcgggagcgaactgtacctttaccaatacagctgcaaataagcttctctccttttcaggattctcctatttgtcactaatacaaaccacgaatgctaccacaggaacaggagccatcaagtccacaggagcttgttctattcagtcgaactatagttgctactttggccaaaacttttctaatgacaatggaggcgccctccaaggcagctctatcagtctatcgctaaaccccaacctaacgtttgccaaaaacaaagcaacgcaaaaagggggtgccctctattccacgggagggattacaattaacaatacgttaaactcagcatcattttctgaaaataccgcggcgaacaatggcggagccatttacacggaagctagcagttttattagcagcaacaaagcaattagctttataaacaatagtgtgaccgcaacctcagctacagggggagccatttactgtagtagtacatcagcccccaaaccagtcttaactctatcagacaacggggaactgaactttataggaaatacagcaattactagtggtggggcgatttatactgacaatctagttctttcttctggaggacctacgctttttaaaaacaactctgctatagatactgcagctcccttaggaggagcaattgcgattgctgactctggatctttgagtctttcggctcttggtggagacatcacttttgaaggaaacacagtagtcaaaggagcttcttcgagtcagaccactaccagaaattctattaacatcggaaacaccaatgctaagattgtacagctgcgagcctctcaaggcaatactatctacttctatgatcctataacaactagcatcactgcagctctctcagatgctctaaacttaaatggtcctgaccttgcagggaatcctgcatatcaaggaaccatcgtattttctggagagaagctctcggaagcagaagctgcagaagctgataatctcaaatctacaattcagcaacctctaactcttgcgggagggcaactctctcttaaatcaggagtcactctagttgccaagtccttttcgcaatctccgggctctaccctcctcatggatgcagggaccacattagaaaccgctgatggatcactatcaataatctgttctcaatgtagattccttaaaagagaccaagaagntacgctaaaagcaacacaagcaagtcagacagtcactttatctggatcgctctctcttgtagatccttctggaaatgtctacgaagatgtctcttggaataaccctcaagtcttttcttgtctcactcttactgctgacgaccccgcgaatattcacatcacagacttagctgctgatcccctagaaaaaaatcctatccattggggataccaagggaattgggcattatcttggcaagaggatactgcgactaaatccaaagcagcgactcttacctggacaaaaacaggatacaatccgaatcctgagcgtcgtggaaccttagttgctaacacactatggggatcctttgttgatgtgcgctccatacaacagcttgtagccactaaagtacgccaatctcaagaaactcgcggcatctggtgtgaagggatctcgaacttcttccataaagatagcacgaagataaataaaggttttcgccacataagtgcaggttatgttgtaggagcgactacaacattagcttctgataatcttatcactgcagccttctgccaattattcgggaaagatagagatcactttataaataaaaatagagcttctgcctatgcagcttctctccatctccagcatctagcgaccttgtcttctccaagcttgttacgctaccttcctggatctgaaagtgagcagcctgtcctctttgatgctcagatcagctatatctatagtaaaaatactatgaaaacctattacacccaagcaccaaagggagagagctcgtggtataatgacggttgcgctctggaacttgcgagctccctaccacacactgctttaagccatgagggtctcttccacgcgtattttcctttcatcaaagtagaagcttcgtacatacaccaagatagcttcaaagaacgtaatactaccttggtacgatctttcgatagcggtgatttaattaacgtctctgtgcctattggaattaccttcgagagattctcgagaaacgagcgtgcgtcttacgaagctactgtcatctacgttgccgatgtctatcgtaagaatcctgactgcacgacagctctcctaatcaacaatacctcgtggaaaactacaggaacgaatctctcaagacaagctggtatcggaagagcagggatcttttatgccttctctccaaatcttgaggtcacaagtaacctatctatggaaattcgtggatcttcacgcagctacaatgcagatcttggaggtaagttccagttctaaaagcgttcctgatcccttagaaattctaagagatcctgagtgtatctagggacttctcaaagacaatgcgccttgtttagacgaggagaagtcgaaagatcagaggaatctaagaactagaaaaaatcccagattacaagaggtcgaagattcaaagaagtcgctagatcacaagaaagaatgggcagagtacgtgatctcacgaactccgcccgtcttagaatccaaagactttttagtatactaagactgtctatgatccaatagccaaagactcttgaatatttaaatgttttctatgatccgaaaactcttagagtcgataaaaactccggattctttatccccagatctctttagcaatctctttcacaaaggcgatcttcttccactgttcttcttcagtcattctatggtctccctcacaagaagcaaacccacattgcgggctcaaagaaagtctctctaagggaatgtagctcgcagcttcataaatacgagaaaccacagcatctcgatcttcaatacaagaatggttgctggagatcaatcccaagcagacgtgtttctctccagagacgtaagctaaaggctcagcacctcctgaatacttatcatcaagagcccaataatagtgataactatccacatcggtcttagcaaataaaggctcctctatagaatcataagctcgtctagagaaaaactcggcctgataatcaccacgacagacatgcagacttacaaaaagatcctcgggtctatccttcatcactaaattatggatccataaaaactgttctaaaatttcctgcaacctgtcatgagaatcaacaccataccaagaaggcgctcgtatatccaagaggcgacaccaagcacaatcgtccaactgcaaattacgacaacctgcagcataaagatcttggatgacttggcgataataaaagacaatatcatcaattagctcttgattcgtaggataaaacttccgagtatttttcagattaggagcaaaaatcatctcatggaaaaattgtgatggagaaggaatcgtttgttttgcttttgcatttcccttctcaaaagttttgacaaactcgaaatgttctataaacggatgttttgatacggagattttatctttaagatacactccaatttcagggtcattagagtccctgcgacgatccacgccatggaatccccacataaagtcgaaatcccaactatacctacggaattccccatcagtaaaaaagataagacctgcttctgtttgcttttttatgagattacgaatagcagcatcttcgacaactcgcatctgctcatagacaattcttccttcttcaaaatcagagcgtgctcgtgtaagactttcaggacgtaagaaacttcccacaacatcaaaatgacattgctcaggttgttggaatgggctcatcatttccatccttagagatgatcctaataaaatacatttccactcatggatctctcttctcgatggttgaataaattaaagacaagaaaacagctagatcaaaacataaagtacgattgtaaaagttactgcctgaggggaatctcacaaatcttaggatgggtgtaacaacaccccttcccttaaaaaagaaagagacgtaccgtctctgcaactctaatctttgcagctattctctataagaagcataacaaaaaccacttaaaatttaggatctaaaaatagtgaattatcttattcaataagaattaaagaaacgtattttaaagaacgggtttctattaaaaaatttccttaattttaaaacgtgtttgtaacaagaaaggcagagtacgtgacctcacgaactctgccctcttgcctttttaatccccgatctctcctggttcaaaaacaaggtgagtcgtgtttaagaaaatcctaaatgcgatctctctcagaatttctgagacatgagagacgctcctagaattggaacttacccccaagatctacattataaatccgtgaggatccacgaacttcaaagacaaactggccgagcacttcaaacataggagagaaggcgtagtgactgcctgcacgcacttgcaaggcctgtcgtgctaagttattggcataagtttcccaagaggctccgctgattacaagtgctgtagtgcatttgggatcattgcggataagatcaggaacataggataaagtcagatcataagaaaagtcattacaatcagagaacttctcaaacttcacccctataggcaaagataaattgaagaggttgctgtcatcaaaagatcttccttctgtacctttctccgagaagctgtcctgacgtatataggtcagattcagtttgatgtatggagcataggtatcaaaacaatgcaggtattcaggataagaatgagaagaagctcccaacatcatgttaaaagcattattcccccaagaacctttcacctcaggatacgcagtatactttgtcttcagatcattactgacgtggctataagcgagctgcccttctaaaacgaggggtttatgactccaagagccaggaagtttatctaagagacaacctatgaacccactacattctgtaatgtgttggatatagaaggctcctgcataggtatcagtatgatttttagcgactaagaaatctttatcgctaccaaagagttggcaaaaggcaaagctaattaagttttcagaacaagtttgcgctgcacctccgatagcatatccaccagatttatgacggtatttgcgtttttcccctttcttatctttatctaagaaattggcgactcccgcagcccagaagcctcgatctgaacaaagagtcaaagcacttctctctatgacaccttgaatcgcttggatgtctgaaaaagatccccaaaggctattaggaactaaaggtccttgacgctcaggattcggaaggtagcccgtattggtccaagctaatgtcgctgtcttagtctttggagtgcttgcggtatcatcaacccaagtcattccccaagtaccttgatacccatagtgcgtaggagttgctactgtaggaaccgctggaacatctgtagttgttgcagtacccagagcagagagctgcacaaatgaaaagtcttgagtttttcctaagtcgtgattttcataagcattcccttggttatccaaaagaagaatcggaccactaagggctacatttttacttgctgcagaagcagcaattacaactttcttaccctcgcctaaagagtctacaggaatggaaagacctgttaaagtgacctcctctgtacttgcttttaacgttgtgcccgcatccataataacagaggaacccgcggtctgagtaaagcctttcgtatcgagagtgacaccacgtttaagtactaaatttcctgcagttagagttacaggctgcttcagcgtagaagtgaggttgtctgcaacttttgcttcatcttcagagagcttttcaccagaaaaaacaatcgacccactataatctgtactattacctgcatcagccttattgagatttaaagtatctgtagaatccgcagccgtattagcagtaatcggatcgtagaaaaagatgctatgcccagatattgcacgtaaattcgtgatctttgcagtagatcctatgtcaatagaatttcttttcgtagtttgtggtgtagttgcaacaatggcattcccattgaaggtaatgtcccctgcttctgctgaaagactacactctccagctgccagtatagaaatggctccaccattacctgcagtggtaccttggactatattgttagaaaaggagatacccccccccccccccggaagccagtgtaagcttcttagcataaatggctccgccattagctacagcttggtttcctgagaaagttacactctgattcccagatatggtaacatcggcatctccagaaagagctcctccatttcctgcggtcgctgtcacactattttcagaaaatacaagagacgtattccctgtaattgtacagtttcctgtgctatttatagctccacctgcagcttcagcaatattgttcgagaagagggtaggagccgtattatttgtaatatctacagtaccagtagcacaaatagccccaccttttttccctgttgcgctcgatttattcccttcaaaagaaatcgatcccgtgctgtttttcaaagaaagattcttggtagaaatgtccgccattttcctcacagtaatcttgtttaaataaaatagttccattgttatcaaatgtaagatcccctccacatttaactgcaccttttcctgagggggttgtgattaccgatgatggggccgctaagaaagtaagactcgaaaatcctgttagcgacagatttttatcagttgtaacagaaagtntgcgccttcagcactagacttnatatttaaaaaagaaagtgagtaccccttaccggcaaagcttaaagattccgtagtgtcagaaaaacaacccttcgttaaagctgccgaatccccaaggttttgcagagttatatctcctgtcagagtatagtctattccagtagtcgtatttttaggagtataggtgcctgtgttagtacttccgtcaaagctatcagaggggcctatattttcagcagttgcagcaaaaacagtggaacaactagtaaaacatgccaatgtcgaagagagcactaaccaggaaaattgcgatttcataaacccactttattattaaattcttacttgcgtcatataaaatagaaaactcagagagtcaagataaaaattcttgacagctgttttgtcatctttaacttgatttacttattttgtttctatattgatgcgaatagttctctaaaaaacaaaagcattaccatgaagacttcgattccttgggttttagtttcctccgtgttagctttctcatgtcacctacagtcactagctaacgaggaacttttatcacctgatgatagctttaatggaaatatcgattcaggaacgtttactccaaaaacttcagccacaacatattctctaacaggagatgtcttcttttacgagcctggaaaaggcactcccttatctgacagttgttttaagcaaaccacggacaatcttaccttcttggggaacggtcatagcttaacgtttggctttatagatgctggcactcatgcaggtgctgctgcatctacaacagcaaataagaatcttaccttctcagggttttccttactgagttttgattcctctcctagcacaacggttactacaggtcagggaacgctttcctcagcaggaggcgtaaatttagaaaatattcgtaaacttgtagttgctgggaatttttctactgcagatggtggagctatcaaaggagcgtctttccttttaactggcacttctggagatgctctttttagtaacaactcttcatcaacaaagggaggagcaattgctactacagcaggcgctcgcatagcaaataacacaggtnatgttagattcctatctaacatagcgtctacgtcaggaggcgctatcgatgatgaaggcacgtcgatactatcgaacaacaaatttctatattttgaagggaatgcagcgaaaactactggcggtgcgatctgcaacaccaaggcgagtggatctcctgaactgataatctctaacaataagactctgatctttgcttcaaacgtagcagaaacaagcggtggcgccatccatgctaaaaagctagccctttcctctggaggctttacagagtttctacgaaataatgtctcatcagcaactcctaaggggggtgctatcagcatcgatgcctcaggagagctcagtctttctgcagagacaggaaacattacctttgtaagaaatacccttacaacaaccggaagtaccgatactcctaaacgtaatgcgatcaacataggaagtaacgggaaattcacggaattacgggctgctaaaaatcatacaattttcttctatgatcccatcacttcagaaggaacctcatcagacgtattgaagataaataacggctctgcgggagctctcaatccatatcaaggaacgattctattttctggagaaaccctaacagcagatgaacttaaagttgctgacaatttaaaatcttcattcacgcagccagtctccctatccggaggaaagttattgctacaaaagggagtcactttagagagcacgagcttctctcaagaggccggttctctcctcggcatggattcaggaacgacattatcaactacagctgggagtattacaatcacgaacctaggaatcaatgttgactccttaggtcttaagcagcccgtcagcctaacagcaaaaggtgcttcaaataaagtgatcgtatctgggaagctcaacctgattgatattgaagggaacatttatgaaagtcatatgttcagccatgaccagctcttctctctattaaaaatcacggttgatgctgatgttgatactaacgttgacatcagcagccttatccctgttcctgctgaggatcctaattcagaatacggattccaaggacaatggaatgttaattggactacggatacagctacaaatacaaaagaggccacggcaacttggaccaaaacaggatttgttcccagccccgaaagaaaatctgcgttagtatgcaataccctatggggagtctttactgacattcgctctctgcaacagcttgtagagatcggcgcaactggtatggaacacaaacaaggtttctgggtttcctccatgacgaacttcctgcataagactggagatgaaaatcgcaaaggcttccgtcatacctctggaggctacgtcatcggtggaagtgctcacactcctaaagacgacctatttacctttgcgttctgccatctctttgctagagacaaagattgttttatcgctcacaacaactctagaacctacggtggaactttattcttcaagcactctcataccctacaaccccaaaactatttgagattaggaagagcaaagttttctgaatcagctatagaaaaattccctagggaaattcccctagccttggatgtccaagtttcgttcagccattcagacaaccgtatggaaacgcactatacctcattgccagaatccgaaggttcttggagcaacgagtgtatagctggtggtatcggcctagaccttccttttgttctttccaacccacatcctcttttcaagaccttcattccacagatgaaagtcgaaatggtttatgtatcacaaaatagcttcttcgaaagctctagtgatggccgtggttttagtattggaaggctgcttaacctctcgattcctgtgggtgcgaaattcgtgcagggggatatcggagattcctacacctatgatctctcaggattctttgtttccgatgtctatcgtaacaatccccaatctacagcgactcttgtgatgagcccagactcttggaaaattcgcggtggcaatctttcaagacaggcatttttactgaggggtagcaacaactacgtctacaactccaattgtgagctcttcggacattacgctatggaactccgtggatcttcaaggaactacaatgtagatgttggtaccaaactccgattctagattgctaaaactccctagttcttctagggagttttctcatacttttagggaaatatttgctatagggaatgctttccttgcaaactgtaaaaaataacatttgtccctcttcaaaaaagatttcttttaataatttctagttataattttattttaaaaacagttaaataattaatagacaataatctattcttattgacttctttttttcttgtttattaaagttgcttcaaccttattgatttaacgaggaaaccatgaccatacttcgaaattttcttacctgctcggctttattcctcgctctccctgcagcagcacaagttgtatatcttcatgaaagtgatggttataacggtgctatcaataataaaagcttagaacctaaaattacctgttatccagaaggaacttcttacatctttctagatgacgtgaggatttccaacgttaagcatgatcaagaagatgctggggtttttataaatcgatctgggaatctttttttcatgggcaaccgttgcaacttcacttttcacaaccttatgaccgagggttttggcgctgccatttcgaaccgcgttggagacaccactctcactctctctaatttttcttacttagcgttcacctcagcacctctactacctcaaggacaaggagcgatttatagtcttggttccgtgatgatcgaaaatagtgaggaagtgactttctgtgggaactactcttcgtggagtggagctgcgatttatactccctaccttttaggttctaaggcgagtcgtccttcagtaaatctcagcgggaaccgctacctggtgtttagagacaatgtgagccaaggttatggcggcgccatatctacccacaatctcacactcacgactcgaggaccttcgtgttttgaaaataatcatgcttatcatgacgtgaatagtaatggaggagccattgccattgctcctggaggatcgatctctatatccgtgaaaagcggagatctcatcttcaaaggaaatacagcatcacaagacggaaatacaatacacaactccatccatctgcaatctggagcacagtttaagaacctacgtgctgtttcagaatccggagtttatttctatgatcctataagccatagcgagtcgcataaaattacagatcttgtaatcaatgctcctgaaggaaaggaaacttatgaaggaacaattagcttctcaggactatgcctggatgatcatgaagtttgtgcggaaaatcttacttccacaatcctacaagatgtcacattagcaggaggaactctctctctatcggatggggttaccttgcaactgcattcttttaagcaggaagcaagctctacgcttactatgtctccaggaaccactctgctctgctcaggagatgctcgggttcagaatctgcacatcctgattgaagataccgacaactttgttcctgtaaggattcgcgccgaggacaaggatgctcttgtctcattagaaaaacttaaagttgcctttgaggcttattggtccgtctatgactttcctcaatttaaggaagcctttacgattcctcttcttgaacttctagggccttcttttgacagtcttctcctaggggagaccactttggagagaacccaagtcacaacagagaatgacgccgttcgaggtttctggtccctaagctgggaagagtaccccccttctctggataaagacagaaggatcacaccaactaagaaaactgttttcctcacttggaatcctgagatcacttctacgccataatctctaagtctacactataattaagggaatcccctttaagaagattttgggacctatctgtattcagagataggtccctctatgcacacatgttcacgagtctcgggcgtagcgccattttctactttacaggttctctaaaacatcttcgtttgggagaatttcttgagatttttcaaaaatagaatcgccattttctatcaagtattcttctaagaaagcaatgtaagaaatgggaaaatgccctttaaaatatcctgtaatcttaaagctgtcaaaattaagagattaaaactgtgtcttattgtacttgtttttttacagcctttcccttatttgtaggataatctggtttcatctctacgtgcaaatgaaaacgtctattcgtaagttcttaatttctaccacactggcgccatgttttgcttcaacagcgtttactgtagaagttatcatgccttccgagaactttgatggatcgagtgggaagatttttccttacacaacactttctgatcctagagggacactctgtattttttcaggggatctctacattgcgaatcttgataatgccatatccagaacctcttccagttgctttagcaatagggcgggagcactacaaatcttaggaaaaggtggggttttctccttcttaaatatccgttcttcagctgacggagccgcgattagtagtgtaatcacccaaaatcctgaactatgtcccttgagtttttcaggatttagtcagatgatcttcgataactgtgaatctttgacttcagatacctcagcgagtaatgtcatacctcacgcatcggcgatttacgctacaacgcccatgctctttacaaacaatgactccatactattccaatacaaccgttctgcaggatttggagctgccattcgaggcacaagcatcacaatagaaaatacgaaaaagagccttctctttaatggtaatggatccatctctaatggaggggccctcacgggatctgcagcgatcaacctcatcaacaatagcgctcctgtgattttctcaacgaatgctacagggatctatggtggggctatttaccttaccggaggatctatgctcacctctgggaacctctcaggagtcttgttcgttaataatagctcgcgctcaggaggcgctatctatgctaacggaaatgtcacattttctaataacagcgacctgactttccaaaacaatacagcatctccacaaaactccttacctgcacctacacctccacctacaccaccagcagtcactcctttgttaggatatggaggcgccatcttctgtactcctccagctacccccccaccaacaggtgttagcctgactatatctggagaaaacagcgttacattcctagaaaacattgcctccgaacaaggaggagccctctatggcaaaaagatctctatagattctaataaatctacaatatttcttggaaatacagctggaaaaggaggcgctattgctattcccgaatctggggagctctctctatccgcaaatcaaggtgatatcctctttaacaagaacctcagcatcactagtgggacacctactcgcaatagtattcacttcggaaaagatgccaagtttgccactctaggactacgcaaggctataccctatacttctatgatccgattacatctgatgatttatctctgcatccgcagccgctactgtggtcgtcaatcccaaagccagtgcagatggtgcgtattcagggactattgtcttttcaggagaaaccctcactgctaccgaagcagcaacccctgcaaatgctacatctacattaaaccaaaagctagaacttgaaggcggtactctcgctttaagaaacggtgctaccttaaatgttcataacttcacgcaagatgaaaagtccgtcgtcatcatggatgcagggaccacattagcaactacaaatggagctaataatactgacggtgctatcaccttaaacaagcttgtaatcaatctggattctttggatggcactaaagcggctgtcgttaatgtgcagagtaccaatggagctctcactatatccggaactttaggacttgtgaaaaactctcaagattgctgtgacaaccacgggatgtttaataaagatttacagcaagttccgattttagaactcaaagcgacttcaaatactgtaaccactacggacttcagtctcggcacaaacggctatcagcaatctccctatgggtatcaaggaacttgggagtttaccatagacacgacaacccatacggtcacaggaaattggaaaaaaaccggttatcttcctcatccggagcgtcttgctcccctcattcctaatagcctatgggcaaacgtcatagatttacgagctgtaagtcaagcgtcagcagctgatggcgaagatgtccctgggaagcaactgagcatcacaggaattacaaatttcttccatgcgaatcataccggtgatgcacgcagctaccgccatatgggtggaggctacctcatcaatacctacacacgcatcactccagatgctgcgttaagtctaggttttggacagctgtttacaaaatctaaggattacctcgtaggtcacggtcattctaacgtttatttcgctacagtatactctaacatcaccaagtctctgtttggatcatcgagattcttctcaggaggcacttctcgagttacctatagccgtagcaatgagaaagtaaagacttcatatacaaaattgcctaaagggcgctgctcttggagtaacaattgctggttaggagaactcgaagggaaccttcccatcactctctcttctcgcatcttaaacctcaagcagatcattccctttgtaaaagctgaagttgcttacgcgactcatgggggcatccaagaaaatacccctgaggggaggatttttggacacggtcatctactcaacgttgcagttcccgtaggcgtccgctttggtaaaaattctcataatcgaccagatttttacactataatcgtagcctatgctcctgatgtctatcgtcacaatcctgattgcgatacgacattacctattaatggagctacgtggacctctatagggaataatctaaccagaagtactttgctagtacaagcatccagccatacttcagtaaatgatgttctagagatcttcgggcactgtggatgtgatattcgcagaacctcccgtcaatatactctagatataggaagcaaattacgattttaaaccttatttaacgacagggttgaggcatgcctctttctttcaaatcttcatctttttgtctacttgcctgtttatgtagtgcaagttgcgcgtttgctgagactagactcggagggaactttgttcctccaattacgaatcagggtgaagagatcttactcacttcagattttgtttgttcaaacttcttgggggcgagtttttcaagttcctttatcaatagttccagcaatctctccttattagggaagggcctttccttaacgtttacctcttgtcaagctcctacaaatagtaactatgcgctactttctgccgcagagactctgaccttcaagaatttttcttctataaactttacagggaaccaatcgacaggacttggcggcctcatctacggaaaagatattgttttccaatctatcaaagatttgatcttcactacgaaccgtgttgcctattctccagcatctgtaactacgtcggcaactcccgcaatcactacagtaactacaggagcctctgctctccaacctacagactcactcactgtcgaaaacatatcccaatcgatcaagttttttgggaaccttgccaacttcggctctgcaattagcagttctcccacggcagtcgttaaattcatcaataacaccgctaccatgagcttctcccataactttacttcgtcaggaggcggcgtgatttatggaggaagctctctcctttttgaaaacaattctggatgcatcatcttcaccgccaactcctgtgtgaacagcttaaaaggcgtcaccccttcatcaggaacctatgctttaggaagtggcggagcatctgcatccctacgggaactttcgaattaaaaaacaatcaggggaagtgcaccttctcttataatggtacaccaaatgatgcgggtgcgatctacgccgaaacctgcaacatcgtagggaaccagggtgccttgctcctagatagcaacactgcagcgagaaatggcggagccatctgtgctaaagtgctcaatattcaaggacgcggtcctattgaattctctagaaaccgcgcggagaagggtggagctattttcataggcccctctgttggagaccctgcgaagcaaacatcgacacttacgattttggcttccgaaggtaatattgcgttccaaggaaacatgctcaatacaaaacctggaatccgcaatgccatcactgtagaagcagggggagagattgtgtctctatctgcacaaggaggctcacgtcttgtattttatgatcccattacacatagcctcccaaccacaagtccgtctaataaagacattacaatcaacgctaatggcgcttcaggatctgtagtctttacaagtaagggactctcctctacagaactcctgttgcctgccaacacgacaactatacttctaggaacagtcaagatcgctagtggagaactgaagattactgacaatgcggttgtcaatgttcttggcttcgctactcagggctcaggtcagcttaccctgggctctggaggaaccttagggctggcaacacccacgggagcacctgccgctgtagactttacgattggaaagttagcattcgatcctttttccttcctaaaaagagattttgtttcagcatcagtaaatgcaggcacaaaaaacgtcactttaacaggagctctggttcttgatgaacatgacgttacagatctttatgatatggtgtcattacaatctccagtagcaattcctatcgctgttttcaaaggagcaaccgttactaagacaggatttcctgatggggagattgcgactccaagccactacggctaccaaggaaagtggtcctacacatggtcccgtcccctgttaattccagctcctgatggaggatttcctggaggtccctctcctagcgcaaatactctctatgctgtatggaattcagacactctcgtgcgttctacctatatcttagatcccgagcgttacggagaaattgtcagcaacagcttatggatttccttcttaggaaatcaggcattctctgatattctccaagatgttcttttgatagatcatcccgggttgtccataaccgcgaaagctttaggagcctatgtcgaacacacaccaagacaaggacatgagggcttttcaggtcgctatggaggctaccaagtgcgctatctatgaactacacggaccacactacgttaggactttctttcgggcagctttatggaaaaactaacgccaacccctacgattcacgttgctcagaacaaatgtatttactctcgttctttggtcaattccctatcgtgactcaaaagagcgaggccttaatttcctggaaagcagcttatggttattccaaaaatcacctaaataccacctacctcagacctgacaaagctccaaaatctcaagggcaatggcataacaatagttactatgttcttatttctgcagaacatcctttcctaaactggtgtcttcttacaagacctctggctcaagcttgggatctttcaggttttatttccgcagaattcctaggtggttggcaaagtaagttcacagaaactggagatctgcaacgtagctttagtagaggtaaagggtacaatgtttccctaccgataggatgttcttctcaatggttcacaccatttaagaaggctccttctacactgaccatcaaacttgcctacaagcctgatatctatcgtgtcaaccctcacaatattgtgactgtcgtctcaaaccaagagagcacttcgatctcaggagcaaatctacgccgccacggtttgtttgtacaaatccatgatgtagtagatctcaccgaggacactcaggcctttctaaactatacctttgacgggaaaaatggatttacaaaccaccgagtgtctacaggactaaaatccacattttaaaactctaagctctgcttagagttttctgtagccccggtcgtcttagaatcctctatccatcatcgaagaacttagcaatgaaggccaagattctcactctatgagaacgcccccccctctctcaagtctatttgaaaagaaagaatatcttttgaatctatagtctgttttggaaagaagagaatacgatctgctttgcatccctagggaaagcatctttcatcaatgcgattacttcacgttgcaatggcttcacttgtttatgcatacgttaacaaggattatgaatccttgaaagactcgctctcctctcgattctcgtgtagaattcactccctaggttttatctttagagtctgcagcagatgaaactttaggattcagttcctcatcctcatcatcagaaatcaaagggtctttaccagaaatgggcaacacgtcactggggcataagaactctatttggctcgctaacttatcgaatgctgcacagttcacaatgagtgtatgctcttgagaggtacggacgatactactatcttctatgactatgccctgagaacttgtgtacggtatcatgtctaaatttgaaacgtaagatactaaagcatctgttactgaagcctctagagcttctctctcataagcaaaaagatccggattgcggaatctccacacagactgttttatcacggcgtctagagcaaaggctagatttttctctgtggagactgtgttgcagaggagtgctcctaactgctcttcagttaaagacccttgcattgtttgttcttgtttctctctgatctcctccgcgtaggcaatatgactggagacccaagggagatgctcatcatcgaaagcgaccactttacatcctgaagcataggcatcagcagcttctttttcacgagaaacaaaaattctttcggatgccaactgcaaattccgaatatcggggtgcccttcaggaagctctgagatcaccaccgtcatagatctcccttcatcggcattcaatagcagacgttgttgaactgtagtctccccggagagatcacaacgcactacattcagatagctatagccttcatcgctaagctcttcaataagctgagagactgcttcaggaggcaggccgaggatattaggttcagaatgattacaaacgacaactacgtctttctccttctcatcataggacactaaaagtaaaaagcgcagccacgactctacggaagtatcgttagcaaaatttagagatacctcacgaagctctttcttacttatgttcttagcatccacaaatgctgaaaataacaaaattttcagctcttcatgggtgagatctgcaagataggaatggcagtgagacccttgagataaaggagcatggagtcgttgccggttctaagagcaatccctgaaatcctgggctccaagtcccattcccaaagtatgcaactgatggtgtgtacgagaaatctctttataaagctctgtcttatccttttcggtatttataggtaaggaaagccgagatctatacctagatggcaatgtgtgcataacattcacccagggaacagtacctaacgaagtccctagggcctgctgtaaaattttaccctcccttaagtaagaatccttcccataacagccgaccataaggtcaaagtgtttcgtatcttcgccctcggcaccctgaggttccaagacggaaagacactgaacttcagaatgtagacctagagaacggagctgtttttccttatcagaggagatatcccctacccactcctnattaaaatcgataagaagatatagagttgtctttgatttgggatagagttgaatgacctcattcgccaagcgtactaaattctcttgttcttcaggactgacgagatctataccaacaatagctatagagtccaactgaggagtaggggcataactataggatctggtgatgcgattgcgaactctagaaaaggctttgccaagctcgctaacatgaactcccttatcgagtttaagaacctcactagaggccatatctgcataaggattctcttgatattgcccgtggactttatctagatcttcaacctcgatagttttcctaaggctctttagctgattttcgattctagaaatatgatctcggcccgcgatcttttctactttcagtataggagcaatatctgaagggaacccagggtgtgagactcccctctcgaagcaatgagagatcaaccaatcgactcccataacaagatgccctacaatggggatggccttaatcacccctaaagcgaagtgggtaattcgagaatataaaggacgtgagaaattaaacgcctgcacaaagtgatgacgaactacagaaaaccaaccatgtaagcaatgagtcataagaaatttacgtttagattcaaaagtacaaggaatttaaatgatgtgccaaaaatacaaaataaacaatttgtattagacatcaagtacactgaaaataaaacgctcttgttgagcacgttttcctaacaaatacgttatcgattcttaggggaaataggttctgacaattagatttgagagactctgttatgagagagagaccataggcacaaagacacgcctgtaaagcagagtatcctgattcaaagcttagacattgcgtatcgttatcctcaaaccgtcgaattttctttgtctctatttgttggctcctaagtgagcttcctcctctggaattggagatatttctgaaggagctctgctaagagtcgatcctagagattcaacagcttcatctaatgctgtgaaatctatagacaattgcgcggattgctgcgtttctagattcccctgaggatctttttttgcgttgttaggtagtgatgtacagtagtaaagagttgttcccctaacgcccgtctctcaatagagagaagttctggcatacgggatctccatatagactggcggattgcagcatctaaagaacaagcgaagttctgttgcgccgtcagctgattacaaacgtaaatctcgctctcgtcttgatccaaagcagcttcttgtttctgttttctaacttctcttttccaaagaccatgctttctattccacagattagattctcgctccaaagttaagacttcttccatcataaagttcgcgcatcctgacgtatagacatcgacagcatagcactctttaccacaaagcattccttcagacgccaaatgcaaacagcggatatctccttgagatactgaatcctcacagaaaatcatggtaaaggctttctcttgagaactttcatttaagatcctacgttcttctacacacatgctattagatctaaaggcaaaaatattgaagtgcgaataccctcgacactctagctccataataaagtgttggaagcttggctcctccttccagtcggtaccccaccaagaatcacatacaacgacaaccacattgcgatcacttctgctcatcctctcaaaaaagccaaagtgctgccttaagtaagttttgctatttaagataagatttagagatataggttgcagtatggtactgctcaactccttaggattcagaaatgccgctaaaattgttttttgtaacccgggattttctaagtctgcaaggtaggaatgacaataatgcccttcagataagggagcatgcacccgttttgggtccatcaagatccctgaccgactatctccaaaccccaaactaagaaccgaagagcgctctcctacgtataccaatcgagaatatagctgttctttttctaattcagagtactctagagctttctctttatctcccttcatctccaaagatgaaaatggagagaaatcccacaaggattgtgaaagaggcttttgccccacatgaatccaaggggtttcctcccctgacttttctaactcttcctgaatctgattcaacgtaccttgatcattctccccatgatacaccatccaacagtcacaagttgcttgtttgactacatcaccctgattaaagtccaaacaagcaatcttggggtttagttcgcaatcactaagtaacttccgattctttttgtccatagcattgcgaccaccagaagctgttagatatagagaaatcgtagcgtcaggatagagtctttgagtttcattacagagacgggctagatgcaagaagtcgtcaacttcaaaaggattcatatcgtttcctatgatgtaaatcttctgcagttttggccgtggagcttgcaaatacgcctgtcttacacgattacgaattttagagaaggcaagccctaacgttgcatcttgaacttcgggatagagagtgagaacttctacaggttggattcccccgaaaggatgcacaggaatcttcccatggaccttatcctcatcttcaggagccacagcgactctctgcctcttcaaagtctccactacacgagcaatgtgatcgcgaccagcaactttctctgttttcagaagactcaccacatcagagacaaatgtcggcttggtcacgaaactctctaaatacctagaaacgagccactctatcccaacaataatgtgacccacaacagggatccccttgatgacccctaatacaaattccgtaatacgagcacaaaacggcaaagaaaaatcaaaggctcgataaaagtgctcacgaactatagaaaaccaggcagataaacaagaagccataacacgactaggaagaaatacttaggaaagaagtatttaaaaaaaacttgaaaaaagcaatctctaagatacttagcgactcctatagccacaagaaattcgctatttttaaaattagaaagaggagacctgagaaaggttgtaaaaagcgcttagatacaactatttagaatcctatcctggaaatcagaaatctacggaatactagtgtagaaagaacaaatatagagagagtcctctaaggagtttgtgcactcctggggtttgtgaaattaagatattcctaggcaaacccttcctggaatcctaggtacatggaccaaggattccatctggagataagaaatttctctagtatttttactttctaactgccttcattttgcgaggaatcagggttactatctggattaggaacgggatgcgtaggatcattgcctgaatctgcagggacttcggctgggaggacttgcaccatgcgatctagctcttcgaagctgataacgacctcatgttcttcggtagttcttttccccatattctcattacgctcctgactccctaaataggaaaatatcgcagttaagaactcctcgcctagtgcctttctttccatagtaagaagacctttcgaacggaatctccagatcgcctgttttaccacagcatctagagaaaatacaaaattctgttgtgtagtgagcatgctgctcaattgatcctgagaataaattactggttctctggcttcttctcctgcttcatcttcgacacgtgcctcccattgtctatattcaatagcctgaggactctgcatctcagaaaactgaatgcaggaacatccagaggcacaaatatctgctacgctggggagatccttagcaaccataccttctgcagctagctgcaaacaacggaaatctgctgcactaatgggatcctcaaataagatcaatgtgaaagacttcccttcagaacgatctccaaagaactgacgttcttttacaatcattttccgtgatttataggagaaaatgttcaaatagctatatccagacatttgtaatcttctggtcagaatgttcattgagtcaggatcaagatcttctggacgaggagttccgtgggcaagggtaactatgtttctcccttcttgctgacccgcaacaaggcggaaaaataacgagtccaattctaatggcaatctagcgatattgaatgctacaggacgaagatcctcgctactaagattgccaggatctaggaaaggcgaaaggactaaagttcgtagatcctcattttctatatccgcaaggtaggaatgacaataatgcccttgggatagaggagcatagattctatctgggtccatcaggagtcctgcatcctctggttttaatcccaaaccaagcatatactcatggtgatacgatcgactcagttgtccgtacaaggaatccttatccccctcactttcagggagtcttggtggcgatgttgggtctgtagattgtcttgtatgtgagtatgaagtaaagtttggtgggtaataaaaatcctttgtgtcttcagtaacatgaatccaaggaattggatctgcactcttccctagacactgctgaatatactgcccgtctatattatgctgttgctctcgtgaataatagccaatccaaagttcgggattttcaggagagccagcgtcgtcttctttactgtctttgcactggattctagagtcgagacctgagttatgtaggtactgcttcttctctgcagtagttgtatcgcacatctgagattcgcgattcaagcctgtcaaatacagacaaactaacgcttcaggatgcagtctctgcgtttcattcgcgagactcacaaattgcgagaaatcttgaggagttttaagtttcgaacccacaatagaaatcgtacgtatttcgggtcggggggcctgtaagtacgcacgagtcacgcgcgtgcgaatcggagaaaatacagtatctaaagttccccctctttctcccggcttaagttttaaagtttcctcggattttaaacgaccaaaaggacagacaggaaacttcccatgcaccttatcttgattctcaggagttatggtccccctttctctttgcaatatctccgccactcgagatatatgatctcgacctaacgccttctcagtctttacaatctgaacgacatctgaggtaaaggaggacctagtaataatcccggcaacacaggaagaaactaaccactccatccccatgacaatatgtcctacaatagggatggccttgatgacccctaaagcaaaattcgtaaccctagaacaaaagggacgagagaaatcaaacgccttaacaaaatgctgtcgaacggtagaaatccaagaagaaatatagggaattggcatnncaacaaaaaaaataaaattagaaacaaacaattttaaataacaacatagaaaatatcaattaaattgaataaacagcttttaaatatttttagtattattttctttaataaactaataaccaactacttttgaagtcctagcttggatttaatatcctcatctaggggtaaaataagaaacagcccttagattcgagcagaaatttcagtcagattctattcaggaaaacctaagattgtttcagagtcaggagaattcgagattctgagggaatttagttttcagggagccctttgcaaggaacttttaaggtatcagacaaacgttactcatcttcgtgcatgtcagtcggagatgctgttgcccccgtagcggtcgaagctgctgttgcatcttcgtcatcatcagaagagcatctttcttgtagagcctgctctaaaggggtaaagtcgacagaaaacttaaagcttttcttggttctctgagatcccaaaatcccgaccatactctgaatatattcctctaagctgactttgatttctcttcctaaagcctgactttcaacataaaataaattgagtttctcttgtgatctccaaccggcctgtttaattacagcgtctaaagtaaataagaagttcttctgtgccacgattttatcacacatataggctctgaaatattctctgaaagaaacactaccttcttctctcaacttgtttgtagaagttctccaattcctgagcccaggatgcatttggattttcgtagactaagactttacatcccgaagcacatgcatccgcggcatcaagagaactggagactaaaatcctatccgaggctaattgtaaactacggatatcttcgctacctaaaggaagatctgtaatcatgacagtaaaggaccgtccttggagatctcgccttagaatctgacgttcctgaaccttggagactccttcggggctcaccgagagaatgtttagatacgaataccctgattctcttaagtcttcttctaatagagacaatgcctctggggacaatccttcttccagaagttttgcatcattacaaacaacagctacgtgcttttctttctcgtcgtgcagaacacgagatagaaactctgaccatctctgtccaaacgaagagttgccaaagtttatagagacagaacggaatgtttcgctagtgagatttttagggtctagaaacgttgacagaagggaacgacgtagctctttgttttgcaaatctaaaagataggaaggacacgagtacggtgaagataaaggcgcgcaaaccctatagggatccagaagccaccctgacagggaattctgaattcctagattcagcttataatgatccttaacagacataaacagagaacaatacgtggagaaggattccagcttattccatcttttctttttacctatttctggggaatgatcgcacggagagagcttctcttgttcttggtattgcacggaaatggaaggggtctcttctagagcaaagtttagaagatgttgtatcacctagggatcttggacttcctgatctttcccgtaacaggtaatcataaaatcgacagtagcgacttctggcactgaaggaagacctgcactcgtaagggatatactctctattttagggtctaaacctagagctcggagttgccctttttcctcttcagaaatttcacagtcccagacatctgccaagttcttcgctaaatagagcttcactttagtatggggatagtgattctgcacgccattagcaagacgcacgaaatttatgaggtccgcagaatctcggagaccaaaacccacaagagcaagatcttgaatcataggtttctctacggacctataggcataggttaacctactacgaacgccttgcagtgcctcatctacagtagagagttcttcaatcagggagaaggttggacaatttctgtgggtgtgatatctacgaagggatcttctggggttctcccgtgtactttgcctagatcttcttgggaaatggggactctcaagctacttaaataggcttctaggggagctaaacaattatgaccccgtgtttgttctactttaatagcactagagacatcagaagtaaacattccatgacgaacggtgtgtctgggaatccaggaaatcaaccactcgattcccatgacaatgtgtcctaatacgggaattgccttaatgatccccaaagcaaaatttgtaatccgagaacaaacgggatgggtgaaatcaaaggcgtttacaaaatgctgtcgaacgacagtaaaccaagaagaaatacttggacaagccacagtagaaatttatgtataaaaattttaacaaagttattttaatcaaataagacattaaaacaaataagtatctaattatgataataatatttttaaaaacgtttttatttgaaaaataaaaagtcagtgtaaagagttcaagctttcataaaatttttctatacaaaagaatcgtgggatacctaagagaaaaaacctcgataccctctatagacaactagacaataagaaccctcgataccttcaaaaaacccagaatgacctaagaaaaaagaagaatcttcaaaaaagagctctgctggactaataaaaaggttcatcaaaacaaacaccttagaaaggtgtgtctaattagttcccatcaatctgcgatttcgttcacaagattgcgatctttagtcatctgtattgttctcctcagaaggtgcatcttgagctgagtcacaagctgcacacacagcctcgtctaacgtagcaaaactcacattgacattacatgcgacttgaggctgtatagtcccctcaactaagagactgctgccgatataaccttctaaagcacgtcgcatgtcatctcctaaagcctgactttctacagcaaaaagatcccgttttttaaacttccacatggcctgttggattaccgcattgagattgaatacgatgtccttttctaaaactactctcgtagatgctgagacccctaaaggctctcctggaatcccctgacgttgaagatcgcctgccctgtcgatgtttctatagaacgacgcatactgttgcgcccactcttgctcgggatcctcatattctaagatcttacattcagaagcacaggcatcagcagcatcgagagcactaagaaactaagatcctatctgacgctagctgcaagttgcggatatccgaactcccttcaggaagatcagtgaggattacagtgaatgacctccccgaaggatcagaacttaaaattctacgttccttaacacacgtgcgttcctgactcactgaaacgatattcaaataagaataacctgactcttccagttcgttctctaatagagataaagaatgtgagggaaaactcttttttataagttgtggattattgcagactacagccacatgcttttctgtttcatcatgtagaacacgagatagaaactcagaccacctctgacccaaaggagagtttccaaagtttatggacataggacgcggatttccctgaccagaattgttgggatctataaaagcggataacaagaaacaacgaagctcttcactttttaaatctaagaggtatgaggggcaggaatactctccagataaaggagccgaaaccctaagaggatctaaaaatactccagaggcaaaatcttccattcccaagtgaacagcatatctatcacatctagggttagacagggtggtatacgtttgaagatgctcctgctcactccaagggatcctctgatcgggtgccgttcctccttgagaaccaggaaagaaatagtagctataaaaaggatcgtcaggtctataggttacagaaatcgcagggatatgttcggaagaaagattgagtagactctttatagagtccacgtctctgacggactgttgtttcccgtaataattaatgagaagatcacaggaaggcaagttctcggattgaagatatttctggagcaggagagcgggggccgacacacatttgattttagcatccaaacctagagagcggagttgctgttctttttcttgagaaatcgtaccgtcacactgattccatatcttttggatagagattaaataaagttttatttgagtttgggggtactgagtttgtatgccgttagccagacgaacgaaattcacctgatcttcgggatctaaaatgtcaaaaccgacgagcgtaagacaagggacttccagaggagtgactcgttgatacgccttggttactcggttgcggattccataaaacgcgcgacctagctctcccagatattgatgaggaaccatattcagattttcttggggagtcctgtcgcaaacataatctctggagaccttcccatggatttttcctaaatctccttcaggaagtcgaaccctaagctgtctcaagtactgttccacccaagcaaggggattataacctcgagttttttctattttcacgatactagcaacgtcagaagtaaatgccggtttcccaaaccttcgtgcagaacatgtggaaactagccaacttacccctataacaacgcatcctaaaatgggaatagccttgatgacccccaaagcaaaatttgtaatccgagaaccaagaggacgtgtaaaatcaaaagccctaataaaatgctgcttaactgtagatatccaaatagaaatatagcatgccataggatcaaaccaacattgaaaatgaaagcgtacgcaggctatataaagatttaaaaaaagatagaaaattaactatcttttaataagaacaacacgatagtttttatataaaaaattgaattctatcgcaactaattaagagtcttcaagatccgaaggatgatcatctgaaggatcctcagaggtagagggaacatcttcatcagaacctgggaagagcgcctctttaagaggagaacagtctgcgataatctctttttgtatgaacgggcctttcgatgttttttcgtgagagtttgtgacatattcaaggtacgatacgatagatggcaagcactgtgttttcaagtctagggcttcacactctttatctatcaagctgggatgtttatgagtccataccgcttgctttatagcggcgtctaacattggaatgaagtgtctcgtgacagtcactcgatcacagaatgctaagaatccttcccagaaggtttttgaagggagcgggagttctccagactctaggatcccttgattcgcctgcgtaatcagtttaaattctcttgagttaaatcctgctgatacgtctacagcatctgcgaaatcggcgtggcgactgaaagttccaggtctccaatttgtatgatcgattttcaagagcttgcatcttgcagcataggcatctacaagatcaaactctctagagaccatgatcctttcagaagcaagttgtaaactacgcatgtctgtatcccctagatataaagcgcaaatcactgtaaaataacgccctgaagttccctctaattccttacggaataaaagctgaggactactatctccgtgacaagaaaatatattgaggtaggagtagtccttagagttcaattcctctactaatttgcagacttgggttgcgggtaaggagagaactcctttaaaaaccacgacgacgttttttcccgtttcatcacgtaagaccatcgagaggaaatctttctgttgtagaggagaaaaagaatctccaacgtttatagagaccttgaggagttctcctgctgagatattctgaggatctaaaaacatcgataatattaaatcctttaaatgttgatccactagatctacaagatacgagtggcaatagtgatcctcagatagaggggcgcagagcattttttcatcgaaaaggaatccgagttcctcttcgagactgaaccatagacacggttggtaatgctcattcccacgagatagaaatgtgtatagctctttagcatcctgcccgactccttgtttcatcatagagtctacgaaagcattcgaggtctcatcaataggaattccgactgtggatatattgactctgggagttctacagtttggagttcccaggagctgctccgttttttcgtagggagaggacagctacgatctgtgtgcacgtagatggagagatcgaagggctcactctctggaacagcatcctcgctgaaaaacccacaacggatgtgcagattttctacatgtaattttgagagtacagcactttgatttacattcttgcccataaagaatcttaaatacatttgcgattcagaatagatacaactcatataagagattagccgctctaggatcttggaactttctgaatcgagaactcctatatagacgatggcaattctatgtaggtcgggttgcctagcacgactgtattctgtagtcacacggttgcgtagtggagcaaatatacgaaataaatttagagctgtcccctcagagaacaactgtaggaacttgagactttggatatcaaaaaaaaggagctgaaggcagatctccgcgaaccttcccctcgtctctaggctctaatgagagcctttgtctctttagaatatcttcaactcgacttctatggtcgtgacccacgacgtgttctactcgcacgatctgatccacatcggaaggaaattctggcttttttatcctagagaggagccagtccagccctacatacaactgcccaataataggaagcaatgcaatcactcccaaagcaaaattagaaattcgtgaacacagggagcgagtaaaatcaaatgctgcttgaaagtgctgttgcaccttcagataccaaagagaaaagtaataactcattaaaaatgagtcttttaaaaaatactttactttaaaaaacagaaaaaatctattattttctaataatcaaaatcagcaaaaatctataggaatagagataagtggctcttatgagtacaagtctccccgatggtcctttgtttttatctctaacagaccctcggtgtttcggaagagttcctagggcatcccctagggatataaggaggctctccgatcccaaacatcacaagctccctaaaggcaaacgaccctgagaaccaaaaactgctctaagcaaagtatgcaaagagcttgatcctctgactacttgctgccattttccaaagtatgatgtacgtttactaaaactcttggactcgcattttattgtgaaaaaaggaaattaaaatcgtcttgtcttaaataagataactttaaactactcataattagacactataaaacaaattatagacaaaaaatctagcattgatttattcagaatatttctttctatttgtgaacgagtatgcgctttttttgcttcggaatgttgcttccttttacttttgtattggctaatgaaggtctccaacttcctttggagacctatattacattaagtcctgaatatcaagcagcccctcaagtagggtttactcataaccaaaatcaagatctcgcaattgtcgggaatcacaatgatttcatcttggactataagtactatcggtcgaatggaggtgctcttacctgtaagaatcttctgatctctgaaaatatagggaatgtcttctttgagaagaatgtctgtcccaattctggcggggcaatttatgctgctcaaaattgcacgatctccaagaatcagaactatgcatttactacaaacttggtctctgacaatcctacagccactgcgggatcactattgggtggagctctctttgccataaattgctctattactaataacctaggacagggaactttcgttgacaatctcgctttaaataaggggggtgccctctatactgagacgaacttatctattaaagacaataaaggcccgatcataatcaagcagaatcgggcactaaattcggacagtttaggaggagggatttatagtgggaactctctaaatatagagggaaattctggagctatacagatcacaagcaactcttcaggatctgggggaggcatattttctacccaaacactcacgatctcctcgaataaaaaactcatagaaatcagtgaaaattccgcgttcgcaaataactatggatcgaacttcaatccaggaggaggaggtcttactaccaccttttgcacgatattgaacaaccgagaaggggtactctttaacaataaccaaagccagagcaacggtggagccattcatgcgaaatctatcattatcaaagaaaatggtcctgtatactttttaaataacactgcaactcggggaggggctctcctcaacttatcagcaggttctggaaacggaagcttcatcttatctgcagataatggagatattatctttaacaataatacggcctccaagcatgccctcaatcctccatacagaaacgccattcactcgactcctaatatgaatctgcaaataggagcccgtcccggctatcgagtgctgttctatgatcccatagaacatgagctcccttcctccttccccatactctttaatttcgaaaccggtcatacaggtacagttttattttcaggggaacatgtacaccagaactttaccgatgaaatgaatttcttttcctatttaaggaacacttcggaactacgtcaaggagtccttgctgttgaagatggtgcggggctggcctgctataagttcttccaacgaggaggcactctacttctaggtcaaggtgcggtgatcacgacagcaggaacgattcccacaccatcctcaacaccaacgacagtaggaagtactataactttaaatcacattgccattgaccttccttctattctttcttttcaagctcaggctccaaaaatttggatttaccccacaaaaacaggatctacctatactgaagattccaacccgacaatcacaatctcaggaactctcaccttacgcaacagcaacaacgaagatccctacgatagtctggatctctcgcactctcttgagaaagttccccttctttatattgtcgatgtcgctgcacaaaaaattaactcttcgcaactggatctatccacattaaattctggcgaacactatgggtatcaaggcatctggtcgacctattgggtagaaactacaacaatcacgaaccctacatctctactaggcgcgaatacaaaacacaagctgctctatgcaaactggtctcctctaggctaccgtcctcatcccgaacgtcgaggagaattcattacgaatgccttgtggcaatcggcatatacggctcttgcaggactccactccctctcctcctgggatgaagagaagggtcatgcagcttccctacaaggcattggtcttctggttcatcaaaaagacaaaaacggttttaagggatttcgtagtcatatgacaggttatagtgctaccaccgaagcaacctcttctcaaagtccgaatttctctttaggatttgctcagttcttctccaaagctaaagaacatgaatctcaaaatagcacgtcctctcaccactatttctctggaatgtgcatagaaaatactctcttcaaagagtggatacgtctatctgtgtctcttgcttatatgtttacctcggaacatacccatacaatgtatcagggtctcctggaagggaactctcagggatctttccacaaccataccttagcaggggctctctcctgtgttttcttacctcaacctcacggcgagtccctgcagatctatccctttattactgccttagccatccgaggaaatcttgctgcgtttcaagaatctggagaccatgctcgggaattttccctacaccgccccctaacggacgtctccctccctgtaggaatccgcgcttcttggaagaaccaccaccgagttcccctagtctggctcacagaaatttcctatcgctctactctctataggcaagatcctgaactccactcgaaattactgattagccaaggtacgtggacgacgcaggccactcctgtgacctacaatgctttagggatcaaagtgaaaaataccatgcaggtgtttcctaaagtcactctctccttagattactctgcggatatttcttcctccacgctgagtcactacttaaacgtggcgagtagaatgagattttaacaataagtgaccaaaacagaaagattaaggaacctctagtgtcaaagactcctcctaagtttttattctatctcgggaatttcacagcctgcatgttcgggatgactcctgcagtgtatagtttacaaacggactcccttgaaaagtttgctttagagagggatgaagagtttcgtacgagctttcctctcttagactctctctccactcttacaggattttctccaataactacgtttgttggaaatagacataattcctctcaagacattgtactttctaactacaagtctattgataacatccttcttctttggacatcggctgggggagctgtgtcctgtaataatttcttattatcaaatgttgaagaccatgccttcttcagtaaaaatctcgcgattgggactggaggcgcgattgcttgccagggagcctgcacaatcacgaagaatagaggaccccttatttttttcagcaatcgaggtcttaacaatgcgagtacaggaggagaaactcgtgggggtgcgattgcctgtaatggagacttcacgatttctcaaaatcaagggactttctactttgtcaacaattccgtcaacaactggggaggagccctctccaccaatggacactgccgcatccaaagcaacagggcacctctactcttttttaacaatacagcccctagtggagggggtgcgcttcgtagtgaaaatacaacgatctctgataacacgcgtcctatttattttaagaacaactgtgggaacaatggcggggccattcaaacaagcgttactgttgcgataaaaaataactccgggtcggtgattttcaataacaacacagcgttatctggttcgataaattcaggaaatggttcaggaggggcgatttatacaacaaacctatccatagacgataaccctggaactattcttttcaataataactactgcattcgcgatggcggagctatctgtacacaatttttgacaatcaaaaatagtggccacgtatatttcaccaacaatcaaggaaactggggaggtgctcttatgctcctacaggacagcacctgcctactcttcgcggaacaaggaaatatcgcatttcaaaataatgaggttttcctcaccacatttggtagatacaacgccatacattgtacaccaaatagcaacttacaacttggagctaataaggggtatacgactgctttttttgatcctatagaacaccaacatccaactacaaatcctctaatctttaatcccaatgcgaaccatcagggaacgatcttattttcttcagcctatatcccagaagcttctgactacgaaaataatttcattagcagctcgaaaaatacctctgaacttcgcaatggtgtcctctctatcgaggatcgtgcgggatggcaattctataagttcactcaaaaaggaggtatccttaaattagggcatgcggcgagtattgcaacaactgccaactctgagactccatcaactagtgtaggctcccaggtcatcattaataaccttgcgattaacctcccctcgatcttagcaaaaggaaaagctcctaccttgtggatccgtcctctacaatctagtgctcctttcacagaggacaataaccctacaattactttatcaggtcctctgacactcttaaatgaggaaaaccgcgatccctacgacagtatagatctctctgagcctttacaaaacattcatcttctttctttatcggatgtaacagcacgtcatatcaataccgataactttcatcctgaaagcttaaatgcgactgagcattacggttatcaaggcatctggtctccttattgggtagagacgataacaacaacaaataacgcttctatagagacggcaaacaccctctacagagctctgtatgccaattggactcccttaggatataaggtcaatcctgaataccaaggagatcttgctacgactcccctatggcaatcctttcatactatgttctctctattaagaagttataatcgaactggtgattctgatatcgagaggcctttcttagaaattcaagggattgccgacggcctctttgttcatcaaaatagcatccccggggctccaggattccgtatccaatctacagggtattccttacaagcatcctccgaaacttctttacatcagaaaatctccttaggttttgcacagttcttcacccgcactaaagaaatcggatcaagcaacaacgtctcggctcacaatacagtctcttcactttatgttgagcttccgtggttccaagaggcctttgcaacatccacagtgttagcgtatggctatggggaccatcacctccacagcctacatccctcacatcaagaacaggcagaagggacgtgttatagccatacattagcagcagctatcggctgttctttcccttggcaacagaaatcctatcttcacctcagcccgttcgttcaggcaattgcaatacgttctcaccaaacagcgttcgaagagattggtgacaatccccgaaagtttgtctctcaaaagcctttctataatctgaccttacctctaggaatccaaggaaaatggcagtcaaaattccacgtacctacagaatggactctagaactttcttacgaaccggtactctatcaacaaaatccccaaatcggtgtcacgctacttgcgagcggaggttcctgggatatcctaggccataactatgttcgcaatgctttagggtacaaagtccacaatcaaactgcgctcttccgttctctcgatctattcttggattaccaaggatcggtctcctcctcgacatctacgcaccatctccaagcaggaagtaccttaaaattctaaaataaaagaacgataaaattgaaatctttagaattaacaactatccgatgagctacgttagcccaatcggtagaggactccctcaaaatttaaatatagaaaatcattcaaatatatgagtttactaactctgtaatattcaacatgttaataagcatatttaaatataaatttataaacttctagacaacaaattgatgattttttatgacaaactctattttcatatcaaagtttggatgtttatgcgacccatttgtctcagcattttatccactgcgctatgttgttccttatcaggaaatgaagtccctaacctcgcctcttgtcagatgtctagaaaagacatctctgctttccacacgtctccaagcttccgtctgaatgtaactccagagcccttggtttcctcctttcgtccctctaatcttcttaatggattcggtcacgatataacccaggacatcacaattacaggaaactctatcaattctgttatagattataactaccactacgaggatggaggcattcttgcatgtaaaaatttgttcatttctgaaaataaaggaaacttaagttttgaaaggaatagctcccacagttctggaggggctctctacagtgttcgggaatgctggatttctaagaatcagaactactcgtttatttcaaatgcggcttccttagctactactacaacttcaggatttggtggggctatacatgcactagatagctatattacaaataacttaggagaaggacaattcttagataatgtctctaaaaatagaggaggagctatctatgttggggtgagtttatcaatcacagacaacttaggtcctatcgttatcaagaaaaatcaaacattagaagattccagctttggaggaggcatcttctgcagagccgtaaatatagaaaggaattatcaaaacatccaaatcaatgataatgcttcaggacaaggggtggtatattttctgccctaggagtcattatctcttcaaataaagaaattatagagatcagcaatcactccgcatcctcaattaacacagcatcaggaaaactatatcccggtggtggcggtatcatgtgtacctccttagtcattgagaacaatcccaaaggtcttatctttaacaataaaacggcagcacttagcggcggagctatacacacgagatctttcatcttccaaaataacggtccgacagcatttattaataactctgcgacttcaggaggggctctcatcaatctttctggtataggaagtactcctcaaaatttcttcctctctgcagactacggcgatattctatttaacaataatacaatcacatcttcttctcctcaacccggatatagaaatgcactctatgctgctccggggattaacttaaaactaggagcaagacagggttataaaattctcttttatgatcctatagatcacgatcagacgacaacagatcctatagtatttaattatgaaccccatcaccttggcaccgtgttgttttccggaatcaatgtagattctaacgcaacaaatccattgaacttcctatcaaaattttctaactcttcacgacttgaaaggggtgtgctcgctattgaagatcgggctgctatttcttgcaaaaccctatcgcaaactgggggcattctacgtttaggaaacgcagcattaatcaggacgaaaggcccgggaagctccataaattttaatgcaatcgcgatcaatcttccttctattttacaatcagaagcctcagctccaaagttctggatttatcctacattaacaggatccacctattctgaagacacttcttctactatcactctctcaggacccttgacttttctaaacgatgaaaatgaaaacccctatgatagcttagatctctctgaacctcgaaaggatatcccccctcctctacctcctcgatgtgactgcaaaaaaaatcgatacttcgaatctcattgtagaagccatgaacttagatgagcactatggatatcagggaatctggtctccctattggatggaaactacgactacaacaagctctacagtaccggaacagaccaatacaaaccacaggcagctctacgtagactggactcctgtaggataccgccctaacccggaacgtcacggagaatttattgctaataccttatggcagtctgcctataacgctctgttaggaatccgcatcttacctccacaaaacctcaaagagcatgaccttgaagcctctctgcaaggactcgggcttctaattaaccaacataatcgcgagggacgcaaaggcttccgaaaccatactacgggctatgcagcaacaacctcagcaaaaactgcagcacgacatagtttctctttaggattcgcacaaatgttctccaaaactagagaacgtcaatctccaagtacgacttcctcccacaactactttgcaggactccgcttcgacagtctcctcttcagggacttcatctctacagggctatccctaggttatagctacggagatcaccatatgctttgccactatacagaaatcttaaaagggtcgtccaaagccttctttaataaccacactttggtagcctctctagactgcacattcttaccagctagaatcacccgcactctcgaactccagccctttatcagtgccattgctctgcgctgttcccaggcctcgttccaagaaactggagaccatataagaaaattccatccaaaacatccccttacagatctttcctctcccataggcttccgttctgaatggaaaacttcacatcatatccccatgctatggactacggaaatatcctacgtacctaccctatacagaaaaaatccagaaatgttcacgacactactcatcagcaatggaacatggacaacacaagcaactcccgtctcctataattccgtagctgcaaaaataaaaaatacttcccaacttttctcaagagtaaccttatccttagattattcagctcaagtctcctcgtcaactgtaggtcaataccttaaagctgagagtcattgcacattttaaccacaaagaaaacatcaaggaataaacagtgcaaaataacagatcccttagtaaatcttccttctttgttggagccttaattttaggtaaaactacaatactccttaatgcgactccgttgtctgactattttgataatcaagcaaatcaactcacaacactcttccctctaattgatactcttactaacatgactccctactctcatagagcaacactttttggagttagggatgacactaaccaagacattgtcctcgatcaccagaattccatagaaagctggttcgaaaacttctctcaagacggcggtgctctctcttgcaaatcacttgccataacgaatacaaaaaaccaaattcttttcctaaatagctttgctattaaaagagctggtgcgatgtatgtgaatggtaatttcgatctttctgagaatcatggttccatcattttctctgggaatttaagctttcctaatgcaagtaatttcgctgatacttgtacagggggagctgttttatgttcgaaaaatgttacaatctcaaaaaatcaaagaaccgcatacttcattaacaacaaggcaaaatcttcaggaggagcaatccaagctgcaatcataaacattaaggacaacactggcccttgcctgttttttaataatgctgcaggcngaacagcggggggcgcgttgttcgctaatgcttgtagaattgagaataattctcagcctatctattttttgaataaccaatcaggtctgggtggtgcaataagagtacatcaagagtgcattcttacaaagaataccggttctgtgatcttcaacaataattttgccatggaagcggacatctctgctaaccattcctctggaggggctatctattgcattagttgttctataaaagacaacccaggaattgcagccttcgataataatactgcagcacgagatggaggtgctatctgtacacaatctctaactatacaagacagtggtcccgtctatttcacaaacaatcagggaacttggggcggcgctatcatgctccgtcaagatggtgcatgcactttatttgctgatcagggagatattattttttataataatagacacttcaaagatactttcagcaatcatgtttctgtaaactgcacgcgtaatgtctcattaacagttggagcaagtcaaggtcattctgctaccttctatgatcccatactacaaagatatactatacaaaactctatccaaaaatttaatcctaatccagaacacctcggaactatcttgttctcctcagcatatattccggatacatcgacttctcgtgatgacttcatttcacatttcagaaaccacattggactgtacaacggcacactcgctcttgaagatcgagcagagtggaaagtctataaatttgatcaatttggtgggactctacggttaggcagtagagctgtgttttctacaacagacgaagaacaaagtagcagtagtgtgggttctgtaattaacatcaataatcttgcaattaaccttccctctatcttaggcaacagagttgctcccaagctatggattcgccccacaggttcatcagcaccctatagcgaagataataaccctataatcaatctctcaggacctttgagcctactggatgacgagaacctagatccctatgatactgcagaccttgcccaacctatcgcagaagttcctcttctgtatctcttagacgtcacagctaaacatattaatacggataatttctaccctgagggtctaaatacaactcaacactacggctaccaaggcgtttggtccccttactggatcgaaacaatcacaacttctgatacctcttctgaagatactgtgaatactttacatcgccagctttatggtgattggacacctacaggatataaggtaaacccagaaaacaaaggagacattgccctatctgccttctggcaatctttccataacttatttgcgacactacgttatcaaacacagcaaggccaaatagcacctacagcttctggagaagctactcgactcttcgtgcatcaaaatagcaacaatgatgcgaaaggattccatatggaagctacgggttattctttgggaacaacctcaaacactgcttctaatcatagctttggtgtaaacttctcccaacttttcagtaatctctacgagagccactccgacaattccgtggcttcgcatacgacaactgtagcgctccagatcaataatccttggctgcaagagagattctctacatctgcatctctagcctacagctacagcaaccaccatatcaaagcatctggatattctggaaaaatacaaacggaaggcaaatgttatagtacgacattaaggggcggctctctcttgctctctatctctacaatggcgatcacgacctctccacttcactccttttatccaagcaattgccgttcgttctaatcaaactgcgtttcaagaaagtggagataaagctagaaaattttctgttcataaacccttatataacctgacagtccctctgggaattcagagcgcttgggaatccaagttccgtcttcctacctattggaacatagagcttgcttatcagcctgtcctctaccaacaaaatcctgaggtcaacgtgagtctagaatctagtggatcgtcatggctcctatcaggaaccacccttgctcgcaatgccattgcttttaaaggaagaaaccaaatttttatcttccctaaactttcggtgttcttagactatcaaggctcggtatcctcatcaacgacgacacattaccttcacgcaggaacgacctttaagttttaaaagcatgttatatagacaatgcaacctgtaaagaccaaatagagagtagtgaacactctctaccatcatgaatcttatgggagaagctaagggaaatccacagatacgtttcccccataaaaattaagaacccgatacatcctcactagagattcgaaagaactacttaaatcctaagcattcgactctccacgaggccatcctttttgtagtaagattttcgttgtagctacaagtccccctaagggctctagatattctgattctccgtcccccggctctgttggaggaacaatactctctgcttcgaccataacagcactcacgctctcgctaagcaaagcggctcttacttctggtccaaaccctgggctcactctaagcgaaacattagtcaatgtattctcgggtcttggaagtgtagcagggggcctgccatgaatccatgggatctcatcataaataggctctacaggagaagcggaagcaccgcctgacctctcctgtaaaattctatctatatttctctgagtaaatggattatcttcaggagtattagcatatatgggttcatccaagtcgcctctaggagagggggaacggctcatatcttcataatcactttcacctgcacctgaagcaccgctcatatcctcataaatgctcccctcctcactcatagcaggtgaaggaactggaggaagaggcacaccccgtctatttggtgagctgcttcgtacgcgatctgaagacggagaacgtgagcttccagacgatcctggacgtgaaggaagatcatagatagcaggagttgctaatctaggtgtcatgtagatgttcttgtctttagatggttcagcagaggttataggaacttcataatctccaaaaacatcctcttccaactctcgcgcaggactccatctaggggaactaggaacgtcatagattccatcttttctacgaggaacatcatagaaaatatgatcatcttccataacaataaaactgacggaactgtcttgactccaacctctcactatgggagcagaaatcgaaatttccggggtacttgattctgaactctccttggttttagcaccgtgcttatgtgcccatcctactaaggcattcatcaatggagaatcttcacgtggacttccatttctgcgtggaacgtcatgcggagagcccgttctttcagtttcatcaatttctgaaggagaccccaccgacatcgagtcctcttcagaagaagtacactcttctcctcggcacgtgcaacaacgacccactgcttcagcagctgcatgacgagcaatacgcaacctgtgcaagatggaccctagaatgcttaaaatcattcctaaaagagaaaccagagcctcgcgaatctgattccataatcttgtagaccagttttcccgagttctttgaggatctgcagctcctccgatttcctcataaataggctcttcttgagaaatcagagttggattattgtctatcggagttggattatcgtctaaagaaaaactcaatcgagcatgggacaaagcagcttctaaatcgtcggcagtctcatctaataggttttgaagagagtctccatcactcatgagttcttgaagctcaggatctgtcagttctgaacagagggaattgatctcatcactagtttctacccccttaaaacgagcttctgctagagataccgaagattgtgttgcctccatatagccgcattggaattctgtaatttggatcagctgttgtatggtaactgtggcttctgctttttcctctggagtcaactgatcattactttgtatgtcagagagctcctgacgtaaactactcaaacggaggtttagctcgtagagacttaaaggctcgctgtctgtaggtggagccccactaggaagtactatgcgatcgcgaactgtctgtaccaaccgacccaaaccgctctgtttttttactgaaggaagagaaaataaacgctgaggttctggtccagaagaggtttctggaaccccctgagaaggattttcgcctgaaacactcgcgtcctctgccactcgggcttctgtagcagcagcacttgatgaatcgacatcccgtctctcatccgcggtgatggtttttgataatctaacaaaagcttgtcgcgtttcacgcgcttgactcgtagactctgcggaaaaaaagttgccaaatgattttaaggccctgtctaccccagaacgtacgcgagaaaaaaatcccgggctagaagctgccgaagaagagctctgagactcctgatcttctggtagaaaagaggaactgctatgtatatgcgaagatcctgaagctccttcctctccatgttcttgaggaggcagggaaatctcgtggctgccaagttctcccttaggagagggcgatcgacttctatccccattatctttaggtggaatctttcctaatccactagatcctccgattcctgatgccataaacacttcctaaaaagaataatcttttttctgaaacaatttaattttattaaaaaacaacaaaaatgcttttaaatatattaaaataatcaacatattgaagagttttaattaaaactcttcaagtttcccttgcgcatagagaaacagtgagataacgactactgtccctctggagcaaatgatctagctaatcctaagccttgttgaatgacaggatcagtcacattgcctgattccaatttttcaagactctgggcatttctgttactcatttctgcagctctacgagcgatctcttccgcaaaagataagctaggtgcagccgatggatttgaaacgccctcttgctccacaaaccattgtgtattactttctgatgcaagatcatctacagctgattcacgtcgtgctgaacttaatcttgaagcaattgccctaaagaagctcgctaccgcttggaatatgctaactacaaaatcccgtaacgctttccatgctccctgcgctgcagatccctctaccccacctgtttcgggagcttccgcagtctctgctggggcttgcgatccatcttgaggtacgatggatgcatactccacagaatcactacctacattggattctacgaaagtaataagatcctccacagtaggaggttcctgatgagtcaattgctccatgcgtgcaagaagagattgcaccctagaagccacctctggtgacacttgttctggagctactttttccaaattttctaaagccttacgcagatgttttgctgctttattcacattagaaagatcaccttccgatgaagaacgttggaatctagttctgatattccctggtgctgatctgattgcacctgcagcctgctctccgaacgccgaaaccttctctttagcgtcacctaaggctccctgaactgtagacgtcgctcctcgaactcctgataaaaaagaagaactcttcgaagaagcctctgcttcttcggaacgcctttcttttacagtatcgccggcagaatcttcgccctgagttgttaaatcatcttcggaagcagaacgctggaactttcctttaatatcacctagggcaccatgaactttagacaccgctcctcgaactcctgataagaaggaagaactctttgaagaaggctctcctccttcagaacggctatcctctgtagaatcttcattagaatcgtgtcctactcgatcaaggtcaccatcagaataggaacgtttcatcttccctaaatctgcctctggattttcagatcttttctggatacgatctctaaagccctcgagtccaggaagacgttggccatgttgcacatgggatggaagacgtggactagaaacttcaggacgcgcttgaggggtttttttaaagacccctttaacgcctttccaaattctctgaagtaccccagaacgtcctgaagttggagaatctccgggttctttgacagatggcaaaggaattttatcagtcccgcctaactgggcttttctctcttctattgtagggccctgacttgcaagactactgtcactactgctaactgtatgttcccctaagttgtctttaggacttacttttccatcctcactattccttctattaggaggaatgggggaaggagatcttgagccgcctacgccaccaactgccataattgaaccttaaaatgataaattatttaataaaaactattaaacaaatgttaaaataaaaaatattttaaaaacaaaatataaattaaaataaacaaaaagaatgctgattatataattaagtaaactactagatgtaaaagagaaaataaaattagagaaggcagacaagctcccaaagctcgaggatcttacattcaaggacctggcctaagcagctccatctatatctacatccacatcaataaaatctacgggaccatcaagatcaaatagatgatcgtggctagcagcaagagcctcaacaactaaatccgtagcaatggagcgcattttactttcaggaccatagagaagctcacggcgattacgtcgacgctcatagagcttcacaagctcatcatagagccagttgacaaacttcctcattaaaatcgatcccgcgattcctaacgtcgatcctccaagagcaagaataccaggaacgataggagcaaatgcagggaccagggcaagaagcatgatcccagttcctacaccaagtaagattccaccaacaagggcgctgttcacttccccacccttctcaaaattgcgaacctcttcacgaattgcagcgtcagtcttctgaatctgttttttgtagactgtcttccacatttggttaaattctcgatccgaggcaatcactccagactcaattaagaactggcgcacccgctttttattttttgcttctttccaacgtaatttactgatattcaatcttgctttcagttggtaggcgacgtaggaaaatcctgaggaaaccatagggagtgttacagaagcaaccgccgatcctacagaagcaacaaggagaacttgcatgactgtcaatccaccaaatcccgtgactatgaaggcagcaatacttgctaagagcaagagtgtcgcaagagcaaagatgaccttctgtcttgtcgtcagggaaagcctcgtatcgatttcttccgcagagatcctcgtctctgcaatcccctctgaatctggaacttctatcacagattgggaagtttcactctcttccacctcactggggggcaatttttctaagcgaatgtctttcagggaggtgtctacaaaaagatcttttttttcttgagtaagcagaaaggctctccactttccgatactactatggagtatcgtttgcaaaaccgtcgtaagccctatagaaattaaagggggagctaaaataatagcaatcgttgcgggagcgcctcctagcaataccgttcctgcaatggcaaggagaatccccaaaaccgcaagaccaacgccaatagtggcaattgacaacgtgatatagtgtaattttttcgcctcttttatagtttctgcttctgtaagcttctcccctttagcaactttttcagaacggaaaaacttagtataaatataatgactgaagcttgctaatgtggtttggcttccccgggaatacgcactggatcccaagctacccacgagacccccataccctccaggaacaaaattcgcccccaccttcatgaccaaacccatgacagtaaatccagtccctacagctaaagcacttttgattctgctcgactcctgcatcctgggggacatatagtctcggaccatataaaccaagctcttcattatagaaaatccaccaatacccacgcctgaaatggcgattccaagaagaatagcctgaggaactccgggagctaagacggtcaaagcgacaacaacaacagaaaccgctaccagcaaaacaaccaggccagcaaataaagtcacggaatgggtgaaaatactttttcgcaatcctgtatcttcaggattgctaggaactagggaatttggtactggcgagagactccggctatttgcaagaagagaagttttctcagttgcattagacaaagacaaatatcggggatcgttgctaattggtgatgtagacataaaagaaatactaataattatttttaattataaaataaattattaatatcaactacaccacaaaatagaacaatcccacaacaatttacaaataaagtatttaaatttttagaaaaaagtaactaaatagatcacagtagctaaaggagggagctctatatccaaaccccaagcgaccccttggtcttgacagaccacaggagcccgatttcccttccctgagcctccaaaagactcatcatcagtgttgagaaggagttcacaatgctttacaccttcacaccttaaaacataggaaggaaaagtactcgcactgaaatgatggacacagagaagcgccgaagaacgattgctgcctgcaaatctataataggcaatgacattgttttctatatcatggaagtctacccaatggaagcactcttgagagctctcttgcatccataaatagggttggtgaatatacaacgcattcaatgcagagacacagtttcgcaaagttttgtggtagtgatgattcaaaagctcccaatctaagggacgatcaggagaccactcgccgtattgtccgaattccccacccatgaacagtaactttttcccaggcaaacagatctggtagctcaagagcactctcatttgagcaaatcgggtccaggtatccccgggaagcttattcactaagctgcccttaccgtggaccacctcgtcatgcgagagaggaagaataaaagactcttggaaggcataccaaaggctaaatgtcagatctttctgatggtatttacgatacatgggatccttcataaagtaatgaaaggtatcgtgcatccaacctaagttccatttgtaatcaaaccccagacctccctgatctacgtccttagtgactcctggaaacgctgtggattcctctgcaaaggtgagcactccagagaactccttatgaattacagaatttaagtgtttcaaaaattctatagactctaagttctccttacctccatagatgttaggcgtccattctccatcttcacggccataatcacgatacagcatagaggccacagcatccacacgtaagccatcaatatgcatcttatcgagccaaaataaagcactccctagtaaaaagttggtcacttcatgacgactgtagtcaaaggtaaacgtattccagtggggatgaagagcctgactatgccccgtgtactcgtagagaggctccccatcaaaagaggcaagagcaaacgcatctacgggaaaatgtcccggcacccaatctaaaataataccaatattttctttatgtagatagtctacaaaatactgaaactcctggagagtcccgtatcttgatgttggagcataatatcccgtcacttgatagccccaagattcattcaggggatgctccgtaatgggaagaagctccacatgagtgtagtgcatttccttgcaatagctagcaaggcgatgcgccatttcgctgtagcttaagggccttccctcctgccattgccaagagcctaagtgcacttcatagatcgtgacgggcccttcactctgcttcgagcgcctctccatccaacgatgatcactccaagagtagctctcagaatccgcaacacgagctgtaccctggggtggaggatcaaagctcttcccataaggatctgtttttacaatcacattccccgattgggtaacgatttcccacttataccgtattccctctcccaagcctgggacgaaaagctcccagatcccctgatcggaaattttacgtagaggattgacaaggccatgccaaaaattaaaatctccgactacagagactctctgcgcatggggagcccaaagaacaaagagcacccctgagattccttgaacttccatagggattgcccccatgcgttcataaatgcggtaatgcgttcctctatggaataaaaaagaatcaatttctccccacagaggaggaaacgcatagggatcatgagcgagaagtccattctgatgatacacacggtaatccccgtgtccgattcctttgggaacggataagaaaaagagccccgaacgataagctacagcgtggtgaagctctcctagaagttcaatagcaaccgtatgcgcccctggacgaaaaataacaatatgatctgaagaatcttcagaagcaaggatccctaagagtttatggggatctttctgtcgtcctgagacgagcagatcaagatcccaaggatggatcagtttatcaaccatggaaggctatctatttatgaaaacaatcccataaatatgtggttcctgcttttatctccagagtttctcctaaagaaagtctcttagatccagagagacgtcgctccgaccattcccgaaggcgcgcactgcatagtgaagaacaaaactttaaaaatacctcgccactatattctgcatggagctcgacctgacggatagttttcttagtccagacgatagacaaagtcccaagattaggaagggcaacatgaatcaagcggccacaaggaaattcaggaggtaatgcaggaaggatctctactagctgtccctggtgtctcagaaaaatatcttggatcataccaaagctatacgagagaagctcaaaaggaactcccccctctggatctccatcttgggggaggattccttggaactcttcatcatagctcctaggaagaaagcactctgaaaatcccgcaagggctatggagagtaacgcaggagcaatctctgtagtttccctatgtaaaactctttgatgggcagtctttaccaagctaccgatagccgtcgtctctagatcccgataggatcccttaggagccatagcggcgaaacggaaccataggggaagaatttctttaagatcacgacgacaacggaccttttgccaatctgcatgcttatgcaccccaagagataacaggggccctgcttgcgctgccgaaggcagtttccctttgatagattgtgtgcactctcccgagggaaggagataatacttgtagcgctcagaagtcactgcaagccccccacgatgtaaatcttggaaaacagcaaagcgttttaaaggcccttgcacctgtaaggtctgctcatttaagatttcgtgtttcgaagaaaatagacgccacagggtaggaaatacctgagcatataacaaagatccaggaatagggagtttttgtcctgggaccatagtatagggcttaaaatgttgcattatatctatcatacaatctccccaatcagcccttcttcctctaccctatcaagacgcacagaaactagagtgttgatagctaccgttcctacaacagggaaagaaaccttttcaaaataaggagagtgacccgtagcaacctgccccgttactttctcaacaagcacctctgtagtctctcctaaacgcttcatcatctctttctggcctaccctcttagcaacctcagcaagatacttcttcctctcatagatcacctgattgggaatctgattatcaaaagtatatgccttagtacgacgacgagcactgaaagggaaactatgcactttaataaagcctacatcttcaataattctcaaagtatcttcaaaatcttgatcactctctccaggaaatccgacaatcacatctgtagtaaaggcatagcgaggatcagaagcacggaacttctctacacaatctaaaaaatctccgcgagaatacttccggttcattctctttaaaattgaattcgaccccgattgaagaacaaggtgtgacgaaggacaagtgtgacgcgatgaggtgatggcacggtgcagatcttcagtgatatcatcaggatctatagaggaaattcgaatcctctcaattccaggaatctggtccacctgttcaatcaaagaggctaatgaacgctctccatcgcaataatctccaacattaattcctgcaattacaacttcgcgatatccttggtctacaacccctgcgatttcagctaaaatcttctcagcaggacgagaaaccgaacgcccccgcaaataaggaataatgcagtacgagcaaaaagaattacagccatcttgaactttaataaaagctcgagactttccctcaaaactatggatcttgaactcagggaaggtcgtatcataggaaaaaattttttctataagtcgggatttttctttattggaaacaagcgtgcattgccgatccaaagaagcaaaaaactctttgtcagattcccccaaacaacctgtgacaacaatatgtgctgtagggttctgacgacataactgacgcacagcatgacgacccgaactctcagcagaagctgtgacagcacacgtattgattatgcataaatctgcagggatttcagaatccaggacctcttggtaacctaagatagtcaactggtcgcgatatgcttggacctcatactgattcacccgacagcctaaacagaccagcttaaatgttcctttgacttccgcaaccgtcatatacctctagagacttcaatagatttagcgatgagtggctattttaaaatatcactctttttctcactaacaaagattcgatgtcctagaagaaaactacctaatccccgaaagaactctccaagacgggccctctaccctcgtcatctccacaatcttcagggaaaacataagaaataaaaggacgaaatttcttttgcagctccttaggaagatacgcttcaacaactaaaaaatcttcttgataccttgacgaggccacaaccccggcatcgcaaagttccgtaaattttccatattctgtataaggaaaattcaaagtcacatgcaaacttttctcctgaatgatttccgtcataagactaagaagattctggatcccctccccagtttttgctgaaatcaatacaggaagaggagagagcaaacgtaatttcatagggatacttccttgaggaagccgatctaccttattcaacacagtaatgatcctaggcttttcaatcttcaactcttgaaagagatcgtaggtcgtctgtacatgctctaaagctaaaggatgcgaagcatcgacaacatgcagaagaacatcttcatggaaagctgcttctaaagtacttttaaatgctgctaccaaagtatgaggaagttttcgaatgaagcctacagtatcagtaagaaggacatgacggcctcctggaagtacgcatttgcgcgttttgggatctaaagttgcaaatagcttgtcttcaacatacgtatcagcagccgtcagcaaatttaatagggtgctcttccctgaatttgtataccctatcaaagcaaaggtaggaattcctcgtcgagattttactttacggcgttccgcacgctgtttgatcacagctttcagctgtgctgacagcttatggatacgctcacggaccattctacggtctagctcgatctgtttttctccttcccccttaacaaagcctccgctacctcccccagatttttgccgagataggtgcccccaaagtctcttaagacgaggaaggagataacgtgcttgtgcaagttggacttggatatttgcctctgcagtaagggcacggctggaaaagatttccaaaattaactccgtcctatccaaaacgacaaggccaaggcgtttctctaaattccgttgttgggatggagtgatctcctcatctatgatcaaagtccctatagagggaaactctttcaagatttcttcgatctcctccaacttccccacattgatataggtggaagctgagggtgtttttaaaatccaagaacgggtctctaaaacagaaataccacaggaatccgcaagtgagatcaactcgtctaaatgttcttcaacgacctgagaatctgtcttattttgataggaagccacagctaaagcttgagagggatcctgttccttacgaggcaagtcgaacctggcccctaacgaatttccgaaagattgagaaccctgttccccgggcgtatctatagtgtccaaaggacctccatgccatcataagcaaatgtgacctctggatgctggtcacgctctgcttctaaacagtggctgatatgtgtaataattaaattctttatccctgcatgattcgcaaaagctttggcttcttctacagtaagatgcgaagatttgtgtccctgaaaaggaataggagtttccgatggacccgcagacaagatcaatgtctctacattatctaagtaactgaaaatttttgcatcatagctacagagatctgtaagataagcaagatttccaaaacgaaaacccgttacatggcacgacttttgataataggaaacataagtatagggaatgccctgaaattcctcctgcccacagtcctcattcaagattgtaaactctaaaactgcgggaagtgaagactctacattcggagtggcgaagagatactctttagccttgtttaaaaatctataggtgcttgcagaaaggaccaaaggcaacgaacgctgcgtgactatgtaccacgcacgtaaatcatcaataccaccgatatgatcgtagtggggatgggtcagaaataccccatcgagctcggaaacccctgcaactaacatctgcgtacgaaaatcagggcctgcgtcaatcactagagtcttgttttgatattgaatgagtaccgaagatcgtaaacgatgaatccctgtgttttgacacactctacatgagcaaaacggcacgggaattccttcgggatttcctgtgcctaaaaatactaatttccctatagattcactctgaatatctcttaccataccaattgctcatctggaaacacaagcaaacaaaaataattagtcagtctcttaactttggatcttaaagtcaagaagttgctagaaccccaatttagaatcctctatagctttttaaaccatagtttccaagtatctatccttaaaaattttcgagagggatctcgtgcagcgcagtaaaagattcatgagaaaatgtgagaaataactgacgaacacgcttagttatctctgcgtgatccattaggtaactttgtaatcggttgagataatgcacaggttgcaggatactctgtgatcacagaatagttttgggaatgtgcctgtatctgacgacaatgacattgcgttatatattcgtgtgaaagattgagccactcacggactctccctcttcccaagtacgccatcaagatcgcaaacaagcataaaatggcaccaacccctccaatgatacagggaatcacccaagcacttaatcccgcaatcaaaggggcttcaaccattaccccgacaatcagacctgcaaaaatacacaacccaccaaagacccaactcacaatagagcagatgtcaaaattccttacttgagaacagagctcgtacattgcagactccagctgcggagctcccttacccacgggctccaaagcccataaagaagtaatggggccatgtacgggtaggccttgaaatttatgttgcttacaacgcaagacctgcaagatacctgtaggaggagccccttgcacatcaactacaataacaggaacaacatagggactaacgacctcagcacataactgacaatagaaatacctatttttgtattcttcaatattgccagcaccaggataacatggcaaagaacctaacatgcaatcttgttccttctttgatacaaattcacctagtctcccagagattccccaagaaattcnntcatccgattaaagacaggaaaagattcaaataaaggcaatgctcctaaccacattctttggggaacggctgtcaaatacatcaaagctttcaatccttgaaacgacacgccctgtgctgccaagccatgaacaagcataaccgcagcctgttcacttaaaacatctctaggattcaatactttttgtccagactgtaaacgactcgcaaattgagataacatagaatccaagccttgcaaacaaacggtgtaatcggcctgatcttctagagagatttcggtaccgcgaacacagtctagcaaaacagcccaatctatcaaataggataaaggatattcatacaaactgcagaggaaccctgactcattttctaagatttcagtgttcgaaagaatctgctcacgaatctgcctacgatctacccgtaccacagaaccatatttgtcaaagagccgcttcatagcaggaacagaagaagaaaaagcaataaataggttgtctaatctttgatttgcgctctcataacatttttctccctcagcacagttatatccccaatctaaggacattgcgtttatcaaatcgagcttctgaaaatagcgagagagaaatgtttgtatttgtgcttcatagcgggcgacatcgatcgctgtctctgggagctttctttgcaagctctctagatggcgatgtaaaaacttctcaaaaaatgaagacgaccaaatgtaggtaagaaaagaatcctttaagaagcgtctgtcgggattttccaacgccaaaagaagatcgaattgcgccaaagcatcctcaggagaacattcttctctgcgacagctaaataccccgtctgcgtctacactaaaggaacctgaatctgcccaatccatcaaaggagacgttgcttgtaaagcatctccgtagcgaatcaatttcaaaatatcaggagagtaatactgctcttctatcaaaaagagtagaagttcctcggcgtgcgcagtgacttcaggactaagatccactcccagtaagttccactgtctcactaaatgtaaaatgatattgatgtggacacaatctttctttaacagcgaaagtgtcgtagataggggctcaagtttcaatatattttgtaaactctgatcaatatctaaagatcgatccttagaatcaacaatcagagattcgtggagatcccctcgtaagaacaaggaaatcaactcggaacgccaatactcattccctaagacatcttgttgtgtagtccactccttttgcgcaacaatttctggaggagtcgcttctcgactaggttctaaagtcttgcctaaaacgagaccggagacagcaaaaacgatagctaagcttaaaagtaaacatccaagagcaaacccgaggaccacagcccacaatccgacctgtgggaaaatgacaatcatagcaataaaaattaaacagctcaaagcccctaggactaaagctgcgtaatacattcgcgatgttcgttcagtaaatctttcgttggaggagttagcctctcctacagaagtagatgaagttacaggaacagaggttgccataagaataccctctattcgtaagcaacttcagaaagttgccatttcttggttaaagattgaatcaccccttcgctctttaaatctgtaatcgcttgttgaatcgtttgtatttcttcaggacgatctttagtacgccgagaccacagcccaacacccaacattcaggagggagctctaatcttgttgcaacaagattagggaagtctttaagaacgacacgtcctaccgagggttctagaacggcaaccggagatttcccataacgaacttccataatcacctccaaggtgctatcaaaagaacggacacaaattccgggctgagataaaagataatgctcctgaaacgttcctgtctgaacagcaacagaagaatgctgtgttaggggaagcacaggggtctctaaagaccgcttagaaaccaccatcagctcttgaacctcatcgccataatagggaagcagggcgatttccttctgacgcgaaggagtaatggacattcctgctaaaattgcatcgatacgatgtttttttaaatttaaaattaaagcatcgaaagcgaattctctaacttccaattgcttgccaagtttttcactaattgcctttgccaaatctatatcgaaacctacaacttccccctgagcatccacatactcaaaaggaggatatgtagcattcgtacctacaatccagatgcgatttcgatcgattttagactcacaacttgttaaagataaaggcattataaaaataaatgctctaaaaaaacggcctatttgttttatcatgaaagtttgcgctctatacgctaaattctatcatgtgttaaagtttacataacaaaaataaatacatcaaactcgaaaaagttttaactttgaataattttgattaaaaaacgagcaatttttgaacgtatgtttccaattcccccaccacattgcccgcccaataacaagaataatttttaccacttaacgactgatactaaagaccctctgttacttagaattctacgtaccataggatacgttctgctccatatcattactcttggtttgcttcttctgattcactactacaagcatcatcgggttgtcagaaaagaaggcttgccaacgcctcccactcttcccaaaggaccagagccaaaaactatagaaattgccaaacaaccgcctaaggatggtgaagacaaaaaacccgatgttcccaagccgggcacgccgcccccagaggacacacccccgcctccccccaaagctccttcaccagcgagcccaaaagtccctaaaacaacctgctgataaaaagccgactccaccaccagaggcccctcctcctcccgtacgggtggctacccccatgcctctccgcccatctagtcaaggctattggcaatgcttaaatcgcatggtgagcatggtactaagacgagcgcctctgcctcttcctgccatgcaagttgatccaatacttggcgactttaaccctcatttcgtagcttcctatcccaatcggattaataacgaaccgatgtatttccaaataaaacagttcaagaaaatcgcacaaaatccggatcttcctcaacaacaccggcgacttgcgcaactctctcttgaacaggctctctatctaaatgacaattactaccttgtgaatgtaccgggagatgggaactgcttttatcgtgcctatgctgtaggatggctatctgctctctacgaagagagcagcagaaatgatattgtctttgagcaggaagccacacgtctccttgacctgcctttcgcctcctcttctccggcaaatgcgaatctttgtgcagaaatggctgaactccttcagttatgcagtacttattgctccttcatagacctctatgacggggtgattctttctcagaaacacactgcaactctgatagcctttctaagaaaactctctgcatatgcgattcgccaacaaatcgcagcttcaagtaatgaagaaacagcgagagccttatttatttctgatatgcaggacgatctcctccccagtgttctggaatttcttgctgcaaatcgtccctattcggaattgttccaaaatctcattgatcattccgcacaccctacatgcaatctagagacaaactctttcttctcttggaacatctgcccgctctctttcttactgatgcagagcttcaaaagatgtctccagaagatcaacaacttcgaaagcaatatgaaagagaaatacgagaggcttttgctaagctgagtcgacgcattgctgattcagggtgggatactgagagattcaatgctatagtcaaagatcacctccctgaagcaatccgatgtcaatactctcgctttcttgcaactatagaaaacagacgatctggggatctcccttggtctccagctctttctttctttgcttttctatgtacctgcccctctgtaagatttcacaaactctgcgctactttctacaaatcattagaggatatcattatagcgtccgcgcccccccaacgctctatacaagagatcttacanataagtaacgcctccctcagctaccttaatgaagatttagattcttcttggcaacgagaggtgatttcttctaacatcatgactatccttacgactcatgagagtttgacgttagagagctctatgcctcaactcgaaacactacataaacgcatagcaaacctattaaagaatgtaatatccacatcctttgaaacccctcctttaagcaatcagccggatttactttcaaatcttgtaaacaagctattagtcgcaattcatagtaagcttgaattaaaagagcacttcaatactgtctgctcggcaagaagtttacgtttaacgcgtgatgaaggcagtggtctctcacaagagcaggacctcctctatacacaggcagtacagctcttattctttattttacagcatcctcaagtgaataatcgtccagaaactaaagatgccgttaaagagttaaaaatgcttctacttccttttctacaatatgcctttaaaaaagtagaaaacgaaaagaaactccaaaaacttctacgttccattctagggtctctagtactcaagcctccagcacgctatccttcaaccccttctaataaagataaagagacgttctgcaagttctggtcacgacatcctgaagtgatggttttagatcccatacttgaaaagaactgtatgcagtttctacgagctactttcccaaattatcaactggaaaccgaggccatactcttagaaaaagaaatcgaaagtacctttaggaatgggtggaacgtttttttaacacggttaaatctcttcggatcaaaactgggttcgccttcttctcccacagctttaagtgatcagttttcgaaatcttttttaatcttttgtttccttaacaactaccctaaacttctacaaaaaaagactccgctagctgctcgattagacgctttccaaagagaggcttctcatagatttacacaagtaaaagataagcttttactttcgttaaaatacggtttccctctagctacagcgactataaatcaatactctagagctcgagatcagttgatttgtaatctcttaaaaaacacggtcacagcatctgatggtttctgtcgctctggttttagacaatcactgataggctacctccactccctaagttctaatgaactcggtgatatcttggatgacgtcaaagagcaagctgaggctaacgacgtcgctgctatgactactgtacctttgcagccgtttgctgtttgtctgatcatgtctgatcgagatactgtctcagaagaaaatattgaaaactttgttgcgatgcatggatttttaaatacaatttctccggaaagagacgctcgtatcttcttaatccgcttccccaaccactacggttgtctcttgcctagaaaccctagaactgaagatcagaactcaaaaccggacagctcaaatccctagttttgcatgaggtacttattcttacgtttacctatcccctaccgcgcaccctcaaacagcatcctgacgaggtccataccgttcctatttctccaaatctatcgtttggagaaggatcgccaatactgatcgcaggcccctgcaccttagaaagttacgagcatacagtctcttcagctcttacagttaaagaagcaggagctcaggtattccgaggatcaatcagaaaaccacggacaagcccattttcgtttcaaggatgggagaaagagtgtgtgctttggcataaggaagcacagagcatccatggtctccctacagaaaccgaagttttagatgtccgagatgttgaaattactgccgaacatgtggatatcctccgtatcggagccaaaaacatgcataacacccctcttttacaagaggtcagcaaatcacatcgtccgattatcctaaaacgcagtccagcagctactcttgaagagtggctatgcgcagcggagtacatccttgcttcttctccctcctgtcctggggtaatcctttgtgaacgaggaattcgtacctttgagcactctacgcgctacacgctagatctcaataccgtggctctccttaaagagatctcttctctccctgtaattgtagatccttcccacgcagcggggaagcgttctctagttcttcctctcgcctctgctggtctctcggtaggtgccgacggtctgatgatcgaagtgcatgcacaccctgaaaaggctctttgtgacgcgaagcaacagatcacgcccgaggagcttcacctatttgctaaaaagcacttctgcccatcagaatcacgggctcatgcgatttcttgaaatcggttgatgattctcaaataaaagagactaaaaaatcttttatttgagaactcttaaattaaacttaaccaaatacttttaaaaagtttattagaaattttgttttattatatttaatataaatatttttattgaatagtaaatactattttcactatctaacagccaattggaagaacgccaacacgcgtctttctttggaggtttatgataaaacaagcgtgtaaattttaccttttacagtgtttactttgcgctctgtattggctattaaagtattgcagaaagcttcttaagggcactcttcaccattctgaagagacgctctatcaagccctgctctcctctcttatcgacctgctctatcagttaaaacagcttcccgcccctacgaatgaataataaaaaataaaacgaacccctcttcttcttggaaaagaaggagaggtatcagattctaaacacaacttaaaaaactgacgatctcttactaagcgcaacctatcagatctaagagaaacctaaacaactcaggatctattttagttatatcttctcatgcagtggttatctaagtttgcgttttgactttgtttttccaagtgatctcaataaatcctacaaaggaaaaggcgactagagaacctacccaagccaatagctccccaaacatccccaaagagactatctgaacccatccatagcccagagcaccaacgagcactcctgcccaagcagcagctccgctcacacggcgacctttaggagctagaagatagaaacccacagggactgaaagacaacacactgacaggctatagcttaaaatcaagacatctacgatgtttgtaaaaccaatagcaacaagaggagctgcaaccgccaaacccaatactaaataacgataataaggggctttcaacgtagggtattcttcagcgattagctggcttacagcattcataagagagtccgcggtagagagaatcgcaacgccgatggcagcagccatcacagctgctagtgagggattgcaaaaatatgcaatggtatcaatcagagggcatcctgctttaaggcctgctttagctcctaaagaacctaaaaataaagggataaagttaaaaagaagaagaacaaggcctgcgcctacagccgcccattgcaagcgttttggagaggaggcagccacacacctttgcaccatatcctgctcaacaagcataaagagcataggcatgaatatccaattggaaaacttcgcacaaggaagtgattggaaaggatccaacacagacaaggatttagggacagagagccatacagaaacaccacagacgagcaccgcaataagaagaaatcctgcttggatcacatcagtacgtacgaccccgcgaaaccctcctgttgaggtataggatgctaagacaatccaaaatgctacggttacgtacttgccaaaagggaagctgctaaacaaccgatctaaagcaatcacctgagcgaccaggatgaaaaataaggaacctgcggataataaaaatgcgatcttacggagctttttagaaccataaaacacttcaaagatagagactacggtcgttaacgatccctctgccaaccgcttcccgggccccattcctaagaaaatcaaccctaaagcgactcctaaaggataaagaatccccccataaccataacagaaggcctcttcagcagccccaagaagtacaccgccaccgatttgggtggcaatgaatgtcatcatcaaaggaaagatttttaaactccttcctgcaagaaaatagctctcgcgatcttctacctttttgctaccacgacgtcccacgtacaagcagattccctgaatagctatcaggaaaaataaaaataatgaaaaattcataaaataaagaactccacaacctaaatganaaatatttcctttaagcaagctacggtgctgagcttaaagatagaaatgctaggaaaattaggagtggtgatggagataacgtccagaataacgaaatcttaacgagaatagagattcaaaaaacaaatctgattttatatacaggttgtgcatgacatacaggctctgagcttacgctcttcataaattataaaagctaccagataaaaatctataacaaagttttctatctccaaagacttaaaaatgaaagaataaagtcagtctgaaaaattatttttaagaaatagaaattacaactgcgtggtttttcttctatatcttgaataattttattaatatttatttgaaaatagagaaaagagcacccgctgctgcacttcgcagcgaaggagcttcgtgatggcagcagtctagaagaaaaggcacagcatcaagattctcagaaaaagcaacgctctctaagattgctaatttatcttgccaacggctgtcattataaagttgagagaccctctgtagggaagcttgatcttttttctgacatagcgaggctaacgctccttccaactttgctgcaaagcaagcatctgtaaccaaatcctcagaagttttcacatctccctcttcccagaacattccagaaaaaaagctccatccctgagcttgctgtcctgaaaggaacgttgctgttacagccttggcttggctatagcgagctactgccaaaaggcgaatgagcttcctaccaatctcacgtttaatcatatccgaatatagagggaaggtatcaccacgtaaattccattgtgcatcccataagaaatactctatagcccagcacatttcaggattggagaggtagcgagcaatcacatctccagctctttcaatatcttcacggctcacaagaagcaaaatggagaggttcgcagcagcctttcgagaagaaaggctctccaaatgctcctttgccaaagggactccatggattcctaaagagcagagagccgccgaagctgcctcacacacaagaggttgaggagagcgcaaccctcaaccagagagtctctgcccaaagggtctccatgcagatggagaagtgcagcagcttgaaaacgtacttttgcaaatggagaagtgcacatcacatggcgcactttactaagaaactctttgtgattctgtagctgatgactccaagctaaagcagaaagtaagagagactcctgcacttcaggatgctctacagataagagttctgtaaaaatctcagtagtctctggcaacataccgttacgcaacacttcacaagtgaacaacgcttgatcaatatcgtccttagctacacccgtctctagaaattgagaagagagttccaagcaagccttccacgcctctcgacgttctacactatctacaagtttgttctcagcacgctctcttaaaaatggcaatagctcctctatctgtaaaagagcgaccacctgatatgctgtaatccgaacatgaatagaatcatcattacgggcaagctctacaatggccttttttaaactttcagagccatagttcacagcaacctgaagagccaaagatcgaacaatagcactgtcatcattacaactttggagcaggagagggaccaagcgaaaatctctagcaagcccaatagcaaggacactcacagcacgaacggtcacggaaggattttcgattccctcacgcagaacttgaatcccaaattcttctaagacatcgcgatcatgagctaactctggataggaaatctgacacttcttaaaacttctaaaccaatcatcaaaagaagaattttgagccagagcccttaaaactagcttagcctgaagtaaagaatactctttagactccaaaaggcctatgccctcttctgaaacttttgcaaaatcttggatcaacaattgataacggagggactccgagccgaacaaggatccacagaaacaaaagaaaattaggctatagcacctaaaggacgcccacctaaaagatgaatatgtaagtgaaataccgcctgtcctccttcagcaccgttgttgataaccacacgatacccatcggcaattccaaattctgcagcaagctcttgcacgatctttccagcctctgccattaaaatcatctcatcccctgggatatcctgaaatcgtggtataggttttttaggaatgataagaagatgaacaggagcttgaggaaaacgatcttttatagctatgaaattttcgttttcaaataccttttcacaatctatcaatccatcgataatttgtttgaatactgtcatatgatccctcgatcttgtaacgttaaccgcaaagcacgttggcaactttctctatttgtccatacagaaaggaaaagacctttatggcagaacacagccccaggaatccctgatactttggacaactctttacctaacaaacctgcccaattctcagggaaaggaacacgaacttccatacggcgatctaaattcggaggaatccctcgtaaaatccattgatcgcaggaaggaaaacaaacaaaagctgcagggtgcttctctccccctaaaaaaaagaaattttcttgccatgctaaaggacgatcaaaatataaacacatatcctcggtttccatggcttctctgacaatccccctacaaactcgatcatactgaaacttcttccttagccgacacaaaaagtcgatggtaaaatgcaaagcacaagaaaaatccgcatccgaattagtttcttcttcctcgcgaggattataaattttaataatatcagaaaacgaacaaaatccctccttagagaagaatctgccattatcttgttcatccacaccatgtaccaaagtgttgttaaggaaatgatattcttcacaatccatataaccaaactctttaagataatgcagaatcatacctgcactactccaagatccatcataagagacttgatgatgatcaaaacgcttgttttctatagaataaacaccaccgacatcacaaacatattcacatttcgataatacgacaggatctcgagagcgtataattttattttcatccacaagatcgaaaataataaggagagcacacgctgtgacctcatccgcatggaaagaaccatcgtgagtaccaatgcttcttggaatctgcatacctactatcctccttagccaatcctccattgtaaccagagagaaataattctcaattgcaaagactattctttacattttactcaatctctccaagagaaagtttctgccctattttctaagaaacttttttcctaaaattcccttccacaacacaattttctcgttccaagaccccctccttgacaaattgcacaaaattataacaacaagcagaatgaagtccttgtaggaaattcttctggaaacgctagtcttagaagcgcaaagagggaccttacctattgcttttaactttaaaatacgatgaattatgtataacctactccacgcgcatcatgatgcagcctccccagacggacgactcgtttcccatttgaaaaaactctcgccccacatttacgaaggagaggtcctcattgagaatattcctgcgtactttcttggatttcatctgcctcaacagtgtatacaagtaaatttaaaaagttccttagcccaactaggtgtcgaagccgttttaaaccacttggagctaaataaagcccgaaaagaagctcgtctacacgttctcttcatgagccaagatcctatagccactgctaatgttggagctcctaggagcctggnagttttgtctgcaagctctttgctgctgatgatcgccgactcgtacgttcgccttgttatctcaacaggatgtttacgcacacagaccgtacaggatctccgctcctacgctttgggaaaaaacttgagcacttcatcactctagagatcattaatgatcggcttgttgtcttccttccgatccttccaggaacaatctgttacgaagagacaatttatgggttccttcccttaatgagcaaatcactcacgcgtccccatttaaaaatacgtaagtttcttcctttgtatcaaatggtaacagatcgtcctcccgttcccgaagatcataaaattcttctcataaagacagagcctctgcacatccgaaccgtatttgcaagagtcgttcaggacttactcccccaagggcttcgtcacaccgcagcggatattctcgaacctaccacacaagaatctggagatatttatgaattctacggcagcacttcagaacctattgagagaatacctttagaattttttactcttgagccttacaaagagcattcgtttttcttctatagagatatgctccaggaaaccttanaatctcctcaagaggtatttcgtgtttttgaatccataccggaaggcgaaaatcaagctgcgatgtttatctccaaaggtagtgagcttgcttgagctctcccaagactcttggatcatcaaacctcgaatctccccatcagatgaaagacatgctagggaaattcaaaagcacattgaagacccaaccttgtttcccttttttaaaagccatggaaacagatcatatcacaagccaaggagttttattttcccgctacttcccttcagcatcgctgaagggcatgttcctctctaactactctcgctattacctgcaacatatctattttcagattccctctcccacttctggagagtttttctcgaatcgagatcgctctttccttctcgatctatattttgcaggaatttctgtattttgggcagacttagaatcgaaacgactcttacaatacatcaaacgcagaaataaagatgtgggcatgtttgtccctaaacatcaagctgaacagtttgctcaatcctactttataggaattcatggttcctgcctaatcgctggggattatgatgagtttctccgtgagctcctgacaggaatgcatactctttctcagcaattcacgatcccagaatttccaccacagacaccgttagcaatccttacaggagggggttctggagctatggaactcgcgaatcgtgtagctacagaactctccatactctcttgtgggaatctaattagcttggataccacgaatgcctatgtagaagctaaaatgagctatgctattcctgatcttttagaacgtcaggccgacttccatgtcgaccttgctgtatttgttatcggaggcatgggaaccgatttcgaactccttctggagcttattagtctcaaaacagggaaaaaagctcttgttcccgtcttcctaatcggacctgtagactattggaaatccaagatcacagctttgtataattccaatcatgctgtaggaaccattcgaggttctgaatgggtacacaactgcctattctgcctatcctcagcaaaggcaggcattgcaatcttccgcagatatctcaatcatacgctgcccataggacctgaacaccctgtccctgaagatggttttgttatcgtttagaatccataggtaagacggaaaccgtagtaattacacggttcacgaatgaattggccttctttagaaaatccctgatgatattctaaaacagcacggattttccttccgatttcttgaaatttggcccactccatgcctaaaatatagctttgatccaagccaaatttctgttcttcccaacaacggaaatgcatcgcgaaaatcggttgtgcgtggagatttccttctctcagaccaaaaggtctgagttccgcaccccattcacagtaaaacggccgctcaggaaaagtaagatccctacttacaatataaccgcagccgccatacaagcggatctgtggtgtgtaacgaaacgaaatgaagagatcgacgccctcatcactcaaattaaatcttgggaaatttggatgcgtaagaataaactcatctcctaaatgggacgagaggtgccacaatcgaaacctaaaactccatttatctatagcccctgaccagagtccggcaacaaagaaatctgaatttaccatgcacgattcaggatgatctaaatcaaaaactgagaagactcctccttgaattccgaaatcacaatctacatggaatcgagaaacatcaaaaagacgcaggagaataaaatctcccccaaagatggtagcacctacccgattccccacgaccttctcattaaaacgaatgccagcactgttggtaacctgacgaggatctgcaatcaaaggagaaaacaaaatggtattttgaggtaaccataccccttctttgccgcagaaaattggcattcctaaagttttctctttagggagtaagggacgctccgcagaagatctcgttatgcattcaccataaggacgctcgcaaatctccacagcacatatgaagggaagatccctaacaaagttggtaatggcttctgataaactcgaatctacaggcaaagagaaaagatacgctctattcttctcaataacaacttgcgtacggctatctaaaaaatgcatgtccaaaagagactgcacataacctgtaagataacagtcgttttcatagttccagagatgatccggcagctgatccgaacgtaaaacagacttagtttcgtatttgcaatcggggcacaaaggctctcccccagcgatgccacccacaaagagtaccaagaagctaaagagccaacaaaaccaagaatagcaagagtgaaaagctgtcttcatcgtaaagacagtgtatagagaagaaagtatttatttcgcaatattgtatagcaattcttaaaactaagagaccctaactcttttcattgatctttccgatctgtgaagagaggaattcacaacagacctacaaacatctccatgtagaatcagcttgtttccttctagaatctccgttgaaaatccactggtcttctccttatggattccctcccttctaccgcagagacctaaaactctgaaccctcttaatgaagagaaggagggatctcagctctgatccggattagctgtctttccaatggacgtgcttgcctttggggtctttgtttccaggctttttcaagatccctttgggtgtctctataaatgaggtctcagcatcttcttgttttctctctacaccactctgttttggactgcgtgtgtaagttcgcaaacgtatgtaagggtgcgttggagaaaaacttgagggagaacgcttcttgcttccacgtcctgtaaacgttctaatccattgaacaaatctgccaacgaatcctttgcttgtcttcgaatgagaaccttctgtcttggattatttgaaatgggcttctgaaatgcctttgaccttcttctctaaagaagctttccccgtcttagaacccgaggtcaccccaactgaagcactcttatgctttctacgaatcccaccacgacgatgcaagcgagagttccctgaaaggggtacatcctttttcccatcttctggagaaggattcctacccctataacttccataaggattgacccttatcataattacctaaaaaattttttcaaatcttatcctttaattatagtgagcaaattagaaaagatttaaaaaacttttaataaacagaattataaatatatcttaataattaaccgaaactacagagcactccttgcctttatagaggcggttaaagnnaaatcagaaaatggctatccaaaaagctggggctttcttaagatgtcttccaagtgaatcacgcccttacctggagcacgctatgcgtagaaatccccacttttctcttctcaagcctcagtatctattttctgaaattagtaaaaagcttgctcagtttcgcaaggagaatccagaaatctctgtcatagatctttctatcggagatacgacacaacctctctgccgctctattactcaggcaatcaaagagttctgcgtttctcaagagaaacaagagacctatcgtgggtacggcccagaaaccggattagaaaaattacgcacaaaaattgcctctgaagtctatgaaaatagaatctcccctgaagagatttttatttcggatggtgccaaacctgatatcttccgtctcttttctttttttggctcagaaaagactctaggtctacaggatcctgtctatccagcttatagagacattgcccacattacaggaatccgcgacattatccccctagcatgcagaaaagaaactgggtttattccagaacttccgaaccaacaatccctagacattctttgtctatgctatcctaacaaccccacaggaacagttctaacctttcaacaactccaagcacttgtgaactacgcgaatcagcacggaaccgttcttatttttgatgcggcctatagcgcctttgtctcagatcctagcctacctaaaagcatcttcgaaatccctgaagcaaaatattgtgctatagaaatcaactctttctctaaatcattaggctttactggcatgcgccttgcctggaacgtgatccctaaagaactcacctatgacaataacgaacctatgatcaacgattggaaacggctctttgcgactacatttaacggagcatctctcctcatgcaagaagcagggtattacggcctagatttatttccgacacctcccgccatctctttatatctaaccaatgctcagaaacttaaaaaaagcttagaaactgcaggattctcagttcatggtggcgatcatgccccttacctttgggtagaactccctgaaggaatctctgatgaagaagcgtttgatttcttcttacatcagtatcatattgcagtgactcccggccacggttttggttcctgtggacaaggatttgttcgtttctccgctctgacacaaccacaaaatatcgctttagcctgtgaccgcctctgtaccgcttcactaaaagaaacgatggttcttgcatgacaattctacgtaaactctctcagtacttatttttcttttctctgttttgctctttcatctatgtagccacttgtggttctcaaccagatagcgtctcctctcctaaaatcgcaattttcttatcctttccccatcccctattagaagattgcagtaaaagctgtatagaaaccttgaaagattttgagaaccttcctgaaattgttgtcctaaatgctgaagacagtatcgtaaaggctaggaaaattgctcgctccttacataccgataaaaatgtcgtggcgattgtcaccttaggaactattgctacgaaggtcatgagccacattgaaacacagaaacctgtgatctatgccgctgttcctgatcgcgaaagcctaacccctcctaaaaacacaatgaatatctacggagtgaatgacactctagacatcaatcaatactgctttgctatacaagccgtagctaccaatgcacaatctatcgtgtatttaaaaccctccgaacctttcccctcagatctccaaaaagaaattgttaagaaactccatgcttcaggaattgaggtcattgagatctctattacaagcagtacattcaaaacccggatacgccaggctatcgacaagcgcccctcagctatcttcattcccctctccccactttctcataaagaaggcaccgcattccttcaggaaatcctcaaagagaaaatccctatcattaccgacgatacctccttaatttccgaagagcctgcattgcctgtagcgtggattacaaaaaatcaggaaaacaaatcgcaaaaaattgtgcaccacctactctataacaatcacgatgtggacagcctgcgtaaaatcattgctcaacgcctgtcacctacaaccacctttaatgaagatatcatcaagtacttaggaatcaagcttcataaaacagaacgcaaccagttcttatcttttaaaagcaaaaaattggaaaaatctgagaaagggaaaaacgtagctgtgagttaggctatacgtctatatgcaaagaaaaaataatgtcttgaactctgttaggaagaagaaactttttctttcgagaagtttctcctgcaattaaagtgacatcacgcttcggtaaggataaagcttttgctaataaagaaattacagcatcattggccttacccttttctgggggttcggtaacacggaccttcaaagcttgtccatcaaagcctacaattttgttctctttggcttttggagtgactttaacctctaagatccatgaatcatccaaaacaaccctctgaaatatttaagcagccgttcgtttcctttaaccattccgctaaagtatgtagacaaatccttggagcccaatgatacttcaagactccttgagcaaatccaggtccagcaagatcatagctttcccctttgaaaaactgcccgaccctgcaagcatctaaaccgataaagggttgactacttacaaataacacgcgtcccggaaacgcttcttgataagaacggaataaaagtaaggtgtccttacgattcgcaaccacacgattttcctctggctttgctagaagaaatgtcactctgactcctgaagtactatctcgccatgctctaggtaaaagcatttgcatccaaacaaatttggcaacctcttcttcagaagagggagtaactcggttaccagattcccagttctcttcagtagggaaaggattgtaccgagaatcaaagaaatgctcttgttcttcaatagactgatagcgccctcgctctccacatagaaaaacgattttcttaaagcgcacgccacgctgccactctcgcaccaaaaaatctaagcgctgacgtagcgctggcaaaggcccgccaaaaactacagcacaatcatacgttgcagaatacgaaggcacagcctgagtcatatgtaataaagacaaatcgttatagaaagcatgctcatctttaacctgacagatagagactaactctccagaaaaacgttcttcaggagtcagtacccaagcagacgaggactcgattaaatcctcaacattctcagcttcaggaagtccacaaacttctagtaaacgattgactacaggaatatacttatcaatagaacatcttgatttcgcttgttaccaaggacaacacccaacagaaatgagcgccgtcattgcgaacaatgccactacccatcttgcttttcttctattcataaagggcgccctccttaatcggcaatattagacgccaccatataacaaaaattcaaaaaaaacaataaacaaaccaccgcaatttgaactataaaaataggactgggtgagagtaaaagctggcaattctgattcgatagtttctactcagaagagatcattctttattataactccgtctcttcctcactatcagagtcttgcttatcacctcgactaggttggttacggccatctccatggggagattcaggatgtatagactctccctcagctctcacaatcatctcttcctcagataagtcagatcgccgagaaaggcgttctctccttgtagaacgctctccggaagaagacctctggtcttcttgagaagcatcgggattatggaaaggcaaacaccccagcccaggcaaaaggttaatccgtctcactatccacatcaaaacaaacacgatgttgtcatagcaactcgaaataaaacctacaaaattcgcccaaagacgacgtaattcattgagcaatctttcacagcaagacaaactttcttcaaccctaggatcagacgaagattccgttgttccctgaagagtccgcaattcttctacagtaggtagattcactttcttgatctggacaagcatactgtcagcagtaagcaccagtcgcggaatccccctctcacaagaaagagaccaattaccttcagcgtctacatcaagccctaacgaacccagatgctcaagaaccctatcattattgtcaaacgccagggaaagatcttcacgactgagtccctgtagcttgtgatgtacatctgttaacttacttaaaatgagatgagccttcccatgaaactggttcgcatggcctaagacagcctcgtaatcgctacgaaataattccagcctcgctatatccgcattatccccagcacctcgagtttcgagtcttctcgttgaagatttccatgccggaagacagtttttcaactctgactgaaagctagtgaaaagggactgggcacccttaaggtcgtctaaaagctctccaacacgctctacaagtgatgagatctgatcagcaaccgcccgactcgaagaaacttcagctacaatctcgtctaccttcggattactcgccgtttcttcagatgaggtccccacaccttcaggaagagaaagttgagtgactataggaagagccacagcatgcgtggcttgcgcctcatctgaagaaacaacatttttgttttcttccgtagattcaggagaagttacctcttctggattcggggttccagagctttgatttactgacgacatagtactacaattacaaaaataaaagattaataagtatacacttaattataagttgagattattaaatttctaaataaaaacaaaaatataattaaaataatacataatcctgaccccaattgttaagttaagaacccaacgcaaaacattgatctagaaaaatccctgtgttaagatacctccttcatagctaaactaaatctactagcttaaaagactctcgatataaaatcgcaatagcctgtaattttttctatagactcttgacgatcaatcactgaagataacagccctactctatgaaaacgtctcaactcttttataagacttcaaaaaatgcaaataaaagcgctgctgtgctctcaaacgagctcctagaaaaggcaggatacctatttaaagtaagtaaaggagtctatacctatacacccctgttatggcgcgtggtctccaagatgatgaacatcattagagaggaacttaatgcgattggaggtcaagaacttctactcccacttctccacaatgctgaactttggcaacatacagggagatgggaggcatttacttcggaaggactgctctacactctcaaagaccgcgaaggaaaatctcattgcctagctcctacacatgaagaggtcatctgctcttttgttgcacaatggctctcctcaaaaagacaacttcctctccacctttaccaaattgctacaaaattccgagacgagattcgccctcgattcggtctcattcgctctcgagagctccttatggaagacagctataccttctcagactctcccgaacaaatgaacgagcaatatgaaaaactccgctctgcgtatagtaagatctttgatcgtctcggtcttgcctatgtcatcgttacagctgatggagggaaaatcggcaaaggaaagtctgaggaatttcaggtcctttgctctctaggcgaggacacgatctgcgtcagcggttcctatggagctaatattgaggctgctgtctccattcctccacagcatgcctacgatcgcgagtttcttcccgtcgaagaagtggccacccctgggattacaacaatagaagctctagcaaacttcttctctatccccttacataaaattttaaaaacccttgtcgtaaaactctcctactcaaatgaagaaaaattcattgccattggaatgagaggagatcggcaagtcaacctagtgaaggtcgcttccaaactgaatgccgatgatattgctctagcttctgatgaagaaatcgaacgcgttctaggcacagaaaaaggattcatcggtcccctaaactgtcccatagactttntcgcagacgaaacaacgtccccaatgacgaactttgtttgtgcgggcaatgctaaagataagcactacgtaaatgtaaactgggatcgcgacctcctccccccccaatacggtgactttctactcgctgaagagggagacacatgtcctgaaaatcctggccatccttaccgcatttatcaaggcatagaagttgctcatattttcaatctcgggacacgctataccgatagttttgaggtaaacttccaagatgaacacgggcaaacccagcagtgctggatggggacctacggcattggagtcggaagaacattagccgcttgtgtagaacagcttgccgacgaccgtggtattgtttggccaaaagcactcgctcccttctctatcactatcgcctttaacggaggagacactgtatctcaagagcttgcggaaactatttatcatgagctacaaagtcaaggctatgagccccttcttgatgatcgagatgaaagactcggatttaaacttaaagacagtgaccttatcggcattccttataagcttattttaggaaagtcctaccaatcttcgggaatattcgaaattgaatcccgatctggagaaaagtatacagtctccccggaggccttccctacttggtgtcagaatcacttagcctagctctttgatcgctgccctcctcgtaaaaaagttagcattcattcaattcgagtgctaaattctcttgaccttctcgggttcttttcctataatgctctcagttacgattgttctagtaggactcgagatggctagatccaaagtctcaaagcgagattcaaaaatccttgatatcctgtttgctacaacagagttgtacctaaaaacagggcagcctgtagggtctaaaactttaaaggaaagtttttgctctgatttgagtacggcaactataagaaattactttgcagaacttgaagctgaaggattcttaaaanaaaatcatacttccggaggaagaatccctacagacctagcattacgtcactatgtagatcaccaagaagaatgcccagaagctgagatttctgcccccatttttgataagntcagtcngcttccctagcgaaagtcgcaatattatcaaggatctacaaaaagctacggaacttcttggagaaatcctagacctgcctacgtttttttcttccccacgctttgaaaatgattccgtaaccaatattcaaattacacaggtcgataagcaaagagctgtcaccatcctctctacggagtttggtcagatcttcacagacaccctatggctgcctgaagcttgcgatactctttctatcaaacgtatagaaaaattcctgcagaactacatccgaaagctccccacaaatgaggaactttcgaaaaaagaagaacacctgagcatgtccctctataatgaggtggttgtccgctatctaacacgctactgcaactttagtgaagaagatctctatcaaacaggaatgtcgaaactactgaaatacgaagcgtttaaagatcctgaagttctagctctaggactctctctttttgaaaatcgcagacaaatgtgtgagcttctaaatataggaatgcataaaggaagagctacagcgttcatagggaaggagctttctgatattttagggacctcgaatccaggatgttctgtaattactattccctattatatgaatcgctctccactcggagctttaggtatcctaggcccgatcaatcttccttataaggaagctcttcctttgctcaaactatttgcgaataaaataaatgaaaccctgacacaaagtttctacaaatttaaactatccttcagaagaccactcacctctaactgtaagctttcgaatgagcctattttaagaacggagtactcttctataaaactattaccctctaaggagacgttatgacagataccccacctgaaaatgaggaacaacacgaaagcaatgttcaaaacgaaaatgaagttgaacatttgcaacaggaaatcgtcaccctaaaaaccgaattaaaagaaaaaaacgataagtatctcatggctctagcagaatctgagaattctagaaaacgcttacaaaaagaacgccaagaacttatgcagtatgctttagaaaatactttaatagactttctcaatcccatagaaagcatggagaaagccctcggatttgctacacaaatgtccgacgatgtaaaaaattgggccctcggattcaacatgattctcaaccaattcaaacaaatcttcgaggaaaaaggtattattgaatattcttcaataggccaaaagtttaaccccttcctacacgaagcggtgcaaacagaagagacttctgaagttcctgaggggacgattttagaagagtttgcaaagggatataaaataggagaacgcccgattcgggtagctaaagttaaagtcgctaaagctcctactcccaaagaaaataaagaatagaaataacccctagagattaggtaccaaacatgagtgaacacaaaaaatcaagcaaaattataggtatagacttaggcacaacaaactcctgcgtatctgttatggaaggaggacaagctaaagtaattacatcatccgaaggaacaagaaccacgccatcgatcgttgccttcaaaggtaatgagaaattagtggggattccagcaaaacgtcaagcagtgacaaatccagaaaaaactctcggctctacaaaacgctttattggccgtaagtactctgaagtagcttcggaaatccaaaccgttccttatacagtcacctccggatctaaaggtgatgccgttttcgaagttgatggcaaacaatacactccagaagaaattggcgcacaaatcttaatgaaaatgaaagagacagcagaagcttatctaggcgaaactgtcacagaagcagtgatcaccgtccccgcatacttcaatgattctcaacgagcatccacaaaagatgctggacgcattgcaggtctagatgtaaaacgtatcattccagaacctaccgcagcagctcttgcctacggaatcgataaagtcggtgataaaaaaatcgctgtcttcgaccttggtggaggaacttttgatatctccatcctagaaatcggtgatggcgtcttcgaagttctatctacaaatggagatactctcctcggtggagacgactttgatgaagtcattatcaaatggatgatcgaagaattcaaaaaacaagaaggcattgatcttagcaaagataatatggccttacaaagacttaaagatgctgctgagaaagcaaaaatagaactttcaggagtctcttccacagaaatcaatcagccattcatcacaatggatgcacaaggacctaaacaccttgcattgacactcacacgtgcgcaattcgagaaactcgcagcctctctaatcgaaagaacaaaatctccatgcatcaaagcactcagtgacgcaaaactttccgctaaggatatcgatgatgttctcttagttggaggtatgtcaagaatgcccgcagtgcaagaaactgtaaaagaactcttcggcaaagagcctaataaaggagtcaaccccgacgaagttgttgctattggagccgcaattcaaggtggtgttcttggcggagaagttaaggatgttctacttctagacgttatccccctatctctgggtatcgaaactctaggaggcgtcatgacgactctggtagagagaaatactacaatccctacacagaaaaaacaaatcttctccacagctgctgataaccagcctgcggttaccatcgtagttctccaaggagagcgtcccatggccaaagataacaaggaaatcggaagattcgatcttacagatatccctccggctcctcgaggccatcctcaaatcgaagtctccttcgatatcgatgcaaacggaattttccatgtctcagctaaagatgttgccagcggtaaagaacagaaaattcgtatcgaagcaagctcaggacttcaagaagatgaaatccaaagaatggttcgagatgccgaaattaataaggaagaagataaaaacgtcgtgaagcttcagatgctaaaaatgaagccgatagcatgatcttcagagccgaaaaagctattaaagattataaggagcaaattcctgaaactttagttaaagaaatcgaagagcgaatcgaaaacgtgcgcaacgcactcaaagatgacgctcctattgaaaaaattaaagaggttactgaagacctaagcaagcatatgcaaaaaattggagagtctatgcaatcgcagtctgcatcagcagcagcatcatcggcagccaatgctaaaggtggacctaacatcaatacagaagatttgaaaaaacatagtttcagtacgaagcctccttcaaataacggttcttcagaagaccatatcgaagaagctgatgtagaaattattgataacgacgataagtaatcaaaattttcaatttaagtttctctattcccatcctcataagaggatgggaaacttccttataaacagaaaacagttccattctcttattctctgatcaaggagttgcaataacagagcttctttagtacaattggctttgaatttgagactgctcctttcataatcacaaaacccacttaaaagggaaaattttgttgagccactcagttcacgagtgaaactacgggatttctcgttcaatgtcctaaacttacaggcggagcccaattgttgaaaaaaccaaaaagaaaaccagggagaagaacatacggtaaatccttgaagatttttattccaggaaccctatttgttcatgctagaaaaggtttcggttttgtttctcccgacaaccccgaagaatacccatttgatatttttgttcccgcccgagatttacgcggggctctagatggtgaccacgtgattgtctccgtgcttccctatccaagagacggacaaaaactcaaaggcactatcagcgaagtactcgcaagaggaaaaacaacactcgtaggaacgatcacctcactagtcagtcccacatcagcacttgcctacacaagcatgtcgggatcccaatctttaattccagtagaactccttcccggacgcacttacaaaatcggcgatcgcattcttctgagcactcctccctgggtagataaaccccaagaaggagcctctccagccttacaaatgctcgaatttattggccacatcaccaacgctaaagcggactttcaggcaattcaagccgaatataaccttgccgaagaattccccccagaggtcattgaagaagcaagccttttctctcaaaananattaacccaagttctccaactctcgcaaagatctccgtgatctcctctgtttcaccatagactcttccacagccagagacttcgacgatgccatctccctcacctacgatcataataacaattacattcttggtgtacacatcgcagacgtctcccactacgttaccccacattctcacctagacaaagaagctgctaaacgctgtaactctacatatttcccagggaaagtcattcccatgttgccatcagcactctctgataatctctgcagcttaaaaccaaacgttgatagactcgctgtatccgtatttatgacgtttacaaaatcaggtcatctttcagattaccagattttccgtagcgtcattcgaagcaaatatcgtatgacctacgatgaagtcgataacatcattgaaaagaaacactcccaccccctctcaaaaatcctcaatgagatggccactctaagtaaaaagttttccgatatccgtgaagaacgtggttgcattcgctttgtcctcccctcagtcactatgtccttggataatcttcaagaacccgtagctctgatagaaaaccaccagaccttctcccataaactcatcgaagagtttatgcttaaagcaaacgaagtggtcgcctatcatatctcccatcaaggcgtttctctaccttttcgtagtcacgaacctcccaatgatgaaaacctactcgccttccaagaannggcaaaaaacatgggctttgatatcacgttcactcccacacaaagaacctgattaccaataccttttgcaaactacgtcagcaggacatcccctagagcaagttctacactcgcagtttgtccgaagtatgaaaacagcctcctactctacagaaaataaaggtcattacggacttaagctcgactactacacccactttacgagtcccatacgtagatatatcgatcttattgttcacaggcttctcttcaaccccctatctatagaccaaacgcacctcgaaattatcgtaagagcatgctctacaaaagaacgagtatccgcaaaagcagaaaattctttcgaaaacctcaaaaaaactcggttcataaataaatttttgcaagagcaacctaaaactacataccatgcgtatatcatcactgcaaatcatgaaggactctcatttgtagtgaccgaattctgccatgaagggttcattgcagcagcagaactccctaaagaatattccctaaagaaaaacgctcttccagaatctatcccagataaaatgaaacctggagcttctagaaaagtcactattgattccgtgaatctccttacgcaaaaaatcgtctggtctatagcgacaaccacagaagataaacctaagaaaataaagaaaacgccttctaagaaaaaaggaacgaaaaaaagagcctcgtaacgtgctacaagaacatttttttctatcggaagatgtaattacactagcgcaacagcttttaggacataaactcatcacaacacatgagggtctgataacttcaggttacattgtagaaaccgaagcgtatcgtggccctgatgacaaagcatgccacgcctacaactacagaaaaactcagaggaacagagcgatgtacctgaaaagaggctctgcttacctctaccgttgctatggcatgcatcacctattgaatgttgtcactggacctgaggacattccccatgccgtcctgatccgggccatccttcctgatcaaggcaaagaacttatgatccaacgccgccaatggagagataaacccccacaccttctcaccaatggacccggaaaagtgtgccaagctctaggaatctctttggaaaacaataggcaacgcctaaataccccagctctctatatcagcaaagaaaaaatctctgggactctaacagcaactgcccggatcggcatcgattatgctcaagagtatcgtgatgtcccatggagatttctcctatccccagaagattcgggaaaagttttatcttaaataatcttaagctgtatagtaaagaaacaaatgcccatttcctcatatcttgcaggagaatcatgaaaaaatactttattacaggacttgttattctccttcctctagcaattactattgctattgttactatgatcatgaacttcctaacccaacccttcgtaggcttggcttcggaattctttgacgaaatttagcttttatactaaacatagagctcttctaaaattcgtattgcaaatcattttactcttcggtctctttttcgccacagtgctcctaggtttcctcacgagaattatgatttttaaatccctactctctatctacgacaaaatcttacaccgaattcccatcattaaaacagtgtataaagctgcgcaacaagtcatgactaccatatttggatcaaaatcaggatccttcaaacaagtagttatggttcctttccctaacgcaaatgttcaatgcatcggtctcgtcgctggagacgcacccacagtatgctgcacaggagaaaaggaagacgaccccctcgtcacggtcttcatcccaacaacacccaaccccacctcagggtttcttaccctatttagaaaatctgatatcgtattcctagatatgaaaatcgaagatgctttcaaatatattatctcctgtggagtcctctcaacccccatggcatgcccctcgtctcccctccctgacgagctacaccaagatcaaggcagctaaaagacgtcatcttcttgaaaaaaaactcttcttttactatcctttttcttataaagtactccgtatcctcaatttccgttgtctggagaaattaaaaaattcaatatcgagttatttatgacacgaatgagtaaacaagctcggcgcagagcgaaaagtcctaaaaaacgtaaacctaagtatgccattgtgcatccagcgccagtccaagaattgtatataaattgcatacgaatgcattgagcaccagtgatagcatttttatcccgaaaataggttaatttctagagtagaattatgtctcgacatcgtagttatggtaaatctgtcaaaggggttaccaaaagaaatgttttgaagcgttttgagcgagtagaagtcttgcgtaagttgggccgttggaatgatagtacagcgaaaaaagtcacaggtttacctaagacccctattttaaaataagtttgtttttctctatgggaatttcattcgcgtgacgcaagaaaagatcaaaatacatgtttccaatgagcaaacatgtattcctattcatttggtttctgtagagaagctggttcttacgctcttagagcacttaanagtaacanctaatganatttttatctacttcctagaagataaagctcttgcagaactccatgcataaggtatttgctgatccttctctaacagatacgatcactctgcctattgatgctcccggagatcccgcttatcctcatgttttaggagaagcattcattagcccacaggccgctcttaggtttttagagaacacatccccaaaccaagaggatatctacgaagaaatctcgagatacctcgtccactctattctccatatgctcggatacgacgacacctcatcagaagaaaagagaaaaatgagagttaaagaaaatcaaatcctgtgtatgttaagaaaaaaacatgctttgctaacagcttaacatgctccatattcttttagccatattctgtattcttctattcctagccttcgggcttacgcaaccgtcctgtcacggatcctcaaaattcctaaaaaccctaaaccaacgcttcttcacagataaaggaagagagtatccccccttccccagtgctcctacaattctcgccacgctgctctgcatcctctatggagctctcgggacaaaactctataccctcctccctccaaaaacagctcacaaagatctcctattctggcccctatactctctaagcgccctgatagcttacggattcctccccccatggatctctacaaaagtccctaaagaaaccaccgcccacctccgttttctagcttcggtattccaactcggtctcttcccactgcaactgctcttttacagacgccgccctaaccaacaagtacgatcttcaacatcatttcaaagccagctctccgaagccctctccgcttttgataacctcattgtccgtgaagtcatgatcccaaaagtagatattttcgcacttcccgaagaaactacactacaagaagctctggttctcgtaagcgaagaaggctacagtcgcgttcccgtttataaaaaaaacttagacaacatcacaggaatccttcttgttaaagatctcttactgctctatacaagcagccacgacctcagccaacccatatcctcagtagcaaaacccccattctatgccccagaaataaaaaaagcctcctctcttctccaagagttccgacaaaaacatcgccatctagccatcatagtcaatgaatacggattcacagaaggcatcgctaccatggaagatattatcgaagaaattataggagagatcgcagacgagcacgacgtacaagaaaatactccttataagaaaatcggaagctcttggattgtagatggaagaatgaatatctccgacgctgaagagtacttcaatttgaaaatcgatcatgaaaatagctacgatacactaggaggacatgtcttccataaagtgggtgctgttccccaaaaaggaatgcgtatccatcacgaaaacttcgatatagaaatcattacctgcacagaacgaaatgtcggaaaactaaaaatcacaccaagaaaacgtaaattcaatatctcctaagaatgtaaacatcctaggaccgatttccttgcactccacgatcccatcctgcctccccccaatcgaaattctcaaacatcaccaataaaaatctctttgcaaaaaagctaaagatttatcagagtgaaaacttaagctcccgtatagttaggagaactatctagatgagtgatatccaaaaagaagaacacggctcaacaacaatctttcatctccacggaaaacttgatggaatttcttctccagaagtacaagaaaatatttaccaatccctagcagctggatccaaaaatatcattctcgactgtgctcacctcgattacatgtccagtgcaggtatccgagtcctactgcaaagctaccatcaagtaggacaacattctgggaaaattgtcctgactacagtcccaaaaaccatagaacaaactctctatgttacaggattcctttcttactttaaaatattcaatactgtggatgaagcgatacaaacactaaacaaagacggggattgagaaaaacctcactgttagtatatgatggcgcttttaagtcatataaagcctccctcttactatgcgacgatctgtttgttacgttaacccttcgatagctcgagcagggcaaatttctacttggaaatttctttattcccttgccacaccactaccagctggaaccaaatgtaaatttgacttagcaggaagtgggaaacccacagattgggaagcccccgcgacagatctctcccaaactagaaacgtaatctacgcagaaatgccagaaggcgaaatcatcgaagcaaccgccattcctgtaaaagacaatcccgttccacaattcgagtttactctcccctacgaacttcaagtaggagaaaccctcactattgtcatgggagcctctccaaaccatcctcaagtcgatgatgctgggaacggagcccaacttttcgcacaacgtcgcaaacccttttacctctacatcgatcctacaggagaaggaaactatgatgaacccgatgtcttctctatggatatccgcggaaacgtcctaaaaaaaatagagatctttactccctcctatgtcgttaaaaacaaacgcttcgatatcaccgtgcgatttgaagacgaattcgggaacctcaccaacttctctcctgaagaagacccgaatcgagctttcctacgagcatcttagagaaaatttaaattggcagctcttcatcccagaaacaggctttgttattcttcctaatctctatttcaatgagcctggaatttatcgcatccaattgaaaaacctctctacacaaganattttcatctctgcccctatcaaatgtttcgctgactccgccccgaatcttatgtggggtctcctccacggcgaatccgaacgcgtcgactctgaagaaaatattgaaacttgtatgcgttatttccgagatgaccgcgctctgaatttctatgcttcttcatcattcgaaaatcaagagaacctctctccagatatttggaagctcatcaatcaaactgtctccgactttaatgaagaagatcgcttcatcacactatccggattccaatatagcggagaacctcatctcgagggagtgcgtcacatccttcataccaaggaaacaaagtcccactcgaaacacaaagaatacaaacatattcccctcgccaagctctataaaagcactgtcaaccacgacatgatttctattccttcgttcacagcttctaaagaacatggttttgactttgagaatttctaccccgagttcgaaagagttgtagaaatttataatgcctggggatcttcagaaaccacagccgctctaaacaaccccttccctatccaaggtaaagatagcgaagatcctcgaggtacagtaattgaaggattaaagaagaatctccgcttcggatttgttgctgggggtctcgacgatcgaggaatttataaagactactttgactctccgcaagtgcaatattccccagggttgacggctatcatttgtaataaatatacccgagagtctcttgttgaagctttattcgcacgtcattgctacgctacaacaggacctaggatcgtcttaagcttcaacatcacttcagcccctatgggctccgaactctccacagggtcgaaacctggactcaacgtcaaccgtcacatctctggtcatgtggcaggcactgccctactcaagactgtagaaatcatccgcaatggcgaagttctccataccttcttccccgatagcaataacctggactatgaatacgatgatatggtacccctaagttcagtgaccctaaaagatccaaacggtaaagcaccttttgtattctactatctcagggtcactcaggcagacaatgctatggcctggagttccccaatctgggtggatttaaattaagaaactatcctatctaaggatttcttatgatgacactttttctcgtaatctgctgtgccacagtattgttaggtctagggatgggtattctacttgtaggttcccatttgcttggcaggcccctctctaaagggtgtcaaaaaccagattgctgccaaaaaaaaacatgtgacaaaacagagcactgtgctacaaaatctcgagagaatagtacatcaaagtgttcatcaaatgacgacgtgcctcccacagccccctaaaacttcccccccctactccatattcgaaaaactggatgcccaagaacgattaagcagtgaagacgctcttcatctcctcctcctcacgaataaagaagatcaacgcacactctggaattttgcagaccaagttcgcaaacaacgggttggcgacactgtatactactcctcaaccttgtacctctatcctacaaatttctgtgacttcagctgcaaattttgctctttctatgcaaaacctggagaccctaaaggatggctctactccccagatgatcttctacagcaaatccaaaatataaaaactccaattacagaagtacatatcgtgggaggctgtttcccctcctgcaatctgcaatactattccgatctatttactaaaatcaaagagtacgatcctcagatccatatcaaagctcttactgccattgaatatgcctatctctcagatcttgataacctttctattcgcgatgttcttctcacattaaaagatgcgggtcttgattccatccccggaggaggagctgaaatcctcgtcgacaaaatacgtaatttcttagctcccaaacgcctttcttcttctgattttctcaacatccataagatggctcatcaactgggaatccatagcaatataaccatgctctgctatcataaagaaggacctgaagacctcgtcacccacatggtaaaagtccgcgacttacaagacgaaactcagggctttaaaaacttcatacttctaaaattcgcccaagaaaataatgtcctaggaaaaagattaagaaaatcaggccagggtcatgccatccctctaaaatctttaatggcagtagcccgaatcttcttagacaacttttccaatatgaaagccttatggaattacctaggtattgaggcagctctagacctcctttcctgtggtgctaatgacctttcttcaacacatatgggggaaaaggttttccagatggcctcatctaaagaacctattaaaatggacgctgagggaatggcggccctcatcacacaacaagggagaacgccatgtctaaccaactccagccatgtataagcttaggctgcgtaagttatattaattcctttccgctgtccctacaactcataaaaagaaacgatattcgctgtgttcttgctccccctgcagacctcctcaacttgctaatcgaagggaaactcgatgttgctttgacctcatccctaggagctatctctcataacttggggtatgtccccggctttggaattgcagcaaaccaacgtatcctcagtgcaaacctctatgcagctcccactttctttaactcaccgcaacctcggattgccgcaactttagaaagtcgctcctctataggactcttaaaagtgctttgtcgtcatctctggcgcatcccaactcctcatatcctaagattcataactacaaaagtactcagacaaacccctgaaaattatgatggcctcctcctaatcggagatgcagcgctacaacatcctgtacttcctggatttgtaacctatgaccttgcctcggggtggtatgatcttacaaagctaccttttgtatttgctcttcttctacacagcacctcttggaaagaacatcccctacccaaccttgcgatggaagaagccctccaacagttcgaatcttcacccgaagaagtccttaaagaagctcatcaacatacaggtctgcccccttctcttcttcaagaatactatgccctatgccagtaccgtctaggagaagaacactacgaaagctttgaaaaattccgggaatattatggaaccctctaccaacaagcccgactgtaaaaagatcttcgattccatagcgagtaagtatgatcgcacaaatacaatactctctttaggaatgcaccatttctggaatcgctctttgatccagatcctagggtcgggatactctctcctggatctctgcgcaggaacaggaaaagtcgcgaagcgttatattgccgcacaccctcaagcatcagtaactctcgtcgacttttcctcagcaatgctcgacattgcaaaacaacaccttccccagggctcttgctcttttattcatagcgatattaatcaactgcccttggagaatcattcttatcccctagcagcgatggcctatggcctcaggaacctctcggatccacataaagccctacaagaaatctcccgagtgcttatgccttctggaaaactgggcattctagagctcacacctccaaaaaaaacacaccctacctatagtgcccataagctctatttgcgtgctgtcgtcccctggattggaaagtctgtttctaaagatcccgacgcctatagctatctcagcaaaagtatccagcaacttccaaaggaccacgatcttgaagacctattctctaaatcaggattttatattgcgaaaaagaaaaaattgttcctaggagcggctacgatttggctactagagaaacaataaaacatggaggatctccaagcttggtcgcaaggagctccctaagattcgtggagtgctctaccccacgctaaactaaaatggtaaacctacctctgggaagactctcatcagcaaaactcccgacaagcttcgtcctgacacaactcttaaatcgctgttttagcatagcagtcttgctaggttcgttatcgataataaaagcaccctcttcatccgaagactcaaagaactgcataatctcaccagaagcaactaaactctccaaaagctctacaagctcggtacgtctttcaccaactcctctaaggacaaatctcccaaacggctgattctcccaatatccagaaatacgtccagcctgcaccagaccctcgagtaccgaccgaatctctccagcttgatcaggatggtcataccaaccttcgattccaggctctaggacccgtagccccttaaagagaatctcctcatcagaagccaccaaaaattccgttaagatgttatttttaggcttagactcgaattccgatttaaagaggtctagttttgacgtaggaagaggtttagctgtacagctcctccctacgttaaagctttgcaagagccatgccactaaagaattgaatactttaatacgtgcttgtgactgagttgccgccagccctcgggcaagaatcatattccctaactctttgtttaagaaaatttcttctaatccttctttctttgttttaaagaaaaatttatagagcctctccgaccaacgccaattcgtacgccaattctcaggtaaatcaggaacgtgtttctgtatttcatccttagaaagttcataatcagctaaatagccattatacaagtccaactccatacgacgcgcacgagtagcttctaaaatcagacttttttcttcatctgtaaacatcacctcaggttctttaggcggctctggatagggaacattttgaactacaagcgcatacctcagagaaaaactcggctcctcctctgtccctggtgtagaatccacggtagcctcagccgccgcagcctctgaaaccccagatgtggtgtctgtagttcccgaagctgcaggcatggtatctgttgtattccctggagctacaggtgaagactctacagtctcggaagctgcaggtatctcttgagtaggattggcgttcacaggaaccatttccgaatccacaataacagcgtccttactacctaaacttttaggaaactttaggcgcttcattgtttcttctaaccaaactagccgctcctcagaaccaaggataggggcccactggaccaaagtactacatagccggccgtgggctggagaaatttgagaaacttgtggctcaagagaacgtatcccaatagcgggcccagcctcctcataatcacttttcacagagaggttatcccactgcaaagcaaaaggacgcctttgaagaatacataattttaatatgtcatccaatcccgaaattatagaaaaattccttttagcaaactccttacccttcgcaccggaagtgtgctgcgggacaaagaaaggccctataggcaagcgctcattaggaactaaagtagggaagtcacagagcccccttgccaccatacatacgtaataggccttcgcgatagccctccccaggacggctaggataatcttcacgaaccatgacactcggaatgatatcgatattcttcaatcccattttctctataatcaacttagagtggatcaaccggtagcaatctaccatagcaaaatgggcgtcgtaatcagagcggaaagcctcacaaatcgtattgccttccttagtcctcagcgatgacccttgtttttcaataacaaagcacaaagaactgacgtgaggcctaaaatcccgaatcaaacaggcccaatccaccaaaggctcgttcggtggctcagggctgaaatgctccataaataggaaaattttagcagctaaggcatggttaagaccatggttctgaaatggagagaataacgtccttactataggaatctcgcctgtgcctaaagatgatcgtcctaaatcccaatggcggaccccctcgtagtaaacggagcgagcgggcttgtgaatctcaaaagctctcttattttgccggtaactcgtaacagtgctataagtaagataacttataattgcaacgtcaccaagaagtgacatcacaaaaagaattaaccccattaccgtaaaagaggtcgccaaggccataatgcttggaatcaaactagagagggccacacaaaccaaaatgatcaacaatgcgcataaaaagatgacacttgcccgaactagacgtgtgctcaactgattctgactcgtatcctcaagatacgtctttaagctacaggtaacccgagtcggctctattcttccgcagctcagtagtgatgacatgatgaactattcactgtttcttaaattagctttaaaaattttaacagttttttaattaaaaaaatgactaataataaatagctattgttaaaattttaacaaaacaataaatagaaataagaaagatttgtaataagatcatgtaaagaagcaataagaacagcgtctaaaaataaactacttcacaaaatagaagattaagaagattttttgcggcctcgcttgctccccttcgtcttagtgaccactttctcatcatcatcaccaaagaaatctccagtagaaagagagtcgtaaccaagcttagccgaaagctctttaagagaagcaaacctctctgaaagattggtaagattcagctggtcttcaacacgagtcgaaccgcgcaagttagcaagaaattcttcttccgtatcaaatttttctgagaaagtaattgaagagggtgaagtaatctcgggtaagaaaaggaaacgacgagcagcctgagggacttttgtataaatatcactcgaaattgttgtttctgtttctaccttagcagattgcttcggaggacggcctcgtttcggacgagggtttaatgcttcattggaatagtaaatcttagctttgttcgacaacaactgacgcgcttgagtgatttctttccccaccttggcatcaaacaaatgtattttcaactgttccaaaacattctttgtgaaatctagatcttcttcaaagacaaaatggaacttattattgcgaagccattctataattcgaattcgagaacgctctacataaaattgctgccacttttctaactctgcctcgtgatcataaataaactctaaaaactgctcacgggcattcttggattgcaaaatctcaaggaacttttctttggtatcgatatcataaatcttttcattgataaacgtttccatgattttttttacttcataaaacgtcaacttcggaatcaaacaataccgctcggcattctcttctaattcttggtaaatcttatttagatcctcttggtctttatctaaatctatgtagagaataaacccttcaacacgatctaaataaaagtccctctcatcgtcagacttagagaatgcatccataagacgaaggattcttaaaagaagtgggttttgtggtacaggatacgtcatcataaattacgattatagaaaaatcccagttagagagcaagatctatccctaaacaagattttaaaatccttgcatgacaaaatcaaaaatcacatctaattataaatctctagttacagagccctgaagatatacccgtcccctattttgactcacagtcataagctctccaccccaagtatggatttggatcgactccttccatccataggagtttgacacaacaagagcagaagctagagcccctgttccacaagctgcagtttccccttcgactccacgttcgtaagtacgaacgcgcaactggcaatgtcccagtatctgaacaaaattgacattcaccccatctggagagaaggtctgatgatagcgaagaaaaggacctaagatagaaagatctaaagtagaaatctcaggaagaattacgacagcatgaggcactcccgtatggatacaaacgatctctttgggaagaggatcaggacgcgactccaatcgatgaacagaagctctccaatctgcgagagtcatatctacaagcacacgatcccaagaataaaaatatcctgaatatagaccactatccgtagatacagagatgtccgattttcccttctgagaagctaagtgagcaatcgcacaacgcaagccgttaccacacatcgttggacgtgatccatcggaattaaaaataatgagttgcgcatcagcacaagaagagggctttaaatataaaaaaccatcaaccctcgtctcttggcataagaaccgaacatcttcaacctcaggaagtgtttcaccaagaaggaaacgatttcctgctccagaatagataaaatatttagagatcgttgaaggagaataaaatgccatccaataaaccaaaatccttagcttcgttggctgtcatccacatatctctatcgatagccttttctatgatatctcgaggttgatttgtcgcctctacatagacatctataatgcgagcttttgtttttaaaatctctctcgcatgaatgtctaaatcggttgcctgaccggtaatcggtccacctattgaaggttgatgaatcataattctagaatgaggagttgcaaatctccttccaggagctgcacataaactcaataccgagcccatagaagctgccaaccctgtcacaacagtagtgacgggtgaggttaacattttaatttgatcccaaacagcaaaacctgcgtccacagatcccccaggactattgatcacaaaaactataggctttccaggatcttttaattccaaataccaaagctttttaattgcatcggaagcacttttctctgttacaggctctgagaaaaatactctgcgcgcttccaataactctttttctataatatcacgtaatttatgaacttccccgtctgccataaaataatgtctctcctaactaaactaaagcttctaaatcaatttcagggtagagcgggaaacgcagcaacaagttgcgaacacgatctctagcttcctgcgctatggcttcaggaagttcccctttatttttcttagaactcccttcaacatggcaacttaaacgaatatttcgcaatactttcacaataatatctgcaacttcttccatttcatcgatacccatacccaaagtcgttagtgcaggggttcctaaacgtatacctgaagtgtcccacttaccaatagcatctgaaggtaatgaattccgattcacagcaattcctacggaactcaagatatcttcagcaatttttccagaaatgcccaaagaacctaaatcaatcaccatcatgtggttgtctgttcctcccgtcaaaagacgtagcccatgacttaaaaatctctctgctaatcgacgagcattatttacaacctgatgagcgtatttcttgaaatccacagagagagcttccttcaaagccactgttttagcagctatcacgtgaggtagaggacctcccatcatcaaaggacacgccttattgagagtgctttcatactctcgagttgccaaaactaatcccccgcgaggaccgcgtaatgtcttatgcgttgttgttgtcactatatctgcataaggaataggattttcttcatcaacaaacactcccccagcaactaggcctgcaaaatgcgccatatctacccacaagacagatccacaatcctctgcaatctgttttaaaactgcaaagtttaatcttcgagaataggaagaatatcctgcgatcagtaccttaggtttatactccttagctaaccgggagatctctgcataatcaaaacactccgtatccggattgacatcataggggaagcaacgcataagcttagacatcacatttaaacgtacgttcccatgggtcaaatggcctccagaatttaatgaaggtcctaagcaaacacaagaagacatttcagccttaagtagagtgtattcttcttctgttaattcgtttacagttttataacctaacttactgacagctgggccttggactttgtgcgtgagaatggccattactgccagtaaattagcatcagccccagaatgaggctgaacacaagcgcaatccgcagcaaaaagttctttcgctgtctctacacactcccactcaatagcatctacattttcacaacaggaatagaaacgcttaaagggacttccttcacaatacttatctgtgagcaagttccccatagccaactgcactgaaagtgaagaatagttttcagaagcaatcatctttaaatgggaacgctggctcttcaactcatcaatgattctctccccaatggaaggaaacgcatttaagagatggtcaagagctgctaaatacgctgtcgaagctaaactttgtccctttttccccgaagcattttctaaaaacttatgcaacaacgaaaccaccgcaaccacctttgtaaatatttccactattgcgaatttcttaaatttctcaaaaacttttagcaaggacttctaaagacgaagccttaatagagagaacctctaagtccagaaaaaaccagcctagctttcaaagtgaaaaatgtcaatcaacgcatgatcaagaagaactaagggaaaaagaaaaattattttcaatatatccctttgaaggtacaaaaacttaggcagccttccttttacccgaaaagactcatgaccctctacttaggattgaatcaaaaaaccgctcgtaaataccaagctcattatttgcctattctaactctcttcccctatgcaaaaagcactccacaaaataagcgtgctcttcaattccttccacaagcaacccatgtgattctcacaagtccctcatccactcacctattcctttccagaatgacttctcttctttctaaggccactctaaaaacaaagacctacctctgtataggagagtccaccaaagaaagacttctctctttccttggacaagtgaagtacgtagtagcaactcaagaaatcgctgaaggcatcttcccattgctacaggcactgccctcttcagcccgcattctctacccccactcctccctcgcaagacctgtgatcagagaatttctttacaatcgatttacttttttctcttaccctcactacacagtgaagccgcgaaaacttaaaaaaaatattttatctaaatacaaaaaaattatcttcacaagcccttcaactgtaagagctttcgccaaaatctttccgcgatttcctgaaaaaacctactggtgccaaggaaggatgaccttgcaggagtttcaaaagttctcctctcaaaagcaggtatctttgttagaaacgcttgggaagtccaggacatctccgtgacaaaaaagaccccactactttaaaatgctttatgctccgaaaaaaacttaatttttaatagtttatggcttcttcagctactcccggttttgatggaacggctccctctctatttcccccagctactcgtcctcgctataatttcaagcttgccctcttcgttactattgcgattgcactcgtctggatagctctgattgctaccaccatagctattgggctatgtatccaccctttgtgctcctttatcttcctaacagcaattcccttatactttatatctcgctatatttgctcccactacgcacgcaatgtctacatagctctagatgtcgtccccgatcattctaaattgcaagacatgcgctctcactctccaattttctcggatcgataaacaaaaatttgttaaaattatagaaagtattttacaaaaaaaatgttatgtcaggaccctcacgtactgagagctctcaagtttctgtactatcctatgtgcctcgggataaagaaattgctcctaaaaaacagtttaccatagcaaaaatatccactcttgcaatcctagcttctttagctttaggagctttggtggctggaatctctttaacgatagtattagggaaccctgtatttttggctcttctcattaccacggccctcttctcagttgtaaccttcttagtctaccaccaaatgacctcaaaggtatcttctaactggcagaaagttctagagcaaaacttcaagcctttgggaaaagcgtggcaagaaaaaaacgtagactgcnactcaaacgagatgcaattttacaataatcacctgaaccctaagttcaaggtagcgatacaaacagatgcgtntcaaccatttcagcctactttcttaactggacttagagtgatcgaaaaaaatcaatccacagggatcatctttaatcccgtaggcccaacgaatctgatcgacaacactgcaacgaacctctctactatcctttactccaccctaaaagataaaagcgtgtgggatacatgcaagcaacgcgaagggggtcccgcaaaaggagaagaccccttttcccctaccgaagtgagagtagtaaaacttccaaacgaagctctagatcaaacgtttaatctaaatttaagctctgcagaaaagaaaagtattcttccgacctttttaggccacgtatgcggccctaaatctgaagagttaccaaatcagcaagaatattatcgccaagctttactagcgtacgagaactgccttaaagcagctatagaaagtcatgcagcaatcgttgctcttcctctctttacttcggtctatgaagtgcctccagaagagattcttcctaaagaaggcactttctattgggacaaccaaactcaagcgttttgcaaacgcgctttattggacgctattcaaaatacggccctacgctatcctcaaagatctttacttgttatactccaagatccttttaatactatagaatcacaaagtcgttctgaggagtaacccaaagggtttcaccaacaaccctttataaagtttagctaaaaattttctcaacatttaaaagtatatttttattttttactaaaaatgattaaatgcgctttggaagtgttcttacaggaacaatttacaagtaaaaattatatgaatggctagacattagttctaagaaaagggcatttcgcttgctcaaatttataagaattttccttacaaaaaaacatgctttacttcttgcctaaaaagaggtaaactgtatttttcttcacatgtatcgcattcctaaactccatagtgatttttggctttcttaggaaacttaagtaaggaataattttcatgcatgacgcacttctaagcattttggctattcaagagcttgatattaaaatgattcgccttatgcgcgtaaagaaagaacatcagaaagaattggctaaagtccaatctttaaaaagtgatattcgtagaaaagttcaggaaaaagaactcgaaatggagaatttgaaaactcaaattcgagatggagagaatcgcatccaagagatttctgaacaaatcaataaattagaaaatcagcaagctgctgtaaaaaaaatggatgagtttaacgctcttacccaagaaatgactacagcaaacaaagaacgtcgctctttagagcaccagcttagcgatctcatggataagcaagctggaggcgaagaccttattgtctctctaaaagaaagcttagcttctacagaaaatagtagcagtgtcattgaaaaagaaatttttgaaagcatcaaaaagattaatgaagaaggcaaagctttgcttgaacaacggacagagttaaagcatgcgacgaatcccgaactactcagcatctatgagcgtctattaaacaataaaaaagatcgcgttgttgttcctattgaaaatcgtgtctgcagtggttgtcatattgttctaactcctcaacacgaaaatcttgtaaganagaaagaccgactcattttttgcgaacattgctctcgaattctctattggcaagaatcccaagtcaatgctcaggaaaattccacagcaaaacgtcgtcgtcgtcgcgcagctgtataaagttaatcggaagagaaaggcaaccgctgtttatatttctcaaaaaatataaagagaggaaagtctggacttcataagagaagatactggagaaattccaggggccgtaaggctacggaaagtgcaacagaaaacactccgctataaaatttattttatagacaggctgaaaattcctactttaggagtaggagccattaaggtgacttaataggcatgcaaaccctatctgaagcaagagaaaaaagctttttgtgtctgcaaatgtgagaggaattcctcccataggctttttcgaaatcgcttgagggatctagtaatagctcccctagatgaatggttgcccttaggatagttcgcaagagctatcttatagacagaatccagcttaccctctcttccgatatttttctcatattctcaaagtagaccagctttggctaaagtgtgcatatgcaacaagccagtcacatgtcggttctcctcgttatctaaaacaggaagaacagctacaggactactagattccataagttgcaaagcaatggcaatatccgaatcttcagtaatacatcgaggatttgccgtcatcaccttctccaaagataacgaaagcacctcccccccataggaagctaaagaacgccgtaaatctccgtctgtaaaaattcccataagtcggaattgaggatctactatacaaacacaaccacaaccgtaagcagaaaagacctctaaagaaaaactcactttatctccaagatgacagaaaggtacctctgtctttgggaacataaaatctttaaccttaccattagccttcatcccaacctgcccactaggatggtttttgccgtacgtagataaagaaacaccacgactatgaaaaaggagcatagctaaaaaatctccaaagatcatttggcatgtcgtagaatttgtagggattaaattaaaaggatctaattcagcaacagagggtaaaataacgactaagtccgagagagccgctaaattagaataaggcatggaagtaatcgcgacaagaatcgcccttcgactctttagatgaggaaccgtatctagtaactcttgggtttcaccacttttagaaaataaacatacaatgtctccaggactcacaagaccaagatccccgtgcagaagatccacaggagaaaagaacagagcacgttcacttaaagattggagtgtagccactaattttcgtgctacacatccacttttccctacaccagaaaaaaatacccatcccgaatgaccgagtattttttctgctaattgcattgcctctttgggttgaaaggcttggaaaaaaaaatctacagcttctttttgcttacctagaatgtcttggcatacgtcagtagaaatcatcggggaaggcattcggttctctttggattggctacactttagcccatcgtaacagactccaaacgatttttcaatgaggttaaaaactcactgccgtaaataccatccaatactctatggtcaaaggtaagtgtcacatagaccattttgcgaatggctaaagaatcgtcatcacggacgacaacacgtttttgtattgtgccaattcctaaaatagcaacttcaggataacgtatgatgggcatcccaatcaaagctcccgtcattccaaaattcgtgacagtaacgctgccatcttgcacttcactaggatccaatttatttaaccgagcccttgaagatagatccgccaaggcctttgcaatacttactaaaccgcgatcttgacaattgtggatgacaggaacaacaaccccttccttattgaggttcacggcaacgcctacattcacagatttcttcataacaatggtagtcccatctaaggaaccattcaataaaggaaactgccttaaagtctgagctaaacactgtacaatgaaacttgtaatcgttagcttcaccccatgcgtatctaagaagcgttggcgttcaccagaaatcagattcataagatctgtgacatcgacatcaacaaccaaagatgcgtgaggaacctcatctgaagacttggagagagaagaagctattgcccgacgtagcggagacataggaatgcgattcacttctccttgaaatatttcgggaatagaaacttgttgcgattctgaaatatacgcttctaaatcctgacgagtcactcgtccccctttccccgtgccggcaatcttttggaggttatcaagaccaatgccttcacgttgagctaaactcagcacggcaggagaaaaccataccgaagaactgctggaacccgcctccgactttgtttcacaagaagtcagaggacatgaggtgctctcatcatcagcttcggaaatctcctcaagctctatcaatcctaaaacatccccagaagcaacctcgtctccctcattgacgcagaaacgcaccagtcggcctgctttaggagagggtaattctgtagcaattttatccgtagatacttcaatcagaggctcatctctagctacatgatcacccaaattttttaaccaacggactatagatcctccggaactcgtctctcctattttagggaatcggaactcaaatatcatgtatcgttaccttctatgtagtttcaacgctttcctgttttattgattcataaggagaaagctctccttctccagaagctacataagtagcaactacagcatccccaagaatattcatgggtgtacctacaatatcccttaaccggtcaatcccagcaagtatagcgataccctggataggtaaacctacagaggctaatacggaacccagagtaatcatacctcctccaggaacaccggcactacccacggcagagaatgttgcggtaactaccaataataacagactgctcaaggatagcggacaattgtatgcttgagcaatgaaaaccgctgccataccctgaaaaattgcagttccattcatattcacagtggcgcctagaggcaaaacaaaaccagaaacctcagcggacactcccaaatttttagaaacacaacgcatcgttacaggtaaagtcgcagaactactcgctgtagataccgcgcaagaaatcgcatccatcattgaagagagaaacttcgaaaaggacatcttgcaaccaaaacgcacaagtcccccaaaaacaagcgtagcatggaacaaacacgccagatagtaagcaatgataaatttgcctagctgccaaaggactcctaaaccatgatttcccgaaatccatgccatgctagctcccacaccatagggagcaaaactcatgatcatatttaccatgcgcaacatgatttcagaaaaaccatcaataaaacgctcgacagggcggccacgttctccagaaagccgaagggcaattcctaagaaaatcgcaaaaataataatttgtaatatattcccttcagcaaaagagcgtacaggattcgatgggaaaacttgagctattatagaaagaaaatacgccgctgttttgtttgaatcaatgacagtaacggccgaatccatagattgggcctgggcaaaatcacacccatttcctggagagaaaatccaagcaaaacacaagccaatcacaatagctagtgccgtagtccctagatagaggccgacacttttaatgccaatgcgtcccaattttttcatatcgctaatggaagcgattcctaaaaccattgagcagaacactaaaggatacactaccatgctcaatagatttaaaaagatgtctcctataggtttaaaaaagatggctttatcttctaaaactaaacctaaggtaaccccgacaaacaatccaataaagatcttcatccataatttcattagttacccctgtttttatgtatttgttcaatcatgttgagaagagaaagtgtatcgtcttgattcacagaaaggcgcatttccaccttagctatcggcaataaacttacctctcctgataatcgaggaagctttacactatctttttctgtacataacaacccttgtccttggcgcatggccatttgctgacaaaagtaatttaattctttttttgttattgctgcgtgatcaggcaataaatactttcctaaaatatgaattccttcttctctaagcatattcaaaaacccttgaggaaaccctaaaccacaaaaaacccccacacgcaattctcgaagagcctctttaggaatacgctctccgttatgggtccaaactacagaagctattgtaggtttcacaaagatctggggggcattcgaaacacgtttcactacagtcccagcctcttttccaccgccatttacaataatggcatccacagtcttcaatcgaagaggaaaatcccgaagccttcctttagggaagaaggcacgtcctcctaaaggatcctgaccattcactacagcaatttctacgtctttgtgtagtttacggtactgaagaccatcatctaaaaggagaataccaaatttctctgcagcgcgtgctgcagagatcctccggtccttatgcacccatacggatccctctggcagtttctctgccattaataaaggctcgtcccctacataggacgcagaatggactttcgagtctacaacagtcagtttcttttgccgactcgactggcttttatagccacgcgacagtacaccgcaagaataccctcgaagcctcaaagcctctgctaaccacaatactgttggagtctttcctgcccctccaacaacgatattgcctacactaatgactgtagaacgcgcacgataaggagtagaccaggaaaatcgattccaacatgccaccaagaatgcaaaaactttggaaagaagggaacctaaccagccccatcccaaaataccctcaaggctaatagctatggtgacacggcgataaaagagaaagagtgtggaaggaaaccgttttttcattgttcctcttttaaacgcacgaatttctttgcacgaaaatcatgctttttaaaagatcacaatcttcgccgtattacaaagaatgctagtattgcagaagaaaagattaaaaatcaagtttacaaagcttaattaaaaaattgtgttaaacaaaaaactaatataattaatttgatctcaaaaagaaaaatggtgtactaattaacccaacgttgacgaacaacttcataagctacagcagctacagatgtagcgagattcaaagaatctgattcccctaacataggaagagcgatttcagaaaaatcttcagaaaaccaatcctcagtcaaaccatctttctctgaaccaaaaaccaaagccgtgggaccaagataatttttagaaaaatacatagtttcagctcgaggagatgtgacaaaaacagtccagccttcctgcttgaacaactccttcccttcctctcttgaaatagagaggatgggaagagaaaagacagctcctaaagaagagcgcaccacattaggattgtacaaatctacaataggattgcataaaatcacaccgtcaacaccagcaccatcagctattcttaaaatagcaccgacattcccaggtttttccacctgctcaataataagatagaaaggctgagcatttttacgttggatcaaaaaatcttctttattccacactctcttttgtatcaccgcgacgaaactatcgtgatgttctttaaaagaaagttgagccaaagtcgagtctaagcaatataaaatctttgtagaatttctttttaactcatataaaaattccttttctttttctgaaagatgtgtcgaacaaaaaacatgctgacacaggtagcctgtgcgtaatgctttctgaatctcacgggctccttcaactagaaaccaagaactttttctacaacgagaccgttttaaagctagagcctctttaactagaggattatgtttccctatgcaatccattgaacaaaactcccagaaggcaaggctcccacaccttctccacaaaaactttccccacaagaccacgcttcagaaacaagggttggcacctacgcctagctatagcccttaaaaactctggggtatgtcctggagtatgagaggttaagagaaaataagaagcgtcatctgcaagaagcttcgaacacaaagaaagcaaaggaaagagatctttatctattttaaatacttccccatcaggtccgcgaccatagcttgggggatctaaaagaatcacttgatatttcttatttctgcggatttctttttttaaaaaagaaatcacatcttcaataacccaaaaaatacgtctctcaggaaaagcatttttctctacatttctttgcgcccaacgtaccgctgcctgcgaagcatctacatgggtcacacgagctccacacttagctgcaaaaatagaacccgcccctgtataagcaaagagattcaatacctgacgttctttgtgcttctcaatggcttgtttcaaagcgggccagaaccccatatgttcaggaaatacgcctagatgcccaaagggggttctcttcaatagacaacgcacatcagaaaatgcgacctcccattcttcaggaagacgcttaaaatttttccatgctcctctttctccttcacgaacatactgcaattgcgcctgagaccatagttcaggtctgctttttggccaaacagcaatacttgaaggacgaattaaagtgacaggaccaaaacactctaatttgttcccgtccccactatcgagcaatttataatccataactaatctttccctgatgaggctaaaatacgttttactgtgtctacctgtatctttgttgacatatcgatctcgatattgactctttctccttcccttttctttcctaaagtcgtcctttgaagagtctcaggaatcaatcccacagaaaacgtatcactatcaactgacactagcgttaagctgacaccatcaattgcaataaaccctttttcaaaaaggtactgagataattctttggaaccacggaaataataacgattttcttttatcaagaaaatctctgctgttccaaaaacatgcccagagagtaagtgacctccaatcgagtctcccatttttaatgcagcctctaagttcacttgatcgctacatcttttttctcccaaagtcgtacaagctagagtttctggaatcacatcaaaaaagatcttactttcattgcatgatgttaaagtcaaacagactccatctacggctacgctatcccctgtaaccagaggggtgacaaatagtggcgtgctcttaattcctaaactcagaccatttccttgagcttcaaaaaaacacacttcacctaattcttgaataattcctgaaaacatcccaccccatttaacaacagaatctttacaacaaaagctttcctagagtagagtatgtttttttcgtctcaataagcaaagcaattttgcacagaaatttaagataatacgaatccctaaagccgtttctttagagaagtatttcctctacccttgatttcctagaaaaaaactttgcaactatagtctcttatatttatcctgatctaaaaattcggtttttcttagactaccttaacctaggaggtagctcccatgcagtgtcctttttgcaatcatggggagttgaaagttatagattcaagaaacgctccagaagctaatgcaataaaacgccgtcgggaatgcttaaagtgctcccaacgttttacgacctttgaaaccgttgaacttactttacaagtactaaaacgtgatggtcgctacgaaaattttcaagaatctaaattaattcacggtctgaacgcagcttctagccacacacggattggtcaagaccaagttcatgctatagcttctaatgttaaatctgaactcttaggtaaacaaaatagggaaatttctaccaaagaaattggcgaactagtaatgaaatatcttaaaaaggctgatatgattgcctacatccgatttgcctgcgtttatcgtcgattcaaggacgttggtgaattaatggaagttttattgtcagcaactccagatatggaaaaatagttgaattttataaggagcaaggttgtgccgttatcagatgacgaaatagaacagtttaaaaaaagacttttggagatgaaggcaaagttatcgcatactctagaagggaacgctcaagaggtaaaaaaacctaacgaagctacaggatattctcagcatcaagcagaccaaggtaccgacacctttgatcggactattagcctagaagtcactacaaaagaatatgagcttctaagacaaattaatagggctctagaaaaaattaatgagtcttcttacgggatttgtgatgtcagcggagaagaaattcctctcgctaggttgatagccattccctatgctaccatgacagtcaaagctcaagagcagtttgaaaaaggactcctatctggaaattaagttctatggcaactcgttttcgtagcacactattagtgattactctgtttgttttaatcgactgggtcaccaagcttgttgtcttattacaatacaaagatctccaaattttaacgcaccccaccttatatactcatagttgggggcggttttcattttcaattgctcctgtatttaatgaaggggctgctttcggtctcttttcaaattataaatatttcttattccttctgcggatatttgtgattcttggcctcctggcctatcttttttttaaaaaaaaatctatacaatctacaacgcagactgctctagtccttctctgtgcaggagctataggaaacgtcggggatattatcttttacggccacatagtcgatttcatttctttcaattataaacaatgggcattccccacctttaacgttgccgatgtattgatttctcttggcactctgctccttgtttataaattttattttcctacaaaacaaactgaaaaaaagagataatatagatctcttcaagagaagctaagatatgtttttaaaactgttatgaaccgtcttctatcgcttttatccgtctttgatgattttttctggtcctatgtggcctttattctaatcattgttctaggtgtaagtttttcctggaagtcgcgattttttcaattcacgaagttctctcagttttgcaagcttttccgttattactctcagaatcctcaagaaagagaaacaaagcaaggtgtccatcctctaaaagtattttttgcctccgcaggcggaaatatcggcatagggaatgtcgtaggaattgtcacagcagcatgtatcggtggacccggggctcttttctgggtgtggattgctgggatctttggttctattgttaaatattctgaggtctatctcggaatcaagttccgtaagttagatcgtgatggcgtctatcagggcgggcctatgtattttcttataaaggcgttcaaaacccctgtcgtgtctgttattgttgcgattcttctctgcatttatggagtggaaatctatcaattttcagtcatcactgacagccttgcccactgttggaacctacctaaagtctatccgatgttaggtctactcttccttgttttctatgcaattcgaggaggcttgcagcgtataggaaaaatttgttctatagttcttcctttcttcatgctcttatactgtgccctatccctctacatcctcgttaaagagtttcatacccttccacacctactttccacagtattttcttctgcatttaaaggtcaaagtgcccttggaggatttgcaggctgtactgtagccactacgattcatcaaggaatttcacgagcagcctattctggggatatcggtataggctttgactccatcattcagagtgaaagttctgctaaagatcctagcacccaagcgcaactcagtattgttgggattgccatagataacctgatctgtactctgagtcttctcatggtgcttgcttcgggctcctggtctctgggattagagaatgcttcccaagtagtagaacacactctagcaagctacttccctatggtgaagttcttcctccccaccttcttctttgttacaggctatacaaccatcatctcctacttcctggttgggaagaagtgtgcaaagtttctttacggaaacacaggggcaaagatctatactctctatggtcttctgattcttcccttattttgtttcctcagccaaaacacagctttgttgatcatgtctgtatctggagccctactcctttgctttaacctcttaggagtcttcatcttaagaaaagaagttatcttccctgcaagggctgcttctctcacagaaacttctctttctacagaataaaaaatttaccttattcatacacaatgagataagaagttttaatttttattaataaattaaaagattagttttagaaaaaaacacttcataaagtaaaataaaagaataaaagttgtaattaatttttttactttttatggataactatctcctcggaagcttgattttctgttgtgtacttctatcaatagggatgtgcacgattttcgtgatgacgatctgctttctacgccaactcaataaaatccttaaaaacatccatcgggtgactacaattttaaattttgaggctaagatcctagctcctttgatgttagggaaaaagcttctctgtggatggctaaagaaaagaaaaaatcgcggctctctgtctgaagacattgacgaactcttagatgagaaaaagcagagaagctggaaaaaaaacttagaccaaggaattaaatggtgcgcacactggtcctcatttggaaagtgtttcgtaataaagattaaaacattgagggatatcgttatgttcaggaacaaccacaaacctaaaaaaactaagtgcaaacgatttcgctggctacggggtgttttattcggtggattcatagctacgttattaacatgcttgtttactcccaaaagtggcgtccaactgcggaagaaaatcctcaaagtaaaaaactctggggcaaaaaaaagtagagtgttctttaaaaattccaagcaacataccaagtcattcgtaaaacaagcgaagttgctagctaagaatatctcacacgaacttcaagattttaaaaagggaatcctcgacgacaaagattagagttgctattaagaagctctgtatgattgagatatcttctcagggctttttttcatttaaaagcacataaatagaggctctctccgagaaatgccattctcgagtcaactttttatttccgtgtatttatttttctgttctatgtaagtttagatctgtataaggctataacttattaggactccgacatatgaagcagatgcgtctttggggatttttatttctctcttccttctgtcaagtttcttatctacgagcaaacgatgttctcctccctctatcagggattcattctggagaagaccttgaactctttactctacgcagttcctccccaacaaaaactacgtattctctacgcaaagattttattgtttgtgattttgcaggaaattctattcacaagcctggagctgcattcctgaacttaaaaggcgatctattttttataaatagcactcccctagcggctcttacctttaaaaacattcacttaggagctcgcggtgctgggctcttctcggaatccaatgtgaccttcaaaggcctgcactctctcgttctcgaaaacaacgaaagttggggaggcgtcctcaccacatctggcgacctttccttcataaataataccagtgtgctttgtcaaaacaacattagctatggacctggaggagcgctactcttacaaggaagaaaaagcaaggctctctttttcagagacaatcgaggaacaattctatttctgaaaaacaaagccgtgaatcaagatgaatcccatcctgggtacggaggagctgtaagtagtataagtcctggctccccgattaccttcgctgacaaccaagaaatcctattccaagagaatgagggcgaacttggtggagccatttataacgatcagggtgccataacttttgagaataactttcaaaccacaagctttttctctaacaaagctagtttcggaggagctgtctatagccgctactgcaatctctattcacagtggggcgataccctattcactaaaaacgctgctgcaaaagtaggcggacatccatgcggattatgttcatataagagactgtaaaggaagcatcgtctttgaggagaactcagcaacagctggaggggcaatcgcagtaaatgcagtttgtgacattaatgctcaaggtcctgttcgctttataaataactctgcgttaggactaaatggtggtgctatttatatgcaggctactggatctatattgcgcttacatgcaaatcaaggagatattgaattttgtggaaataaagtacgatcgcagtttcattcacatataaattccacttcaaacttcacaaataatgccattactatccaaggagcgcctcgagaattttcgctcagcgcgaatgaaggacatcgcatctgtttctatgatcctataatttctgcaacagaaaactataactctctgtacatcaaccatcagagacttttagaagccgggggtgctgtgatcttttcaggagcacgcctatctccagagcataaaaaagaaaataagaacaaaacttcgattataaaccagcccgtacgtctctgttctggagtcctttctatagaagggggcgcgattcttgctgttcgttctttttatcaagaaggaggtcttcttgctctcgggccaggttctaaactgaccactcaagggaaaaattctgaaaaagataaaattgtcatcacaaatttaggattcaacctagaaaatctagactcttcggatcctgcagaaatccgagctacagaaaaagcctctattgaaatttctggagttcctagagtctatggtcacacagaatctttctatgaaaatcatgagtatgcctccaaaccttatacaacttcgattattctatctgccaaaaaacttgttacagctccctctaggccagagaaagacatccaaaatctcatcatcgctgaatctgagtatatgggctacggctatcaaggctcatgggaattctcctggtctcctaacgacactaaagaaaagaaaaccattatagcctcttggactcctacaggagaattttctttagatccgaagcgccgtggatctttcattcccacaaccttatggtcgacattctctgggctgaatatagcatcgaatatcgtgaataacaattacctcaacaactccgaggtcatccccctgcaacatctctgtgtttttggaggccctgtctatcagattatggagcaaaatcctaaacagagctctaacaatctcttagttcaacatgcgggtcataatgttggagctagaattcctttctctttcaataccatattgagtgctgcacttactcaactcttctcttcttcatcacaacaaaatgttgctgataagagccacgcgcaaatattgatagggactgtatctcttaataaaagttggcaagcactatctcttagatcttcatttagctatacggaagactctcaggtaatgaagcacgtattcccctataaagggacctctcgaggatcttggagaaactacggatggtccggatctgtcggcatgtcttacgcctatcctaaaggaatccgctatctaaagatgactccctttgttgaccttcagtatacaaagttagtacaaaatccctttgtggaaacgggttatgaccctagatatttttcttcctcggagatgacgaacctatctctaccgataggtatcgctttagaaatgcgctttataggctcgcgttcttccctatttctccaagtcagcacctcgtacattaaagacttacgtcgggtcaacccacaatcttcagcttccttggtgttaaatcactacacgtgggatatccaaggagtccctctagggaaagaagctctaaacattaccttaaatagcacgattaagtacaagattgtgactgcctatatggggatttctagcacccaacgagaaggcagtaacctttcggcaaatgctcatgcaggcctctcccttagtttctagaagttagcactatagaaataaaagaagacttaaaaagcgcgtggttatcattcaaacacgcgcttttttatcccttgcctaatttatccatctgatttatctatcacttatcgagtttgtgaatatatctgataggttttcctctatgaagtggctaccagctacagctgtttttgctgccgtactccccgcactaacagccttcggagatcccgcgtctgttgaaataagtaccagccatacaggatccggggatcctacaagcgacgctgccttaacaggatttacacaaagttccacagaaactgacggtactacctataccattgtcggtgatatcaccttctctacttttacgaatattcctgttcccgtagtaactccagacgccaacgatagttccagcaatagctctaaaggaggaagtagcagtagtggagctacatctctaatccgatcctcaaacctacactccgattttgattttacaaaagatagcgtgttagacctctatcaccttttctttccttcagcttcaaatactctcaatcctgcactcctttcttccagtagcagcggtggatcctcgagcagcagtagctcctcatcatctggaagtgcatctgctgttgttgctgcggacccaaaaggaggcgctgccttttatagtaacgaggctaacggaactttaaccttcactacagactctggaaatcccggctccctgactcttcagaatcttaaaatgaccggagatggagccgccatctactcgaagggtcctctagtatttactggtttaaaaaatctaacctttacaggaaatgaatctcagaaatctggaggtgctgcctatactgaaggcgcactcacaacacaagcaatcgttgaagccgtaacttttactggcaacacctcggcagggcaaggaggcgctatctatgttaaagaagctaccctattcaatgctctagacagcctcaaatttgaaaaaaacacttctgggcaagctggtggtggaatctatacagagtctacgctcacaatctcgaacatcacaaaatctattgaatttatctctaataaagcttctgtccctgcccccgctcctgagcccacctctccggctccaagtagcttaataaattctacaacgatcgatacctcgactctccaaacccgagcagcatccgcaactccagcagtggctcctgttgctgccgtaactccaacaccaatctctactcaagagaccgcaggaaatggaggcgctatctatgctaaacaaggtatttcgatatccacgtttaaagatctgaccttcaagtctaactctgcatcggtagatgccacccttactgtcgattctagcactattggagaatctggaggtgctatctttgcagcagactctatacaaatccaacagtgcacgggaaccaccttattcagtggcaatactgccaataagtctggtgggggtatttacgctgtaggacaagtcaccctagaagatatagcgaatctgaagatgaccaacaacacctgtaaaggtgaaggtggagccatctacactaaaaaggctttaactatcaacaacggtgccattctcactacattttctggaaatacatcgacagataatggtggggctatttttgctgtaggtggcatcactctctctgatcttgtagaagtccgctttagtaaaaataagaccggaaattattccgctcctattaccaaagcggctagcaacacagctcctgtagtttctagctctacaactgctgcatctcctgcggtccctgctgccgctgcagcacctgttacaaacgcagcaaaaggaggggctttatatagtacagaaggactgactgtatctggaatcacatcgatnattgtcgtttgaaaacaacgaatgccagaatcaaggaggtggggcttacgttactaaaaccttccagtgttccgattctcatcgcctccagtttactagtaataaagcagcagatgaaggcgggggcctgtattgtggtgacgatgtcacgctaacgaacctgacagggaaaacactatttcaagagaatagcagtgagaaacatggaggtgggctctctctcgcctcaggaaaatctctgactatgacatcgttagagagcttctgcttaaatgcaaatacagcaaaggaaaacggaggcggtgcgaatgtccctgaaaatattgtactcaccttcacctatactcccactccaaatgaacctgcgcctgtgcagcagcccgtgtatggagaagctcttgttactggaaatacagccacaaaaagtggtgggggcatttacacgaaaaatgcggccttctcaaatttatcttctgtaacttttgatcaaaatacctcttcagaaaatggtggtgccttacttacccaaaaagctgcagataaaacggactgttctttcacctatattacaaatgtcaatatcaccaacaatacagctacaggaaatggtgggggcattgctgggggaaaagcacattttgatcgcattgataatcttacagtccaaagcaaccaagcaaagaaaggtggtggggtttatcttgaagatgccctcatcctggaaaaggttattacaggttctgtctcacaaaatacagctacagaaagtggtgggggtatctacgctaaggatattcaactacaagctctacctggaagcttcacaattaccgataataaagtcgaaactagtcttactactagcactaatttatatggtgggggcatctattccagtggagctgtcacgctaaccaatatatctggaacctttggcattacaggaaactctgttatcaatacagcgacatcccaggatgcagatatacaaggtgggggcatttatgcaaccacgtctctctcaataaatcaatgtaatacacccattctatttagcaacaactctgctgccactaaaaaaacatcaacaacaaagcaaattgctggtggggctatcttctccgctgcagtaactatcgagaataactctcagcccattattttcttaaataattccgcaaagtcggaagcaactacagcagcaactgcaggaaataaagatagctgtggaggagccattgcagctaactctgttactttaacaaataaccctgaaataacctttaaaggaaattatgcagaaactggaggagcgattggctgtattgatcttactaatggctcacctccccgtaaagtctctattgcagacaacggttctgtcctttttcaagacaactctgcgttaaatcgcggaggcgctatctatggagagactatcgatatctccaggacaggtgcgactttcatcggtaactcttcaaaacatgatggaagtgcaatttgctgttcaacagccctaactcttgcgccaaactcccaacttatctttgaaaacaataaggttacggaaaccacagccactacaaaagcttccataaataatttaggagctgcaatttatggaaataatgagactagtgacgtcactatctctttatcagctgagaatggaagtattttctttaaaaacaatctatgcacagcaacaaacaaatactgcagtattgctggaaacgtaaaatttacagcaatagaagcttcagcagggaaagctatatctttctatgatgcagttaacgtttccaccaaaganacaaatgctcaagagctaaaattaaatgaaaaagcgacaagtacaggaacgattctattttctggggaacttcacgaaaataaatcctatattccacagaaagtcactttcgcacatgggaatctcattctaggtaaaaatgcagaacttagcgtagtttcctttacccaatctccaggcaccacaatcactatgggcccaggatcggttctttccaaccatagcaaagaagcaggaggaatcgctataaacaatgtcatcattgattttagtgaaatcgttcctactaaagataatgcaacagtagctccacccactcttaaattagtatcgagaactaatgcagatagtaaagataagattgatattacaggaactgtgactcttctagatcctaatggcaacttatatcaaaattcttatcttggtgaagaccgcgatatcactcttttcaatatagacaattctgcaagtggggcagttacagccacgaatgtcacccttcaagggaatttaggagctaaaaaaggatatttaggaacctggaatttggatccaaattcctcgggttcaaaaattattctaaaatggacctttgacaaatacctgcgctggccctacatccctagagacaaccacttctacatcaactctatttggggagcacaaaactctttagtgactgtgaaacaagggatcttagggaacatgttgaacaatgcaaggtttgaagatcctgctttcaacaacttctgggcttcggctataggatctttccttaggaaagaagtatctcgaaattctgactcattcacctatcatggcagaggctataccgctgctgtggatgccaaacctcgccaagaatttattttaggagctgccttcagtcaggtttttggtcacgccgagtctgaatatcaccttgacaactataagcataaaggctcaggtcactctacacaagcatctctttatgctggcaatatcttctattttcctgcgatacggtctcggcctattctattccaaggtgtggcgacctatggttatatgcaacatgacaccacaacctactatccttctattgaagaaaaaaatatggcaaactgggatagcattgcttggttatttgatctgcgtttcagtgtggatcttaaagaacctcaacctcactctacagcaaggcttaccttctatacagaagctgagtataccagaattcgccaggagaaattcacagagctagactatgatcctagatctttctctgcatgctcttatggaaacttagcaattcctactggattctctgtagacggagcattagcttggcgtgagattattctatataataaagtatcagctgcgtacctccctgtgattctcaggaataatccaaaagcgacctatgaagttctctctacaaaagaaaagggcaacgtagtcaacgttctccctacaagaaacgcagctcgtgcagaggtgagctctcaaatttatcttggaagttactggacactctacggcacgtatactattgatgcttcaatgaatactttagtgcaaatggccaacggagggatccggtttgtattctagggtatacaattaaagattttatgaaattgaggatacggagagagtgggattcgaacccacggtacgcgttaacgcacacacgctttccaagcgtgctccttaagccactcggacatctctccatatttatagattttccaggcaaaaagacttgccgagaacatatcttaacctttccatttttatcaacatccgtcttactatgagaattttttcctaagatcaccgcttcttaggatattcgttctttattaaaattatgccccaatagaataatagatcatcttatcaaactgcttttgtcatgcataaagtaatagttttnattttccttaccctatattcgttaaaaagttatgggaatgatgtaatagataagccccatgttcttgtcagtatcgccccctataaattcctagttgaacaaattgctgaagagacctgttttgtctatgcgatagttacgaatcactatgatccccatacctatgaacttcctcctcagcaaatcaaggagttacgacaaggagacctttggttccgtataggagaggcatttgaaaaaacttgtgagagaaaccttacatgccaacaagtcgatctttcccaaaatgtctcgctgattcaaggaaagccttgctgtaatcaacataccacgaactacgacacccacacttggttaagccctaaaaaccttaaagtccaagtggagactatcgttaccactttaagtaaaaaatatcctcaacacgcgactctatatcaaagcaatggagagaaacttctgttagctttggaccaactcaatgaggaaattcttacgattacctccaaagcgaaacaacgccatattttagtttcccatggagcctttgggtatttttgccgtgattacaatttctctcagcacactatagagaaaagcagtcatgttgagccttctcctaaagatgtggctcgcgtatttcgtgacattgaacagtacaaaatttcttctgtgattcttctcgaatactctggaagacgaagtagtgctatgctggcagatcgtttccacatgcatactgtgaatctcgatccctatgcggaaaatatacttgtaaacttaaaaaccatagcgacgactttttctagtttatgacaatacgaattcttgctgaaggcctagctttccgttacggaagcaagggaccgaatatcattcatgatgtttctttctctgtctatgatggcgactttataggaatcataggaccaaacggagggggaaaagcaccttaacgatgttaattttgggcttgcttactcctacattcggatccttgaagactttcccttcgcattccgcggggaaacaaacccattccatgatcggttgggttccccaacatttctcttatgatccttgttttcctatctcagtaaaagatgttgtcctctcaggaagattgtctcaactctcctggcatgnnaaatataaanagaaagattttgaagctgtagatcacgctttggataatgttggactttctgaccaccaccaccactgcttcgcccatctctcaggaggacaaatccagcgtgtacttctggcaagagccttagcctcctaccctgaaattttaattcttgatgagccgacgacaaacattgatcctgacaatcaacaaagaattttaagtatcctaaaaaagctcaaccgtacgtgcaccattcttatggtaactcacgatcttcaccatacgacgaattactttaataaagttttttatatgaacaaaactttgacttcattggcagacacttcgaccttaacagaccaattttgttgtcatccctataaaaatcaggaattttcatgctctcctcactaatccgtgattcatttccccttcttattttacttcccacattcctagcggcattaggagcctccgtagctggcggcgttatgggaacctatatcgttgtaaaacgtattgtttcaattagtggaagtatatctcatgcaattctaggaggaattggcctcaccctatggatacaatataagcttcatctctcttttttccctatgtatggagctattgtaggagctatttttctagctctttgcatcggcaaaagatccacctgaaataccaagaaagggaagactctttgattgcgatgatttggtctgtgggcatggcaattggaattatattcatttccaggcttcccacctttaatggagagctcatcaattttctatttgggaacattctctgggtcaccccttcagacctctatagcttangaatctttgatcttcttgttttaggaattgtggtcctttgccacacccggttccttgctctttgctttgatgagaggtacacggctttaaaccattgttctgtacagctgtggtatttcctacttcttgttctgacagcaatcacgattgtgatgttgatttatgtgatgggaacgattctgatgcttagcatgctcgtcttacctgttgctatagcgtgtagattttcgtacaagatgacacgaattatgttcatctcggtcctcttgaatatcttatgttctttttctggaatttgcatcgcctactgtttagatttcccagtaggtcctacgatatcattgctgatggggttangttatacagcgagtcttgtgtgaagaagcggtacaatccgtcgacgccttctcctgtaagtcctgaaatcaatacaaatgtatagctagggaagcgcttttggaagctttggaggcattcttcctgttcgtcaggaagaagatcatcaattttatttaaagctaccagcatatctttcttttcaaaatctggctgatgagagtggagctcgtggatgagcgtttctaagtcttcttcgggagagtttctctctcttttggagacatcgataacaaatagcagtaaaagagtgcgctcaatatggcgaagaaaatcgagtcctaggcctttgttttgatgagctccttcaatgattcctggaatgtcagcgataatccagggtttttgatacaaacgatctttacaaaggactaggcccaaagagggggccagagttgtgaagggataggctccgactttcacttcggtatgtgcgagtgtattaaatagtgtggactttcctgcatttgggaaccctaccaaaccgatatcagcaatgagcttaagttctaactctacctgacggatttctccgggttttcctggggtggcttttgtaggggctcggtttactgaggtcttaaagaaggtatttccttttcctccctttcctccttggctcactaggagacgctctccatctacggtaaagtcatgaaggatttcaccagtctcagcatcacgaagcagggtgcctgtagggacagaaactattagatctttaccactgcgtcctgtgcggttatttgtagctcctgactgaccgtcgggagccttgagaaagcggatatttctataagcttcgaaagaatatacacttgtggtggcttctatgattacggagccgccattgccaccattgcctccgtaaggccctcctttaggaaggtatttttcctttctccaagcaacaacgccgtttccgccctttccagcacgcaattctaaggtaatttgatctacaaacatgattacgtttttatccttcttcaaacaaaaaaagctcgatttgatgcctgagcaaaaaaccgagcttttttaatgtttctgaaaaatcgaaaaataggaactaaagttgctcaggaacaacagagatataagtacgattcgtctttttcattactacaataccatcgactaaagcgaatagggtatcatcacgaccacgacctacattttgtgcaggattccatcgggtccctctctgacgaacgagaatacttcctgtagaaactttttgcccagcgcccactttaaccccaaggcgcttcgattttgaatctctaccgtttcggcttgccccttgtcctttcttatgtgccataactctaaactctctagcttctgtttatatcaatatctcacggattttcacacgaaggtacttctgacgatgtccgtgtttacgatgataatttttgcgttttttatacttataggcgactactttttctcctttaacatgagaaagatattcggcttttacttgtgcgttcgcaatcgtagggcttcctagagaggctttagttccatcgaatacaaagaggacatcttgaaaaatgacttctttatccgaagcaacttcccctagtaactcgacatcaatcacatcgcctgagcgaacctgatattgcttgcttcctgtttggattactgcgtagggctccatcaattttttccttatgaatctttcaatgcttaaagttaagcgctgtttgctaagttactttagcaaacttaaggattatacaaaatataaagtcttggattatagtttttaacccctcggagagcgctatcctcaagcggttatggccagagccgggatcgaaccgacgacacaaggatcttcaatcctctgctctaccatctgagctatctagccatttgtactcagttatcataggaaaacattcagtttaatatcaatgagatttcgaattcttcgcctctctttttgctattaaggagtatttctcaagagagtgcttcgatgtagcgagaaagtttgacaaattactggaataatgcgtgaattttagaaattttgtagtatcttctgtgaaagaaattcttaaaaaaaacatataccaggtagttatggatagagacaatgaggttcccctgcccaagcccaaatggatttaccgtacaggtattggtcaagacagccaccgctttctcccagaaagttccacgaagccctgcattttaggtggtatcatttttgatcattgcccaggatttcaggcaaattccgatggagacattatctttcatgccatttgtaatgcgatttcctcagtaactaataaaattattttaggaaaggttgctgatgagcttctccaaacacggggaattacagatagtgggatttatcttgaggaggctttaaaatctctgaagcctaatcaaaagatttctcatgtcgctattacgattgaaggaagtcgacctaaatttctctgtaagctatctgcattacgtcaaaatattgcccaggttatgaacttaacacctacggatattggcattactgcgacttctggagagggtttgagtgactttggctgtggagatggcgttcagtgtttctgcgtcttaactgtgatggaatactgtgactaatagacgtcaacaacgtaacgatgttcctttctgagggaggctagagtatcttttcctaagatttcttctaaagcgtgttttacttctatgcctaagactttacgtccacagacaaagaaaaaccctccctcttcataggcctttcttacctcatctttttgaatcctaagaagatcttgaacatagactttttggtctctctctcttgagaaggctaaaaagagttttagttttccttcctcttctgcatggttccagaattctcgataatagaagttcactttttctttgcgctcaccaaaaaatagtaaattatttcctgggtctttattgaaaaggcgttcctctaggaaggctttataaggagcgattcctgttccagctccgatcataactaagggtttcccttcagtctgtgtagatagagtgaagtgttttgtaggttgtacgaatatgtaggcagaatcgttgacctgtagttcgctacatagaaaggacgagcaaactccgaagcgtttttgatattttccaggataggaaacgtgttttaccaatagctctatacttttgggatgtagatctggtgaggaggctatagagtagaaacgaggcaataaaggaaacacactctcagcgaagagttctattgggatctgagggcggtactcttgaatggcatcatacagtgtaatcttaggatctttgtctgggaaaaaggaatttagctttgctggaatttaatcaagatcaacatagccttggataaatttttgggcagaaactttttcagaagttttttttacgttgacaagggtcgttggggaatagccttagaagctggagaacgtgttcggagacctctttagaattctctggtaagactcctaaagcatcgcctactttataggatatagtcgtatcattgctatcaaagaccatgcggtagatgggatcgctatcgttaatggaatcggaacaagaaagtagctcacgcaatactagaggaacttgctgagccttaaacttttcttgtaggtacatcttttatagacaagcttgaattaagccgctttgattttaatatcaactcctgcaggaagtgctaacattttcaaagcatcgatagtttttcctgtgggatctaaaatatctacaagacgtttgtgagtacgaatttcaaactgctctcttgattttttatccacatgtggcgaacgcaatacagtatagacttctctttttgtaggcagaggaattggtcctacaacacgagctcctgttcttttagcagtttcaacaatatctgctgtggaacgatctagctgcccctgatcgaatcctttcagacgaatacgaattttttgcttttgctgcttcatacatcccttacttcttaacaatctcttcttgaattttttgaggaaccttagcaaagaatgctggttccatggttgatgttgcacgtcctgaggtcaatgatcttaaagatgtcgtgtacccaaacatttcgcttagaggtacctcagcattcacttgagccattcctcgagaagattcttgtcctaaaattttgcctcgacgacggttgaggtccccaataacatcgccaagatgatcttctggggtaattactgctaccttcatgattggctctaagattacaggcttcgcttttctacaggcgtctttaactgccatagacccacagatcttaaatgccatttcactagaatcgacttcgtgatacgaaccgaaaacaatacttaccttaacgtctacaagaccgtagccagccaggactcctgtgttcaatccctcttctatccctttaattactgcagggatatattctttaggaatgacacctccgacaatcttactgacaacttcgttgcctttcccaggttcgttaggttctatttcgaggcaaacgtgagcatattgccctcgaccaccagactgcttcacgtattttgtttcactatttccgctcacagtaatggtttctttataagaaacttgcggttttcctacgttagcttcaactttaaattctcggatcatacgatctcgaagaatatctaaatgaagttcccccattccagaaatgatggtctgtcctgtctcttcatttgttgagacacggaatgtaggatcttcttctgataaagaacttaatgcttgagcaagtttttctctatcccctttagactttggctcaatagccatatcgatgacggggtctggaaattctatacgttcaagaacaatttcttggttatcgtcacacaaggtatctcctgtgacagaaaacttcagacccacgcaagctccaatatcgcccacagtaaactcatctctatctgtacgctcattagcgtgcatttctaaaaggcgagaaatccgttcttttttatcttttgtagaatttaaaatggcagacccttttttaagagtgcctgaatagattcggataaatgtaatccgacctacgtagggatctgtcatgattttgaaagctagagctgctagaggtccatcacgtcttggctctaaactaatttcttgatctgttttaagattgattccgcggatatttcctcgatccaaaggagaaggcaaccacttgacaatcacattgagcagttgttgcacacctttatttttaaaagcggttccgcagagtacaggattgattttattctcaatgactcccttacgcataacctgatggatttcatcttcagtaatgctatcgggatcttcaagaactttcatcatgaaagcttcattactttcatctatagtagcgagttcttccaaaagattcgctcgcaattctgcacaacgctctttgagatcttcagaaatctctttttcttcccattttgctcctagggtatcatctagaaaataaagagctttttgagagattagatcgaccatgccgacaaactggctttcagatccaataggacagtggacagggaaagcattcgctcccaatttctctttcatggattccacggcagcaaaatagtctgctcccatacggtccattttatttacgaaagcaatccgtggaacaccgtatttatctgcttgtctccaaacagtttctgattgaggttccacgccagatacggcgtcaaatacggctacagcaccatcaagaacccgaagagaacgttctacttcaatcgtaaagtcgacgtgtccaggagtatcaataatgttgatttttgcgcctagccagaagacagtagttgcagcagaggtaatcgtaattcctctttcttgctcctgggccatccagtccatggtagctccgccttcatgacttcaccgattttgtgagttcttccagcatagaaaagaattctttctgtagtcgttgttttcccagcatcaatatgagccatgatgccgatgtttctaattgcacttaaatcgaattcttgattgctcatgaacttgttattttctccgtaatttaactaatcttaccacttataatgtgcgaatgctttatttgcttccgccatacgatgggtgtcttcacgtttcttaattgttgcaccctgtttgttgaagcagtcaatcagttcggtagcaagtccaacttccatagactttccaggtttactacgagcgtgtttgatgatccattgcatcgctaaacaattcctacgttcgctagcaacttcaacaggcacttgataagtagcgcctccaacacgacgggaacgaacttctaaaataggttttgcattttctaaagcttctccaaaaccttcaagcacattctctaaatttaattttttaccgaaacgctctagagcagagtagacaattttccttgccacacttttcttcccatgcatcataaccttgttgataaatttttctaagatcacgctgccatagataggatccccagggatatcgcgcttttcagcggagtgccgccttgacatatacatttacctctatcttataaatctcgaccaagaacttcgtatgattacttaggccgctttgcgccgtaccgtgaacgactttgctttctattttttactgctgcacaatctagggtgccacgaacaatatgataacgaacaccaggcaaatctttgactctaccgccttggatcaacacaatgctgtgctcttgaagattgtgtccttcaccaccaatataggcaatgacttcctgcccgttagatagtcgcacccaagcaactttccttaaagccgagttcggcttcttaggagtttttgtttttacttgaaggcaaactccccgcttttgtgggcacttctgcaaagctggggatttctttctagctagacttgacttacgtcttttacgtattaattgattaatggtgggcatgtattcttctcgtttcaacctcactactacaagcatggaaatatagagtaaggctctctttgttggcaagggcttattttcagatgaagagggaacgtatcctgcttgaatttaaaaaaatgctatctttttctagacgaaccgtttttttactttttaaaagaaattttagctgtaacgaacttattctaacctatctctttggagagaagaatttcgtattaggtttctcctaatgaagactgtgcacaattaaagcagtattccataagagccgcgatttatgtaaccaaagagaaatcctaaaatgggctctgttaaatcttggttataggtaaaactactttctttgccttgttctatgatgtgaatagaatcgttggtataaataaaaagcaaaggtacggtgtgggaaagcaattgcgtanttgagctaggtctgggatgcccgcaagnattttagcggagtcttcagataggaaaagaacttgaacgtagtttagaagagaccaaaagcgaccgaggaacgtggtcacgacttgtgagtcacaaagatcaacaagcgtgtggttattctttcttttggtctctttcagaaacttttctatactatccccgtagagaatcaattgcccatccaggagtgtgtatccctgattgcataggcaagtatttgtttctatgcccttttctgcttctttttccgagtagagcagggtatctggttggttaggacaacgtaaaactaatcttagatccttgggttgttttagagcgggtccgttttctttatttgccattccctcagcgtaagtttctccgttacgcatacataaaatacctaaatcggagagatgggattgggaaaggtttagaggttcttttcgtttgaaactgatagaggcttctggaaatttttccttatatatcaaaaaaatttcttttatttttgcgttattagtcgaagaaatggttcctatttgcaggccgcactgggcaacaaagtcctcattcgttgtgaggataatatctatgaaaggaatccctagcactgttaaacaggtcgatgtttcccaggagaagctttctgaagctcttagagggaagacggctcttcccaagataaaaattataaggaatctgaggacaacgcgccacatacaacctcagtaaaagtagaactcctattactaaactaaaagtaagactttattttaagtgttttcttaccttcttctttgtataatacttgtttatgtacggtttatgtacgaaggaaaatcacgcatggcatcgcccactccaggacaattgcatctacagcaaaaagtagaatcaaaggcctatgactattcacgcagcctcgctatgattgctacagctttgttattttttattgttgctcttattctttctggattgagtctgcttcctcaggtcttcctccccttttcaggagcgtattttattatcggttcttttttagcttttattgcgttagggattcttcttattaattgcgtctgcgatctcaaacagtaccttacctcgtcttagtttacaacctcgcaaagcttcttttttttattacaaaagttttttcctgactaagctgtttgtaataaattagtttctcacatctataagaaatctgtgctaaagcccttgggcttcgtgccgatgttacgaatatccattaacattaaatagatgttcgtaatgaaaaaacttgtccgtctatgcgtagttcttctttctttacttccgaatgtattattttcttcggatcttttacgagaagagggcatcaaaaagatgatggacaagctgatcgagtatcatgtcgatgctcaagaggtttctacggatatactctcgcgttctttatctagttacattcaatcttttgatcctcataaatcttatctttcaaaccaagaggttgcagtttttctacagtctccggaaacaaagaaacgtctcttaaagaattataaggcaggcaactttgctatttatcgcaacatcaatcaattgattcatgagagtattcttcgtgccaggcagtggagaaacgaatgggttaagaatccaaaagagcttgtattggaggcatcctcatatcagatatcgaagcaacctatgcaatggagcaaatctttagacgaagtgaagcagagacaacgcgctctactcctttcctatctttctttacatcttgctggagcttcttcctctcgttatgagggtaaagaagagcagcttgctgctctgtgtctacgtcaaatcgagaaccatgagaatgtatatttaggtatcaacgatcatggtgttgctatggatcgggatgaagaagcctaccaattccatatccgtgttgttaaagctttagctcatagcttagatgcacatacggcgtatttcagtaaggacgaagcgttggcgatgcgaatccaactagaaaaaggcatgtgtggaattggtgttgttctgaaggaagatattgatggagttgttgttagagaaatcattcctgggggacctgcggctaaatctggggatcttcagcttggagatatcatctatcgggtggatggcaaggatatcgagcatctttctttccgcggtgttttagattgtttacgtggaagtcatggctctactgtagtcttagatatccatcgtggggagagcgatcatacgatcgccttgagaagggagaaaatccttttagaagaccgtcgtgtggatgtttcctatgagccttatggagatggtgtgattgggaaagttacgttacattctttttatgaaggagaaaatcaggtttctagtgaacaagatctacgtcgagcgattcagggattaaaggagaagaaccttcttggattagttttagatatccgagaaaatacgggtggatttttatctcaagcgatcaaagtttctggtttatttatgaccaatggcgttgtggttgtatctcgctatgctgatggtaccatgaagtgctaccgcacagtatctcctaaaaaattctatgatggtcctttggctattttagtatctaaaagttccgcatcagcagcggagattgtagcacaaactctccaagattatggagttgctttagttgttggagatgagcagacctatgggaagggaacgattcagcatcaaacaattactggagatgcctctcaggacgattgttttaaggttactgtagggaaatattattccccttctgggaaatcgactcaacttcagggagtaaaatccgatattttaattccttctctctatgctgaagatcgtctaggagagcgttttctagagcatcccttacctgcagattgctgtgataatgtacttcacgatcctctcacggacttggatactcaaacacgtccttggtttcaaaaatactatcttcctaatctacaaaagcaagagactctttggagagagatgctacctcagcttacgaaaaacagtgagcaaaggctttctgagaattcgaattttcaggcatttttgtcgcagataaaatcatctgaaaaaacggacctatcctatggttccaatgatttacaattggaagagtcgataaacattttgaaggacatgattttattacaacagtgtagaaaataattactgttgctctttacatctgatctcgtacgtggaaagtagcatcccaagttctaggatgcttgtgagatgaacgtctaaacgcgagctattttacttactaaaggtgaaagtacagganttccgcggccatcattaagtactggggtantagccctagaggtatttccttctgttttcacatggccaaaaatcttatttgagttattaaggatcccatcatcgagctgatcttctaaaacacctgcccatttttggaaaaccatgagtttttcagatgtacaagcttcatcaaaacataatgatgtaactagtaacttaatcaatcctatggcagcaggaataatcaaccaaaatgcatttgcccctaactggctatggaagataaacatacatgctaatccagcaacaaccaaaagaattcctaaaacgagcagggtaatttggcaagctctggattgaaagagctttgattcacgtataggttgaataaattttgtctttgcccatcctatgagtagattcaccattcctggactggacgtaattgcttgtagaccagcggtgacactccccgatgctgctatttcctctactatgtttagcacagactcaggagcagctgctcctgttcctgttcctcctacgggatgtagatttgatgacataccgttctcctagtgtagttcctaaagaagcaggttacactaggaaaacattaattaaaaattttaattacatacctaaaaagatgggcttttaaaataaatcttaggatttcagaaacttaaataatatctttgattaagaaactctacgattggattgaagagcttataaaacaaaaaaaccgctttagtacgtaaggtactaaagcggtacttctttgaaagctatcctaaagcagagcggaatatcgctctgctttaggataattccttagaatttaatacacgtgggtattttctgtgtctgatactggtgaagtcagtgtatcagaagaaagaatagcttcgccgcgagcatctccgggagcaatacctttcaaggtaacagaaaactctacagattccttagaaccgagtttaggtaaagcgtcgaaaacaacggtattacctgaaatcgttcctttagttggacctgaagaagctattggctgaagttcttttgagaacttcaagattaaagatacgttagtatcttcagcagaaccacggttagttacacagatacgatagacagtattttctcctacacagataggatcatttgtgtctaatacgcacatatgggtagctgcaagacctttccaatgtgttgttgtttctgcgcaagatgtacatgttccgcagttagactcactagttactgcaacttgatttgtgaatcttccaggaacttgagctttcactacaagtttaaactggagggtttctcctgggcacatttctttaatacgccaaacaactttattacagcagatctctccaccaggagcttcgagtactgtaacaccagaagggagtgtatcttggatcacgacatcatgaagaaccaagtctccaggattcgatactgagatagagtactccacaggtttacatacgtaagaccaatcagcaccagagatatttacttgtacacaaggctcattaacaactgtagttacatttgcagaacatttgtgtccaccgcagtaagttacagtagcaacgttagtgatttgacctcttctttgagggcagaactcaactgtaaatacctttttatcgccaggtctcatgtctcctaagttaaaagagagaactctttgaccagatgcatgagaatagccatcgggaacaggattatctacagttacgttacgggcaatagcagatcctgtgttcactacttcgattttgtagcatacagggcatcttaggcaagcacagtcaggtccttcttgcttaatacaaatggctggttgaccgcatttagtataagaacggagctctgggcaagcacatacagtagcagctgtgaagcagcaaccttctttaagaggttttacccatacagtaattttgcatttatctcctgcacccaggcgatcgattttccagactaatttcccatcacttgtaggagttgtttctggatcactgcttacgaattcagcttcgcaaggtagctgttgtgtaatcacaacatcaacacaatcttttttgcctatagcaaggatttcaatagggtaaggagatcctacagtagcgtattctggaacggactggcaaatttctacgttgcaatcatcgtttacttttacagaatacaatcttccgtagcaagactcttgctgagcctctacaggttgacatcgtccctcttcacagggataaaattctttatcacaaaaagcaccacggcttttttgttcaactggttgtttatttctacggacaagtctaaccttcttcgctgtcataggaacaggtgctggctttgtttccgcactagcgacgatcttagtaatcagagactctgctacagcggcctctatacccccgctggcaaagcaactcgccatactcgttagcgcaaggaccgtaactactcgtctgatgagtttggacatagggatctcctatcgcatgtttatttttttcttctgccatcgggtagaatgttttgtaaactcttaccctcaacatttgggtttattatctgaattaaggtagtcaggaattaattcatctcctaactacctgatcaatttaagtaaacagttaagagaactctccttactgtttgcatctgccatcaggtgatgtacaacctttaacttgtgggctttgagagttacactctgttgaaccacatggattagaacaagaaggaacgtaggacccacaagcattaccgccgcaagatctttctttttttcttattacttcacaaggattgcaagaagagggtgcgcaaggatcctcaaaacaacaatctacaatgcggcagcagctacttaagctaactactccacaaaacattgcagcaattaaaacagctttcttcataagtttttaactcctttctaattagaaaacttacgtgtcttatttattactgaaaattcaacaaaacttttaataattaataaagcacgttcccatgaacaatattacaaatgaaaataaaaattttatcaattattttttctagataaatctttttggtattaaaactctttttagaaaacactatttactaaaagataaacctataattttcaaaaggaagcgtcatcaggaatttgaggaaactgaagaataaaaagaataatttgtttaataactaatggtttatttcacgagactttttcacttattttctatattaaaaacacataagattcacaatcaacgagttgaagtagaatgattgttaatccgcacaatcaaatcattgaattataacaaaataatttcgtaacattaaaaaataaaaacgagggggaaatgaaattattttacttttgtaacattattttcctgacatctctattttctgtaagctgcacgcacacgcctcctccacgtagttatattcttgctcaaggaagaacgcccctcgtcaataaagcgcattccttagaattctttttagcaagatctgtctttaacacgtgttataatacgaacttatagcctcacaaatcacgatcaagagagaggaacgcaggactactctgggatagagctgcgttgtagattgtcttcgcaacgactcaaacaggaagtgtggttatgaatagaaaccgcggtggctgtttcgcttagctagcagccacgcacattcatgcgaccgatatttagagatcgaaagtagcctcttcgaagtcttctcgttgcatgaacttatccacagttgcagcgagcttcttaggaacgcctcctaaaagcttttctgcatacacaagacgtgctctcgctcgaggtttccctaaaatctctatagagtcaaagagagggagcccctgctttttcccagtaattgccacataaagcagtgggatgatggcttttttatggtggacattgaatgcttgagctaaccatttagatccgaggtaacacgtctctttcgtccattgatcggttttctcaagatatttgacatagctatagagaaggatagctgctttctctggagaaagggcctgtggtaggagttcctcaacacggtactctaacaatcctgagaaaaagaacgaggtgaggttgataaactccgcaagagttgtaatccgagattgacagaggggaaggatttttaagaaaaattcgtcattaagtagccaaccctggagttcttttaacaagcactctggcgaaccctcgtggttgaggtaatgcttattcatccagtcgagcttttgaatatcaaaaactgctcctgactttccaatacgtcgaggattaaaagtttctataatacgctctagagaatagacttcttcatccccttccatactgtaacccatgagagtcaggaagttcacaaaggcttctttgacataacctgagtcgcggtaataaaaaatcgaggtagggttctttctttttgaaagttttgttccatcggggtttagaagcaggggcatatggagaaagacgggaggctcccagccaaaagcttcgtagagtaggagatgcttaggagttgaacttagccactcttcccctctgaggacgtgagtgatgcccatgaggtggtcgtcaattacattagcaaagtggtacgtggggaatccgtcagattttactaggacctgatcatcgacatctgcccaaggaaacacgactcttcccttgctataatcttcgaaaacacattcccctgataagggaactttaagacgaatggtgtagggctgacctgctgcctctcgtgaggctacctcttcgggagagaggtacctgtacctgcgatcgtatcccccacgataaccgagggtacttgccacagcgcgcatttctgcgagttcttgaggggttgcaaagcacttataagcgcaatctgtctttaaaagtgtctcaacatacccttgatagattttcgtgcgttctgactgacgataggggccataggggccgcctacatcagggccctcatcccattggatcccgcaccaacgaagagctgagaaaatattttcttcgtaatcttggcgactacgtgttctatccgtatcttcgatacggaggatcattttccctttaaatcgttttgcaaagatttcattaaacagagccatataggcggtacctacatgaggatctcctgtaggtgaaggagctaccctaacacggacattttcccaattcatgattcttttatccttagaccagagagacttcataccctgaaaacggctatttcttcaagggaaatcctctctgcagaaatgcataaatccaaaaataaaagaaactccttaatttaataaaaaattaaggagtttctcaaaaaaatcacgaaaggatatttcgccacccttagatcggggatcgcctttaaagtatcagaaagaagtagttaatcaacaatgttgtaagtagaaaatcgaaaaatcgagagcgagttagttagattcaggaaaaatttcagtaggaggttcgaaatttggagcctgatgttctttcggttcagctccttttagttttttagctgcttgcttactcagatactcattcttatatctttcaatctcagatacgtgaattacccaagcggctcccttacgctctcctcgtatggttcccgtacgagttgcatagtagaccttctgcacaggtattcctaaaatctgagcaacctgatttatggagtagcatcctttaccgttatcgaaaacaagctctccttgataaagagatttctttcgagagtaacggttacgtttgtactcttccaaatctttaatatctatttcccagcgcgtctctttagaagcttttagttttttctgcttaattgccacataaattgcttgcctagtgacgttatgtaatttagcagcttgagtgatcgaaacccattttgtatctgagtctttgatatcctcaatttcttctctttcttctctttcttctaattcgtagcatccctcatgttgttcgcacgccataagctagcatcccctccccctcaacatatttacaattaaaacaaccgtaacagttagtttcttccttgtttttagaagtttttaaagaagcattttcctaaaaaaagctttattaatcaagcttttttgttaatacaaagtttatgttttcagattaaaatcttaataaatcgtaagcaggattatgaattattaatatttctttacgttataaaaaataggtattcttaaaaaaacacgccctgaatatcgccagggacgtttttctaatcataacgtttttcttaagtagacaagacaaaataccaagaaccaacaaaatatctactctttttcttttcctgaacgaagtatttttttttaattttccttatcggtcagcagtttacagaagccagggataaggaaactacaaagatttctttactcttttaaaataaagctctcgatttttgatttaaatctgcgatgaaccttaggaaactcatttttggtttaaaagatgagtttctaattatcgaaatgtcttcgaatatgacctgcaacttctttaatcacatcatcggaaaggatatgatcgtgtcttagaccggtctgagctacagggattttcttccctgaacactcttccaagtttttaggatctaaaaatggtgctgcgaagcacgtctcttttttgaacaatccatccccgataagattaccttgggaatccttgccataaataaagagttctgggcaatgcaagtccttgcttctcttttcagaattaatattccaatgggtaagattcgccagccaaactcctagacttccaataaactgtttagcaacggctcctgtagagcgagctcctcgatctttaacgacaaaccaacggacgctatcacttccgtctgcgatctctttacttaatgcttcggcttgaacactagctcctaaagaatagccataagcaacgatttgacgcgcctgaggtcctgcgggttcatctctaagatagcgtacgcatgcttgataagatttgactacattgtttcttgttatattcccttggctcttcatgactcctgggtaattgaagattaaaatgttggattgagactcttcagcaatacggaatatccagtccttttccccttgcagcactgtcctatactctaagcaatcggagtttccattggagattaacatccatcgatctggcttagcattgggaagacgtaactccaatccgtcaataaagacctcgtcatactgtaagcaaacccttcgcacagaggagacatgatcttggaatgaagcggagaaaagacgcgcggcgtaagcttgtcgcaataaattagagtccctgcatatgggtctaaaaatccaccctcctgcaccaagaagaataaaattctgacatatcttctgaaggacccagaaaagacccaagggaataaagaagattaagccgagaagaaatttcacaacaccccatatgatctcaagaagacgataaaggtaaggatgagcctgtcgtttctcccaagaagttctcgcctgctccgaagaaaacatggcgatcgaaggtttaggatgcatatccaatatagctgcgtgttgttcccttgcaatagctattgacattattaccttataatttcatgcagaatgtagtgagcaaactattatagtggaaattattgaataaaccaaaaacaaaagccgagtttatttatattaatataagtaattattttaatagaatcgacctcgaaccattagatagataggtgacgaccctcatctagaaaagaacattcatttattatgataatgaagtaaatcttttacttgcaatgaacaaagaaccaatcgaatgaaagttagcggtctttttttagtctgaaaatctaggttctgaggaaatacggaaatcccggaccagcaggtggatgactcccgatccagaagtttgggacaagcggggtgtgtaagcaatctcaagagggtaatgccaacttgcttttaatgcatcagcgtgtcttcccagaccgaagcgacaccctcaagatttctttctttttggcttaagtagagtttgagatggtttccaggcaatacttttggatagcgtacctggcgcacttttgaatagaagataggcatcagattccccttcccaaaaggctcgaatagttccatagaagctaggagatcataatctatagcatcaaaatccgcataagcatcaatttcgagatgaggaagtgtgtcaccctttttaagagaagagttcacgagatgaacgaatttttttttaaaatcttcgactttatcttccttcataatcacgcctgctgcaaagtcgtgtccgccgtaagataaaaggagcgaggagcatttctttaagactccgagtagaggaaatgaccctatagttcttgctgatccctttccaattcctcgttggatagcgatgattaccacaggtttgttataagtcttagcaagacgcgctgagataatagggatgacacgagcatgccatgccgtggatgaaagaactatagcagcctgctttaaaatctcaggattactatttaatatctcttggacatcttgaaatacctcagcttctattctttgcctttctctatttatattatctagctccataattagagcatctacacgttcatcatcttgggtgagtaaaagttcaacaccttttgcagggtcgtccaaccgtcccaagctattgagttttggtgcgatcttcaagacaatatctgtcgaagtgacttcgcttttttctactccacataatgcgcagagtttattcaatccgggtcgcgcgcctctggcaatttctttaatcccatagcgcaccataacacggttttcccctagcaaaacaccgacatccgtgatggttcctaatgtgactaaatcgagtaattttttcaggctaccttgactcttggggacaagatttctggatatcagtgcgttcagtactcctcttgcgagcttaaaagcaacgcctacgcctgtgagttctcgattcgggtaggtatgatcccgtaatttaggatttaatgtaactacgcagtggggaatttttcctgtcggcatgtggtgatctgtaatgatcacatcaatgccttgtcttgtaatatcactcacctcttttcctgcagtaattccgcaatctacggtgatgaggagtgtaattccttcctctttcaactttgcaatgagtgtggaggtctctccatgttgcttgagtatcgcaccaagaaagaagtagctaacgtggacatcaatatctcttaaaaattcgaccaggagagcgacgcctgtcatgccatcgacatcgctatctccataaatcatgacgtgttctttacgatctctagccaggagcaggcgttctacagcctttgacatatctaggaagagtccaggatcataaaggctcgacagatggctgtataagaacttatggatttcctgaatcgtttggaatcctcttgagataaaaatctgagccactgtgggaggcaagtgaaattctttgataatcattccaagaaacgcaggatcttccttgggatgagcccagagcaatcctgctgcagaagcattatctgaatttgtcataaatttaataccacaggggcctttgggactaaagtcccaaaggagatttttatattgctacacgttagattaagtttaacggtacttattttgagcgattttctttacggaccataaacaacaacagaggtggtgcaatataaagagacgataaagttcctagaagaatccctatggtcataataaatgcaaaattaaagacagaggagccgcctataaacaaaagcattaacaaaactgatagagttgtagctgttgtcattaccgtgcggctgaacgtcttttgaagggcatcattaactaaaacatgcataggggtaaacaggttcgcttggcgatcttcacgaatacgatcaaaaatgatcaaagtattgtttaatgaataccccaatacagtcattaaagcaccaatggcttgcaaatctatttgaattttcttcaaaaagaaatgtgctataaacaagactgcacaggtagccaaaaggtcatgaattaaagcgcatacggcactgaaagcatattgccattcaaagcgcaaactcacatagagcaagatgattgccaaagctcctaaaagcccgatggtcgcctgataacgcattttcttcgatagtttgctgcttacctttgaccaaaaattttgcgtttcgtttagagtttccgtagagaaatctaggcctgtttctgacaacaatcccacagctaacgccagctcatgatcgttaattttaggagagaggctcgtatctgctttagtatagcttaaagctttatcactaaaatagattttgatcttttctgaagatccaaatgtttgaatacggaagtctctagaagaaagaccagcttcctgtagtttatgcacaactttgccacgcatttgagcaacatcgctgatgccatgctcttttggattaaaggtaaaggcataccctcctttaaaatccattcccaaaacggaattccaggctccaaacccgagagcaacgcaacctaaaagaaaaacacttccagaaacagcccaaagttttttgcatcctctcaagaaatcatgctttatccccacgaacttattcatcatatgcaactgtgtatgttgggtcttattcatccacagcatgaagaaaaatttagtcatgaaaagagccgtaaacattgaagagaaaattcctaaaatcaatgtcaaagcaaaccctttaataggccctgtatctaggaagaaaagaagtgctgaggccaatactgtagtcaagttagaatcaaaaatggctccaaaagccttggtatatcctttttctacagattttttaagactttgagacaataaaaattcctctcggattctttcgaatacaagaacatttgcatctacggccatccccatagcaagaacaatcccagcgagtcctgacaaggtgagtggcgcatccaaatactgtagagctgcccagataagcaaaagattcagaagaacagctcccgaagcgatgacgcctccaaatctataatatacgctcatcaaaacaataagcattgccaagccacagcatgctgagataatgccttgtgtacattgttttttcccaagatcagaagagatcgtctcttcactgagaacctcgggaacaaaagacatcgctccagattttaaatctgaggcgagtttgctcacttcacggtgggtaaatttccctgagacactggcatgatttttcaatgggacgtttaaaatagggctgctgaccatataaccgtcaatcactacagccatacgccatccacggtttgcagaatattgtccattagcagtgccgctgatcccctcctgacaatatgcggaagtccatgtgtggaaactctctgtaggagaaagtttctctgccattttcttagggcttgtatctttgactgaaaaatttaaaacataaccttcccctgcagcaaattctggacgaatgtcttttagggaagctccatctaacgcataatttctaaaaacaatgactaaaggatttgctttttgttctgcatcttttccaatagcaatcatagaaaacgtcgtatctaaatctgtcgaaggcgtttcgcatcctgaaggagagaacgccaacccctcacttttaagcttagtaatggcctcatggacacttggaggcacatcgacttcctcattaaataaggcgctagcgaaggtattgatttcttcgggagatgtctttccttgagcttgagaggtaaaccaaagatagtctaaaaatctttgcacttcgtagcgggaagcgctgtaagaagagaacctctcattcaccacatggaaactcatttttgaggtccccaagatctcagatgaggagatcgtagaagatcctggcacactgagatgaatgtaatctccctcacggcgaagttcgatttcagatactccaagtttatttaatcgagcacagagctcatccgaaactttaagaatatcttccttatcggtgagctgctttccctgatgatctttaaaagagagtagcagctgacgcccaccaacaaaatcaataccaagacgtagtatgttctccccacgagaaaattttctcatgttgagtttcatattttctaagaaaagattttgataaggaatcggagcactcaaacgttcctgaagatccatagaacactttgcgtgtcggtattgctcatgccaacgcactaaatcgctttgacgattcttctcgatttggtttacagttgcaaggcgatcttgaatgtctttaacttctaaaaaggcacagccctctttccctatgacaaatccctcaccccatacatctagaaattgctgcaaggggtgccggatttctaagacttgatcttctcctagagtccaggaaatcgcttctgtatgagaaaaacagttatagagattttgtagatctttttcgaaactttggagttctttaccccctccctgttgatatttcgcgacgatagaacggagtcctttcaataagatgtaaacggagcctttagaaaagtgtttgcaatctgtattgggagaaaagatgtaacagccaaaacttcgctttctctaggttgacgacagaaaacaggaaaattttctggaatcaggtcacaagattcagctgcaggcctatgcaaagttaatgccgtgagatgttctgcgattccttggagcaaacgctctccctggagaataatctttccctgagtatctttatccatccattggaaggaaaatccgttgttataatcttctacttgaacagttaagttcttagagagcttttgtttttcaacagccaaacgactgtcaaaatctaagcgttgttctttagacaaagacgtacgctgtgctaacaaatcagaatgtagtgtcaggaaaattttacgttccttagggcaatactctatggaactaaaaaataatgaggactcactacaatctaatcgaagcccttcaatataagggcaatctaaactacgaatgcatgcagtttgagaaagagtttcatatacactcttgagtagcttttgatcttcaacatcgattgctgcgtcgtttgacaacgaagacaggcgtgataaaaacgcaagtctatcttggttggaagaaaaggactgttggcaaaacgctgaaagtcgcgaagaaaaaacctcaaatcctgaagaaaggttcttggcatactgtaacaattgttctttaggtgccgtttcccagatagaggggtaactacaagaacagtctttttgtttcggacaagtacatgcagaatagactcgttgcaaaatacttgaggccatctcttgttcattttcggaagaataggaaacaaaagaaaaatcactttctactaaggaagtatttatagagcttgctacttgtattacatggtcgtcgtgttctcgactatagccaaccacatggagtcttgcagactttatgggaacgttaggctctccatgaacgaggttcccgataaagtcctctgcatcttcacctcttttaaaacgcacactgacaatatctggaatcgcaggatgttgttgtatgtgcccacgtaaatgtagggacgaaaggatcgctgagacgcgaggaatgacatccttacgaacttgctgggcctgcttggtaaaagatttgattatatgttcggcttcgtttccatctattttcttatccagaggtttggcgtaatataaacatgtaggcaaaacgtaatacaaagccaaagcaaacacgcaaataatgatagcgaagtttcgcttaaccttctgtttcattgcaccgctctactttttattaggaaatattaaaaccaaaataccagttgaaaaaaaaatcgtcaaacgaagaggagccctccaccttcaaagagagctctttattctgtatcttttacaaaatactatttttaattttcctaaaatctctatctcaaaagggtcaaattcaataaaaactaggcaaaagtatagctctcttgttcgccaacaaaaccagaaagcgaaataggagttacactatgcggggttgaggagtgatgaggggaaaaatacagtgaggttgggcttgtgggatctgtgaaaataaactttatccgaatggaatcttgtttctcttctctcattcgttttgccacctgctctgcagagtagaggaaagcggcttgtgagagcagttttaggttttcctgttcctctttagggagtgcatcaggaactccaaggataggagtgagtacgtagatcgtatgttttttcactatattaggatcgccgatttgatctaacacagtaaaaaatgctttagtataggcatcgatataacatcttccctgaggttcctgggctgcgtcagaaatatttacataaatcgcgcttttaggatgcgtgcggtcactagcttggtcttctgagctccaggaaatgactttaggatccaaatattgctgttcctctctttggatttcagagagcaacgaagacactacagaaggatctatagcaaaagttttgcgtgataaggagcttttttcgatcccctgtcttaatgcgatctgatccatttcttggatcagaaagatactggtatttctatcggattttttctggaatatcttagtaacgatctcctgggagccttcgcagatctctacttggggacagcctggatgatagtagcatccgggtcgtatttttttccaagactgcaagagagagaggcatcctaaccaatttataggtttttcaaagaccttagtttctcgaaatagaggacgctcgaatcgtgaccatcccttagagtattgtaagtacgcaaaccctaaaagaaccaatcccagaatcataagacctatgcacgggaaaatggtttgacataccccagcagcgaaggcagcacatcctaacaacgccaaaccaaaacaagctaaaacaccgcccagtattttcttcggcaggttttgtgcattggggacgtagtggacattgccntcctcggccgccaccaaatgaccatttgagtgggaatcaaatctgaaatggatatgcgaggaaatttcatactacgaagcatccttttagaatttctttttatttttaataaaaaactagaatcgaatagaattgcactaatattaacaaaacaaaaaattaaaaaacaaaagagtttgtttcaaaattttcattgaaaaataaaaagaacactaaaattgtttcgactttgaaaaaatgaatgtcaacttgtcaagatattctagtttcttctactatgcaacctaatattttctactcctttgctcgtcatgagtaagccgagtatacttagattaggaggatgcctaagaagcccttgtattcatttgaagtaagaactctcaaaaattttcttcttgagacaccgatctgcttagagaatagaatacagcctctccctactgggatggctggggaaaaatcctttgtgatttttgtcttaggtaagtgaacgaattctcctttcttaaaaataggttcgaaacgttgttcctgagaacgaattgtgacttacgccctaataaatgatcctgtagacttgtctttagctaccaacaatgctgaatccaagttcccctctctacagcgccttcccaaccatgttgctatcattatggacggcaatcgccgatggtacaaaaagcatagggaggagtgcggccacacacacacgtcaggtcattattatggcgctaaagtccttccaaatattttaaatgcggttcttgatttaggaattaaagttcttactctctatacgttttcaacagaaaattttgggagaccaaaagaggaaattcaagaaatatttaatattttctatactcagttagacaagcaacttccttatctaatggaaaatgaaatctgcttacgttgtataggagacctttccaagctccctaaaggcatccaaacgaaaatcaaccatgtgagtcgcatgacggcatcgttctcgcgtttagagctcgtattagctgtcaactacggtggcaaagatgagttagtccgtgcatttaaaaaattacatgttgatattctaaataaaaaaatatcttctgacgacctttcagaatctttgattagctcatacttagatacttcaggacttacggaccccgacttacttatccgtacagggggtgaaatgcgtgtcagtaatttcttattgtggcaaatagcatatacagaactatatatcacggataccttgtggccagattttacgcctcaagatttgtttgaagcgattaacgtataccagcaaagatcaagacgaggggggaaataggtgcttaattcaaataagtttaaatcgaagaccggtgcatacggtgatttatttcagcgtgttgttgttcattcgttagtacttacatttttggttcttcttctctatagttccctatttcccttaacttcttttgctctagggtttattaccgcgacttgtggcgctgtaggaacttatgagtactcctcaatggcgaaagccaagatgcactatccattaagcacgtttagtgcgatcggatcttttttatttttagcattaagttttctttccattcgttggggacacagtctcccaggattcttcgatgctcttccttggaccttgcttattgtttgggtcgtgtggagtatctttagagttcgaaaatctacaatcggcgctttacagctatcaggagtcactctcttttctattttgtatgtagggattccgatacgtttattcttacatgtcctttatagctttattcatacccaagaaccctatcttggaatttggtgggcttcttttcttattgccacaactaaaggtgcggatatcttcggttatttcttcggtaaagcctttgggaataagaaaatcgccccacaaattagccctaacaaaactgttgtaggttttgttgcagggtgtttgggagccacgctcattagttttattttctttctacagattcccacgaggtttgcgagttacttcccgatgcctgcgattttaattcctttaggtcttgctttaggaatcacaggattttttggagatattattgaatccatatttaagcgtgatgctcatttgaaaaatagcaacaagctcaaggctgtgggtggtatgctggataccttagactcactgctcctgtccacgccgattgcttacttatttttgctcataacccaatctaaagagtttattggatgattatcactattgatgggccttcaggaacaggaaaaagcacaacagcgaaagctttagccgaccatcttcatttcaattactgtaatacagggaagatgtatcgcactttagcctatgctcgtttacaatctccctgggcgacgcttcctttaactaaatttttagaagagcctcctttttcttttacctttgctacaggccaacctttagagtcgttttttaatggtcatcttcttacctctgaattaacaactcaagaagttgcgaacgcagcatcggagctctctcaacttccagaagttcgtgcattcatgcaagatttgcaacgacgctatgctcagcttggcaactgtgtatttgaaggaagggatatgggatccaaagtctttcccaacgcagatttaaaaatttttctaacttcaagtcctgaagttcgtgcgcaacggcgtttaaaagaccttcctgaagggactctttctcctgagcaattgcaagcagagcttgtcaaacgtgatgctgcagatgcacaacgcgctcacgatcccctagtcatccctgaaaatggaattgtaattgactcttcggatttgacaataagacaagttctggagaaaattttagctttactatttcgaaacgagctatgattttccgcatttgtaaatttttcacgtgggtagctttttctcttttctataagctaaaagtttatggagtgaaaaaaaattttattaaaggtcctgctattattgcagtaaaccataattcttttttagaccccatagcattgcacatgtgtgtccatgagtgtatttatcacctagcacgggcctctttatttaatatcccctggttatggaagcaatgggggtgttttcccgtgcgtcaagacgaaggaaactctgcggcatttaaaattgcctctcggctctttaataaacgaaagaagttagtgatctatccagagggggctcgaagccctgacggtcaactccagcctggcaaggtcggtattggtatgatggctgcaaaatctagagttccgatcatccctgtctatattaggggaacttttgaagcttttaaccgtcatcaaaaaattcctcatgtttggaaaacgatcacgtgtgttttcggtactcccatgtattttgatgatattattcaaaatcccgagatcaaaaataaagaaacctatcagatcatcacgaatcaaactatgaacaaaattgccgagctcaaagcatggtatgaatcggggtgcaaaggagacgtcccctaaacttatgtcgacattactttctatcttatctgtgatatgttctcaggcaatagcaaaggcatttcctaatctagaagattgggctccagaaattaccccgtctacaaaagaacattttggccattatcaatgtaacgatgcgatgaaattggctcgtgttttaaaaaaagctccgagggctattgctgaggccatagtagctgagcttcctcaagagcctttttctttaattgaaattgctggagcaggatttataaactttaccttctctccagtatttctaaatcaacagctagaacatttcaaggacgctctaaaattaggatttcaagtttcccaacctaaaatnattatcattgatttttcctctccaaatattgctaaagacatgcatgttgggcatttacgctctacaattattggggatagccttgctaggatcttctcctatgtaggtcatgatgtacttagactcaatcatatcggagattggggaactgcatttgggatgttgatcacctatttgcaagaaaatccctgtgactatagtgatcttgaggatcttacgagtctttataagaaggcctatgtctgctttactaatgacgaagagtttaaaaaacgctcccaacagaatgtggtagcattacaggctaaggatccgcaagccattgctatttgggagaagatctgtgagacttcggaaaaagccttccagaaaatctatgatattttggacatcgtggttgaaaaacgcggagaatctttctataaccctttccttcctgaaattatcgaagatctagagaagaaaggccttctcactgtttccaacgatgctaaatgtgtatttcatgaagccttttcgattccttttatggttcaaaaaagtgatgggggctacaactacgccaccacagatcttgctgcgatgcgctatcgcatagaggaagatcatgccgataagatcatcattgttactgacttaggtcagtctctacatttccaactccttgaggctacagcaattgctgcgggctatctacaacctggaatattttctcatgtaggctttggccttgtcttagatcctcaagggaagaaacttaaaacccgctctggagaaaacgtaaagctccgagagcttctagatactgctattgaaaaagctgaagaagcattgcgagaacatcgacccgaacttacggatgaggcaatccaagaaagagctcccgtcattggaatcaacgctataaaatacagtgatctctcttcccatcgcactagcgactatgtcttttcttttgaaaagatgctccgcttcgaaggaaacaccgccatgtttctactgtatgcctacgtgcgaatccaaggaattaaacgtcgtttaggaatttctcagctgtcattagagggacctccggagattcaagaacctgctgaagagttgcttgcattaactttgctacgcttccccgaagctttagagagcacaattaaagagttgtgtcctcattttcttacagattatctttataatctcacccataaattcaatgggttcttccgtgacagccatatccaagactccccttatgctaagtctagactgtttctatgtgctctagctgaacaagtcttggctacagggatgcatctcttagggctaaagactttggagaggttgtaagttcttcctgttccatatcaaagatctgaattttagctccgaggcttctgagcttgcctacccaatttgtatatccacgatctagaagatgagtgttctcaataatagagcctcctccttctgcaatcagtgctgccatgacataggcaaatcctgctcgtaaatctggaatgactaaatgcgaggcccataaaggcgtcgccccatgaatcacagcgctgtgaggaaaattcccgatagcataacgacatgccttggtacttaagcactgatgaaaaagctgacactcagctcccatgtgctgaagaccatgaaggtagccgaggcgattttcatggacagtctcatggattactgaagatccctgagcctgtgatagtagaactgcgaagggttgttgccagtccgtcaggaaccctggatgaacatcggtttccaagacaacacctcccaccaaggggcgttcttgaaaaaattctattcccgactcggagaccaaaaatcctccgcctatggagcgcaacatcttgaggaagggaatcagaagttcttgtttagcatttcggacgaaaacacgtcctccagagacaaccgcggccattccaaaagaggctgcttcaatcttatctggaaggatggtgtggtctacagagccgagacctccagtgccaaaaatatctatcgtacgatcattatcggtagtgatatccgcccctgccttttgcaaaaagagcaccaaatctaagatttcagcttcgagagctacattttttataaccgttcttcctttagcatgaattgctgcgagtatgagattttctgtagcccctacagaaggatagggtagatgaatataattccctttaagacctcgaggagcctttgcgtagtatcccgaactatcagaggaaatctgcacaccaagttgttttaacccttcaaaatgaaagtttaaggtcctttctcctatagcatctccccccacagtgggaacatagacaccttcagggcaacgccctaacagcgctcctaataaaaggatggggatcctattgacatttgaaaatgtgggaggaactcttgtgcattgtatttcgggagtatagatttccaaaacctctgtttccttatcccaagaaacatgtgctcctagcgacttgcataactctacagttaaggaaacatctcctatatcggggacattccgcagtgtgcacttctgatcagaaagtaaagaagcaacaagcagcttagttgcagcattttttgctcctgaaacttttacctcaccattaagtctaccacaaccaaatacttgagcaatctgcattctccgttcccctttggcatcaaaatcactaaaagaaacgttaaccttctcgaaggtttattgccattcaaactttttccttagatcaaagttccttaattcaaaatgattaaaatattaaaacaatattactttgatattttaaaaacaaanacagagataaatataattaatattatttaaaatataattaatagaattaaaaattatttatttctcaaaatagattatggcagctcctatcaaccaaccatcgacaacgactcagataactcaaactgggcagactacaacgacaacaacggtaggatcattaggagagcattctgttacaacaacaggatctggggcagcagcacaaacatctcagacagtaactctaattgcagatcacgaaatgcaagacattgcaagtcaagatggatccgcggtaagcttttctgctgagcactctttttctaccctccctccagagactggaagtgttggagctacagcacaatccgctcaatctgcggggctattttcattatcaggtcgtacacaaagaagagattcggagatttcttcctcttctgacggcagttcgatatctagaactagctcaaacgcatcttctggagaaacaagcagagctgaaagtagtcctgatctaggcgacttggatagcttatcaggaagcgagcgcgctgaaggagccgaagacctgaaggacctggaggcttacctgaaagtacgattccacattatgatcctaccgataaagcgtctattttgaacttcttgaaaaatcctgcagttcagcagaaaatgcagaccaaaaggaggccactttgtttatgtagatgaagcccagaagtagtttcatttttgtccgcaatggtgactggtcaactgctgagtctataaaagtttctaatgcaaaaaccaaagaaaatattactaagcctgcggacttagaaatgtgcatcgctaaattctgtgtgggatatgaaaccatccactcggattggacgggacgcgtaaaacctacaatggaagagcgctcgggagccacaggaaattacaatcatctgatgctcagcatgaaatttaaaactgctgtagtctacggtccttggaatgctaaagaatctagtagtggatatacaccctctgcatggcgtcgtggagcaaaagtagaaacaggtccgatttgggatgatgttgggggcttgaaaggcattaactggaaaacgaccccagctccagacttctcctttataaatgaaactccaggtggaggggctcactcgacgtctcatacaggtcctggcactccagtaggagctactgtggttcctaatgtgaatgtcaacttgggaggcattaaggttgatctgggtggcatcaatttaggtggaattacaacgaatgtcactacagaagaaggtggtggaaccaacataacatctacgaaatccacatctactgatgataaagtctcaataacatctacaggatctcaaagtacgatcgaagaagacactatacaatttgacgatcctggtcagggagaggatgataacgcaattcccggcacaaacacacctcctcctccaggtcctccgccaaatctaagcagttctcgcttgctgactatttcgaatgcgtccttgaaccaagtcttacagaatgtccgacaacatctgaatacggcttatgattcgaatggtaattcagtctcagatctcaatcaggatttaggccaggtagtaaaaaacagtgaaaacggagtgaacttccctactgtgattcttcctaaaactactggcgatacagatccatccggtcaagcaaccggaggagtcactgaaggcggcggtcatatccgtaatattatccaaaggaatacacaatctacggggcaaagtgaaggagcaacacctacacctcaacctactatagcaaagatagtgacttccctgagaaaagcaaatgtaagttccagctctgtgctaccacaaccacaagtagctacgacgatcacccctcaagcgagaacggccagtacatctacaacgagcataggaaccgggacagaaagcacatctacaacaagtacgggaacgggaacaggaagtgtctccacacaaagtactggcgtagggacaccaactacgacgactcgatctacaggaacttcggcgacaaccacaacatcatcagcttcgacacaaacaccccaagcgcctcttccctctgggaccaggcatgttgctacaatctccttagtgcgtaatgctgcaggaaggtctattgtattacaacaagggggtcgatctcaaagcttcccgatccctccctcagggactggaacacagaatatgggggcacaattgtgggctgcagcaagtcaagttgcttccactttaggccaggtcgtgaatcaagcagctacagcaggttctcaaccctcctctcgtagatcttccccaacaagtccacgaagaaaatagctcttcgtaatctagttgagaaaggcaagtccgtagaagtgaatagctaaaatacgaggtcctgaaacttaggacatgttgtggtagacgtcatccacatcttcgatttgctctagccaatcaataagagctaagtttgcctcgccatctttctcatcacaatctactagacgcaagggaagataaatcaacctgtcttcactacaagtcgcaccctgactgataagtttctctttaacggaggcaagttcacttggagcacagatcactaagaagttttcttcatcttcggtatcgagatcctcagctcctgcttctatagcataagaaaatattacttcttcatctatagagctcttagcgacagtacacgcccctttccttgcaaaattataaagtacgcttccaggttctacaagagaacctccacgtttatttatagcaatgcgcatatcagaagccgtacggttcttgttatccgtcattgcttccacaataattcccactcccccatgaccatacagctcataggtaacctcttcaaagttcttttgctctgcagaagttgctttcttcaaattcctttcgatattctcattagggatattattttccttagctttctgtatcaccatacgtaatcgcgcattggacttagggtcagctccccctaatttaacagctgaaatcaactctttaataatacgagaaaaaatcttgccttttttatgatctgctctttccttgcgatgtttcgtattggcccacttactatgccctgccatatcctccacctactctttttttataccctcgcaataaataagcgtttgccttttcccaagcaacagcacgatcatacaaggggaaacgttgttcgtattctttaaactttttaccatgaaaaatcgaacgtcccgatagagaatactctctagggactacactatgaaccatttcatgatacacaagatattccataaaaaatcttgggatttcctgccgatctaaagaacgatgaattcgaattaactgttcattttcatgaaacaatcccaagacaacactcttgccttttctggtagctttccttccgaaccaaccaatctgtaaacgcagtgcaccttgaaataactgcgcattcaattcctcatagatctcctgcaaatcatagatctttcccggacagtagtctactgggaatgaaggacgagcaagaaccctgtgcgaagataggaacgtcttttgacgacatgggaagcgaaataccctatagagatacttgctcagataacgttggaaattatgaagtactgtttcaaccataacgataggatgtctaaaacctctttctgcgctctatagatcccttttccatagtagttttagcaagatagccgatttcatctttataaaaacggttttgccttcctacttcgacaaatccaaaacgttggtagagatgcagagcaggattgccctcatagacttcaagatagaggacctcaagcttaaatcgcgtcttcgccaaatgaataagattgtttagcaaggcggtccctatgcctttattacgaaactcttctccaacaataatggaaatcagcgcatgatgggaaaccttaacataagggttaagaaccaaagttgccactccagcaacattcccattgtacacagctgttaagctagaatgataacgatagaatcctacccagaaatttacagtctcacgaatttctgcttccgtttggatgggaaatccacgtaaaattttaggatcattcagccattttagcatatacgttgcatcgctaggaagagtgtaccgtatttctaatcctagaattcctgtattttgcttttctgctgtcatgaaacnnctccaaactctgccaaatatgctttaataaattcatccaatagctcgccgtcgagcatcgcttggacatttcctgtttcatgtcccgtacgtacatctttaacaagagtatagggctgaaatacgtagttgcgaatttgagatccccaagcaatttcctttttatctttgcgatcaagagattgcttctctaaacgttcttgtaaaacctgctgatacaactttgcttgtagcattttcatacagctctcacgattctgtatctgactacgttcattttgacatgaaacaacgactccagaaggtaggtgcgtgatcctgactgcggattccgtaacgttgacgtgttgtcctcctgctcccgaagaacgaaacgtatctatacgtaaatcattaggtcgtatctcatcttaatctntcatcaatctcagggaagacgtctacagaagcaaagctagtgtgacgtttcccattactatcgaaaggtgagatacgcaccaaacgatgtactcctcgctctgccttggcatacccataagcatacattcctgaaaactttacagtaacatgcttaattccaacaacttcaccatctaagcgatcgacaacctctaaggcccattgatgtttcgtcgcccatcgggaatacatacgaaacagcatctctacccaatcacacgactccgtcccacctgccccagcattgatcgtaaggaaacaagagttcttgtctgcctctccggaaagcaaccgttgcgtctcccaaacagcaagtttcttctcacaaaagagaaattctttctctaagtcttcacaaatcgcagggtcttcaagagcatcggcatcctcgaggaaaaactctatagcatctattttgctttttaattcctgatactcttggatttgtcgtctcagacttacaatctgttcagaaatttttccagcatgaacactgtcttgccaaaaattttcttcggaactttcttcttctaaaacttgaagttctttttgttttttatcgaggtcaaagagacctcgcagctaaagatatttccgtgcgaagtgcttccaaacgcttgtctaaattttcctgcattactcttaccaacctacgattccaatcaagattctagaaaacaaaagccaataaagtcaattagagcaaggacttcctagagcttctatgacttaaacaaaaaccaagactttttcttctttttggagagaaagttctttgttatatcttttctaaagactccccttgacgctttctaaatagaaaaggtaaagagaattccacttttttgttttgacgagaaacctctctgagagataaaaaagttgggatgaagagctcaggtctcttcttaccacctttactaggagtcaccaatgagtcaaaaaaataaaaactctgcttttatgcatcccgtgaatatttccacagatttagcagttatagttggcaagggacctatgcccagaaccgaaattgtaaagaaagtttgggaatacattaaaaaacacaactgtcaggatcaaaaaaataaacgtaatatccttcccgatgcgaatcttgccaaagtctttggctctagtgatcctatcgacatgttccaaatgaccaaagccctttccaaacatattgtaaaataaggaatttgttcgctgttgacttaggcttaagaaagcatgagctctcattctgatatgttaagtaccctgccctttagggcggggatataaagtgatctttaatttaaaatggagttttttctattaagaaaagaggaatacttcaaaagcttagtatcacctataataggaaaattcttgggccccataaatagtctcaagtttctcgtttttaaagaccggaaattagacaacaaatagttttatagtgcttatctctatttctttagccacccttcctattcttgccttttcttgggcttccttcattgaaccgaattggttaagaacaactgctattccatggaggcttccaaaaaaacatgcgcatttgcatggtcttcgcatcgctcagatttcggatctccatttccataagagagttcctgagaaatttcttaataaagtttccaaatcaataaaaaatttctctcccgatcttattgtattttgtggtgacctcctttgccgtgctcgacttgaagataaggaacgacttgaaaccttcctaaatacattagaagctcctctaggagtctttgctattctaggcaatcacgactattcttcgtatatttccagaaacactaaaggagagattacctgtatccctgaggaaaaaagtcgtcctatacaacgcgccatcattgctgtaatgcaagggctattctcctctcctagctatcgctatgatcccaatctgactccccaagagccccacccagacctcttaaaacttctgaagaatactcccctaactctccttcacaataccacgcatgtcattcctaacactcttaatattgtaggacttggggatctgttcgctagacaattccatcctgaacaggcattcaaaaactatgatccttctctcccaggccttctcctttctcataatcctgatggcataactaggctgcaacaataccctggagattttgtactttcaggacattcccacggtccacaagttactttgtcctggccgaagtttgctcgaaaattctttgaaaggctgtcaggattagaaaatccctatcttgcacgcgggtatttcgttactaaggaaggaaaacaactctacgtaaaccgcggtctcggcggactaaaaagaattcgcttctgctcccctcctgaaatctgctacatcacatgttcctatgattaagtcttctctaatacttcttagtggaggacaaggtacacgttttggatctaaaattcctaagcagtacctccctctaaatggaactcccttagttcttcactcattaaagatactctcttctttgccacaaattgctgaggtgattgttgtttgcgacccctcatatcaagaaacctttcaagaatatcctgtctcttttgccattcctggagagcgtcgccaagattctgtcttttcaggactacagcaagtctcctatccctgggtaatcatccacgatggagcacgtccttttatctatcccgacgaaattcatgatttattagaaacagcagaaaagatcggggcgacagctctagcgtctccgattccctataccataaaacaacgcaatcctgtgcgcactctggaccgagacaatttagcaataattcatacccctcagtgtataaaaacggaaatcctcagagagggtctagctcttgcaaaagaaaaacagctcacactggtagacgacatcgaagctgctgaaatcataggcaaaccctcgcaactcgttttcaataagcatcctcaaatcaaaatttcctaccccgaagatctaacgattgcccaagccctcctatgactaaagtagctcttcttattgcttatcaaggaactgcctattcaggctggcaacaacaaccgaatgacctatcgattcaggaggttattgaaagttccctaaagaaaattactaaaactcgcactccactaattgcctctgggagaaccgacgcaggcgtccatgcctacgggcaagtggcgcatttccgagctcctgatcaccctctatttgcaaacgcgaaccttacaaaaaaagccctcaatgcgattctccctaaagatattgtaatcagagatgttgctttgtttgatgataatttccatgcacgctatcttaccattgctaaagaatatcgttattccctatcaagacttgccaaacctcttccctggcagcgccatttctgttatacccctcgccaccctttttctacagagctcatgcaggaaggtgcgaacctgcttataggaactcatgactttgcctcttttgcaaatcatggcagggactataactctacagtacgaacgatctataccctggatattgtagataaaggagattctctctccataatatgcagaggaaatggcttcctttataagatggtacggaatcttgtaggagcccttttagatgtggggaaaggagcgtatccacctgaacatctcctagatatcttagaacagaaaaatcgtagagaaggaccttcggcggctcctgcctacggcctttctttacaccacgtatgctattcctctccctacaataacttctgttgtgagcaatgctctgttagcacgtcaaacgaaggataagagaaaaattctttgcctttaagttcagggtaatcttcaggggtgatctccgccatcgaattgatacatactaaagttgctggaatcttggagagcgcccgaagccccttcacagaatcttcaaatcctataactttcattccttcacgagcaaacgtccgatacgcgtagtcataactatctccgtaaggcttagggcgtgcataattttctcgggtgacccagaacaaaaatttatttaaaattggatacatagtacgtagtgtgtgcgtggcatctcttggagagttagttacaactccaaatgttttattcaaagacaagacaagctcgatgaaagcttcgactccaggcatcagagcaggacctgcgtgttctaaggacttgtagtaaatctgcagtcgttttgcaaagatctccgccatgtactcttgtgcttggggatattgttctataaactttttgctaaaaatttctgttcctaaggtagtatgactataataggtagaaaaatcccaatgcacttctaaagaaaattcagcacaggcttgtaaaaatgcacgataaaaacaaggttctgtatctacaagcaaaccatctaaatcaaaaaagaaaacgtcataatcctctaaatacataccactcctcaaacacaactgaaactcgtcgcttaccaacatactataaatccaacattgtcttaaaaatgattttacggatctccaccgtaagccttcttacaagttgctccttctcgaaaaattctcgtacctgtttcgtcactccagaacgcattacctcacaaaaagactgccccgtccttctccatccaaaaagcactacgatttctccccctctctatgactggatctccccaaatagagaggtaatcaccgcctattctttctactgccgaggtcaaggaaactctatcataactcccgaaggggttctctatgattgtgatggactccatcacagcataactaaagaagagttccgttatatccatcctagattgattgaggtagtacgactcttgcaacaagatcaccctaaagtctctattattgaagccttttgttgtccaaaacactttcattttttagaagcctcaggaatctcactctctcaactccatctccaaggtactgcagctaccttcgctctagatcctcccctccccatggagaaactcttggcaactataaagaaactgtataaaaaaaactccgatccttctctctctaattttatcgttacagaagctacactgaccaatccagaactgcgactcacgcaacaagatctcggctcgcatacagaaattactgtagaaattctcgataatctacaaaacaaagaggctctttcctccgcataagagatttctcttgcgataattagaacagaaaccgtacattcgtggctcactttatgccggtgtggcggaatggtagacgcggtagactcaaaatctactcttagcaataaggtgttggttcgagtccgatcaccggcataattctttcttttttcaggttgccaataaattgttttgtcgtttttcttagggaaaaccaaagtaacaccccgatttcttatgaatgaaagaaccctcttgctcttgttaaaaaagaagaagggccttttccttgctattttagatcttacgcaaacagaatcctctctaacgactccagaattagagaaagtcttaaagcaaaaaaaaatctttctttcttgcatcgatagagttgatcttcaaatcaaagagtttcgccatgccttctcttccgaacttccccaagatatccaagaagagctggaagaaatccgtgatgttattattcgtattctagatacggataaacgcaactatgcacagaaaaaaaaggaatttggtatttatgaacgtccctgattccaagaacctccatcctcctgcatacgaactcctagagatcaaggctcgcatcacacaatcttataaagaagcgagtgctatactgacagcgattcctgatggtatcctattactttctgaaacaggacactttcttatctgcaattcacaagcacgtgaaattctaggaattgatgaaaatctagaaattcttaatagatcctttaccgatgttctccccgatacgtgtcttggattttctattcaagaggctcttgaatctctaaaagtccctaaaactcttagactctctctctgtaaagaatctaaagaaaaagaagtggaactcttcatccgtaaaaacgagatcagtggatacctgtttatccaaatccgcgatcggtccgactataaacaactagaaaacgctatagaaagatataaaaatatcgcagaacttgggaaaatgacggctaccctagctcacgaaatccgcaatccgctaagtggaatcgttggatttgcctctatcctaaagaaagagatttcctctcctcgccaccaacgaatgctctcctcaatcatctccggcacaaggtctctaaataaccttgtctcttctatgttagaatatacaaaatcacaaccgttgaacctaaagattataaatttacaagacttcttctcttctcttatccctctgctctccgtctctttcccgaattgcaagtttgtaagagagggcgcacaacctctattcagatctatagatcctgatcggatgaacagtgtcgtttggaacctagtgaaaaatgctgtagaaacagggaactctccgatcactctgaccctgcatacatcgggagacatctcggtaacgaaccccggaacgattccttccgagatcatggacaagctcttcactccattcttcacaacaaagagagagggaaatggtttgggacttgctgaagctcaaaaaattataagactccatggaggagatatccaattaaaaacaagcgactccgccgttagcttcttcataatcatccccgaacttctagcggccctacccaaagaaagagccgctagctagaacgcgttcttgaatcttcaagaccacttagggttctcaaagatcatctacgatgttttcttatccttgaaattgctcttgctctagtctttcaacctccgctctaagctgtgcattttcttcttgcaatctttgaagctcgacctctagctcaaatctcattccagcatcttctcgaacaggagagagaaggctctcaaggtcacagcattttctctgagccacttcgcaatctttgatcgcttgtgcatgcatcttatcaagagctcgtaatccttctttctgctcttctatgtgttctcgaagcttgctgatttctttttcagcttctacagcatcggcaaccagttgagtcaattcgttagatttaaatgcaagtgctttcaggagttcttgattctcttccacgagttcgcggatcttcttctggctgagagaagcagaatctgtgagtacccagtcatcgtcctcaccgatctcagtaggagcagcggcaccctctaaatccgctaacttcttcttgtaggccatgttttccttttgagccttctcaaagagatcggcaaaatgattcatactttcttctaagattttttcttttacctgtttctcctcttgaagacggctatacctttgttgtagctctttggaaatctttctcaactttttctgcctcacgcagactgtcctggtactcaagaatgaatgtattcagacgtctaatttcttgggtttgttcgtagtcttcctgttgctgcttccctaattcttcttcccaaacagctgctgctttcttcagattagcatctttttgttcgagctgcttctcatagtcatggaccagactctctaagcaagccttctcacttttctctgcgttgacttcctgtaaaatcttttgcatatctagtttctgactcagatatttctctttatattcgcgatagaacagagattgttcgtcaaaagcaatcccagtaagtctcagatcctcttgtaatctttctaatttggcattctgcttacgccaagccttctcttgttgatggattgtgcccctcatctcaatccactcctgcatagatttcagctgtctccttaaatccttctccagttgctggcgttctgcacaatccatctctgtgccctcacaggcacgctgcgaagcctcgcgatcatgagcccgttgtatatccttctgagattggttaaatacgttgtaaagccgtccagcatctcttctgctcgtcatcgatccgactccttaaatcttgcaccgtctgctgctgcaaactgattagatcttgtagacgagaaatctctttttccccctcctctgatctaactgtcataattccttgaacaaatcgctcataacttctacggttaaattctagccgatcggcaaccagactacgcatttccaagagctccagcaagaactcatacctttcctcgtctttaagatgggccgtcgagcgatacagaatctcctcttcacgtcgcagcttacgatccaacattccaagacgcttttcacagtctacaaccacctggggcaccgcagggtccttagcgtctctatcctttaagagaacctctaaaagagtcccttcaagaacttctctggtctcgtttcttaaatcttcaatctgaatttgttgtggttcaggaaccggagggagttcctcaggaaggccctgagaatcataaagacataaaatcaaagccaaagcaaatataacggctcccaaagcaatcagacctgttccaataaacataggaactgctggcagcaatcctacgagtaatcctccccctaaaatagtaagaagagcaagaataataagacttaccttaacaattgtatgattccatccacactgctggactcgagctattgccatctcccctctttcctcaagcgttagcggggaaaagacagggtggttactgcctagctctcttacaaaactaggatcttgaaatgtaggggatttttgagcgggtgttgccatgttgctactacaatctccaattgaaaaattatttggcctaaggattttacgtcttaatgatatttaaatacaacgattaaatcgtatttcttattttataaaaagtatttgataatattttttaaattctttctattaaattgaaagttttgcttcatttttcaagatttagtaaaaagaaaaaatgaatccatccaggggagagaacatggcgattaaaaatatacttgttgttgatgacgagcccctactcagagatttcctctcggaacttcttacctcacagggattcatcccagacactgctgaaaacttaagaaatgctctccaaatgatccgaagtcgagactatgaccttgtcatctcagacatgagtatcctgacggctctggtcttgatttaatcaaaattataaagcaaagctccccccacacgcccgtccttgtagtcactgcttacggaagcatagagaacgccgtagaggctatgcaccaaggggcattcaactacttaacaaaacctttttcttctgaagcactttttgcctttatctctaaagctgaagaacttaagaacctagtccatgagaatctctttctacattctcagacaacaccagattcacaccctctgattgcagaaagcaaggctatgaaagatcttcttgccatagcaaaaaaagcagcttcaagctcagcaaatatattcattcacggagaatcgggatgcggaaaggaagtcctctccttttttatccaccacaactctcctcgagccaaccacccctatattaaagttaactgcgcagcaattcctgaaactctcttagaatcagaactttttggccatgaaaagggagcatttacaggagcaactacaaagaaggcaggacgttttgaacttgcccataaaggaaccctcttattagatgaaatcaccgaagtcccagtaaaccttcaagcaaaactcctgagagctatccaagaaaaagaaatcgaacaccttggaggaaccaagaccctctccgtagatgttcgcatcttagcgacctcaaaccgaaagcttaaagaagctatcgatgataaaagcttccgacaagatctgtattaccggttgaatgtcatccctctacacctcccccctctaagagaccgacaggacgacatcctccctctggcgaactacttcctaaataagttctgccgcatgaacaatactcctctgaaaaccctctctcctaaagctcaagagctcctccttaactacccctggccaggcaatattcgagagctctccaatgttctggaacgtgtggttatcctagagaacacctccctactcaccgaagacatgctcgctttagcttgatctcctctaggggtttttcttgtttttctcaatagcatctggtaagctgatttgctttaatctctgtattcttttaagcaccgatagctcaattggatagagtacctggcttcggaccaggtggttggaggttcgagccctcttcggtgcgttaaattctttttttgaataggtatttctccttataatagagctatggagaactatttattttatctactctcctaaagcatcacgtaaccctaggagacaagatgagacctcatcgtaaacacgtatcatctaaaagcttagctttaaagcaatctgcatcaactcatgtagagatcacaacaaaagcctttcgtctctctatgcctctaaaacagctgatcctagagaaaagcgaccacctcccccctatggaaacaatccgtgtggtgctaacctctcataaagataagctaggcaccgaggtgcatgttgtagcttctcatggcaaagaaatccttcaaactaaggttcataacgcaaacccatacactgcagtgatcaatgcttttaagaaaatccgcaccatggcaaataagcactccaataaacgtaaagacaggacaaaacatgatctaggtcttgcagcaaaagaagaacgtatcgcaatacaggaagaacaagaagatcgccttagcaaccgagtggcttcctgtcgaaggcctcgatgcctgggattctctaaaaactcttgggtatgttcccgcatcagcgaaaaagaagatctccaagaaaaagatgagcattcgtatgctatctcaagacgaggctatccgccagctagagtctgccgcagaaaacttcctgatcttcttgaacgagcaagagcataaaatccaatgcatttataaaaaacatgacggcaactatgtccttattgaaccttccctcaagccaggattctgcatctgaggactccacatcgcaatctcaaatcttcgatcccattagaaatcgggagttagtttctactcccgaagaaaaagtccgccaaaggttgctctccttcctaatgcataagctgaactaccctaagaaactcatcatcatagaaaaagaactcaaaactctttttcctctgcttatgcgtaaaggaaccctaatcccaaaacgccgcccagatattctcatcatcactccccccacatacacagacgcacagggaaacactcacaacctaggcgacccaaaacccctgctacttatcgaatgtaaggccttagccgtaaaccaaaatgcactcaaacaactccttagctataactactctatcggagccacctgcattgctatggcagggaaacactctcaagtgtcagctctcttcaatccaaaaacacaaactcttgatttttatcctggcctcccagagtattcccaactcctaaactactttatttctttaaacttatagctaatcatccatgcagatctgtgttaccggcgttgtacttcgcagccgccccttaggaaaaaatcatacactcaccactttatttacccctgaaggactctttaccttttttgcaaagcaaggacaaaccctccaatgtgattatcgagaaacccttgtccccatatctttggggaagtatacgttacatcgtaatggctcacgccttcctaaactgacccacggggatatcctcaatgccttcgaagcaatcaaacaaacctacgctctcctagaagctagtggaaaaatgattcaagctcttctggcttctcagtggaaagaaaagccttcgcataagctcttctctttattcttgaatttcctccaccgtattcctgaaagcagcaatccagaattttttgcagccatctttgtacttaaacttctccaatacgaaggaatcctagacctgactccagcatgttcgctatgcaaagcatctctaccctatgcctgctatcgctaccaaggccataaactatgtaagaaacatcagcataaacaagccatctccatcgagaaagaagaagaacaaatcttacaggctatcattcatgcgaagaagttttctgaacttctagctattgcagaattcccgattgctatagctgaaaaaattttttatttgtttgactcgctacaagaggaaaaaaaatcagaaagaaattcttcggaagatccatatcatgaaatcctaagactttctaaagtagtccatccctactgatgaaggacgtgtaggcccctagaaattataattatcaaaggtaccgctgcaccaaacctttgaaaaaaggtgtgttttcctagaattcaagaaaaattgagagaaataaactccctaagagaaggtaattgtaccgccctcactagatacgttaaatattaacgtcacctcagagaatccaactaaatcattgtggtatattttattccatacaccccaaccctgttttataaacgtactcccaggacaaacgtttccttttaaagaagtttttgtatttacaatgacgccaacatctttaggcagttttaaattgatagattctttctgattagaaatggtaatggtactacttctattccatttgccacggaaatccatatccatcttgcaagaactacaagaaaaatttagagcatagagaacaggatagactcccctacactttgcacggagatgaccgaaagaaccttgataatttaaagtctctaatttagggaactctccagtcagattgaattcgacccgtttttttctctgcgcctggatttccatattctccatatcagggtagcttttcgaaaaatcaaaacggtgggtgtaaaatgattcttcttcagaaagccaacaagggacagaaagcagctgattcccaaaggaacccgaagcaaacaaaacaatgaaaaaaaataaatatcgacaagcgaatcccaaattatgatctccatacaaaaatagtcaaaaataaataataaaggagggggacatcacgaagctattgcgaaagaggggactcgaacccctaaggaaagctccactaccacctcaagatagcgcgtataccaattccgccacttccgcaagaagaaactagcttaccgaggctgtaccctttacctcaagaaaaaaagtatttccctaccacgaaaaatcaggtacattgtcctaatagctagaaggagtaaagcctaattatgcgttgcactgcctactgtacagcatctgcttataacctccatgtccttttccacctacttaaaccccgctatcctaccatcttatctagagaatatgttctcgcaaacctagatagtacacaggcaagcaaccagttagcgatcttcttccctttcggagttgccgtattctggggttgggaagagtccgaagaaatcaaacttttacaaacaatcgttacagcatcaccagaaattcttccccaacccgagatcgattgctataactttcattacggagataaactccaaatccggagggaccgcctgacccttgccgacaccacattaaatacaaagctcgccattgcttttggtctggcgcaatcggtaaaactcacaaccttcgaaactacaatctataaaactatagaagattctaaacggcttccccaagatcttgctactaaaggaaaaatttccatgtctcggaaagccatcgcaaaaaagattggcaagctcttcctagataaggcttcagtaaaccttcattccgatatcttggatgaacctgattttttctgggatcatccagaaacacaggcgatttatcgtgacgttctcagttgtttagatattgaggcacgaatcaatgttcttatcgtttgactattcttggagatgtgttagaaattcttaacgaccaactcaatcaccaacactcttcatctctagagtggacaatcatatggctgattatgttagaattttctgtagctctactcaaagatgttttcaatgtcatttaaacgtttcttgcaacagatccctgtacgtatctgtctacttattatctatctctaccaatggcttatctcccctctcttaggctcgtgctgtagattttttccttcctgttcgcactatgcagaacaagccttaaaatctcacggcttcctgatgggctgctggctttctataaagagaatcggaaagtgtggcccctggcatcctggaggcattgacatggtccctaagactgctttgcaggaagttttagaaccttaccaggaaatagacggtggtgattcaagccatttttctgaatgatcttatccataggaatgccaaacctcttagctatcaaccataaagaatccccgtcctgtaccacatactcttcatcctgatcttcttgaacacgaggagcctctaccctccgagtcgacatgcaggccaactctctacgcggagaatgctgtaatcgagagaagaaattctgactatagggagactcttgaggcatcaggcggatgaccttctcaagatcttcatcacaaaattcatgcaaaacaacatcactatcatggacaagcaaaagcaaggctgccagagattcttcacaatctaaataagattttaagaccttctgacgttgtgtagctgaaatcatggaagtgcggctctcttcattgcaaaaatgaaagaaacgttcggatccgcaacgaatcaccatacgagctaatgaggctactgaagaggcctgcacgtctgcacctacaagtaacgtacgcaagtaaagaaattctggagtcgagcagaaatgatacaggcaatcttcatctacccagccttcttgtaccatcttttctatcagcaaaaacaagcccttagaagtatagggatacttgtggcaacgcaaatagtccaaaatcacaggaaagtctttaagatcaatattcggcaaaagccaccgcactgaagatcctttcaactctgtataggtcaaaggcttcgaaagcacaggagtgatgtctatgtggtgggaagctatcgctacactcaacgcccaaagttttatcggccgaccatacatatagcgctcatctttgaacaacgaaatcaagtcgtccaaagatgcttgagatatctcgtttaaaaaatcttcagaaaggtagaccttacgactacttttcgcaatcaaaggtccggaaaataaatgcagcttatagatgtctttacgaaatatggcagagtaaaataagagcaaaaaaagcatattcaatcccacactcaggatcaagacttgccacagccatctagtttttcttttgaaagccatacattttgcgcctaaaactcagttcattctctaggattaaaacacttgccactatacacaggtcatcgtaaaatccctcgtaaaaacatccttgcgtttatcatccatgcggattccaataactctactgcaancatacttttcagaacctctttcgacaaaggaaattttagaagcctgtgatcatattggcatagaanncgagattgaaaatactaccctatactctttcgcttctgtgattacagcaaaaattttacatacgattccccatcctaatgcggataaactccgggtagctaccctgaccgacggggaaaaagagcaccaagtggtttgcggagcccccaactgcgaagcaggattgattgtagctcttgctctacctggagccaaattatttgatagcgaaggacaagcctacacaatcaaaaaatctaaacttcgtggtgtagaatctcaagggatgtgctgcggagccgacgagttgggccttgatgaactccaaattcaggagagagctcttttagagctcccagaagccacccctttaggtgaagatctcgcaacagttttagggaatacttctttagagatctctctaacaccgaatttaggccactgcgcctccttcctaggattggcccgagaaatctgccacgtcactcaggcaaacctcgtcatccctaaggaattctcgttcgaaaatctcccgactacagccctagacatgggcaatgatcctgacatttgccccttcttttcttatgtcgtcattacgggaatctctgcgcaaccttcaccaatcaagcttcaggaatctctacaagccctcaaacaaaagcccataaatgctattgtcgatattacaaattacatcatgctttctctagggcaacctctgcacgcttacgatgcgagtcacgtcgctttagactctctgcgagtagaaaagctctccaccccagaatctctcaccctattgaacggagaaaccgtcctcttgccctcaggagtgcctgtagtccgcgatgatcatagtctcttgggtcttggaggtgttatgggagcgaaagcaccctcatttcaagaaaccacaaccactacagtcatcaaagctgcctatttcctccccgaagctctccgtgcctctcaaaaacttctcccgattccatcggaatctgcctatagattcacccgggggatcgatccacaaaatgttgtaccagcactacaagctgcaattcactatattttagagatcttccccgaagctacaatctcccccatctatagttctggagaaatttgtcgtgaattaaaagaggtcgctctacgccctaaaaccctacagagaattctagggaaatctttctcaatagagatcctctctcaaaagttacagagcttagggttctctacgactccacaagaaacttccttacttgtaaaagtcccttcctaccgccatgacatcaatgaagaaatagatctagtagaagagatctgtaggacagaatcttggaatatagaaactcaaaatccagtatcctgctacactccaatctacaaactaaaacgtgaaactgctgggttcctagcaaacgcaggacttcaagaattcttcactcctgacctgctagatcccgaaacagtggctctaacaagaaaagaaaaagaagaaatctctcttcagggctccaaacataccactgtattgagatcctcactgcttccaggattattaaaaagtgctgcgacaaacctaaatcgccaggcaccctctgttcaagcttttgagatcggcactgtctatgcaaaacatggagagcagtgtcaagaaactcaaactctggcgatcctgctcactgaagatggcgaatccaggtcctggctccccaaaccctctctttctttttattctttaaaggggtgggtagagaggctgctctatcaccaccatctttctatagatgctttgaccttagagtccagcgcgctctgcgaatttcacccctaccaacagggagtgttgcgcatccacaaacagagttttgctactttaggtcaggtacatcctgagttagcaaaaaaagcacagataaaacaccctgtgttctttgcagaactcaacttagaccttctatgcaagatgctaaaaaaaacaacgaagctttataaaccttacgccatatatccttcatcttttcgtgatctcaccttgacagtacctgaagacatccctgcaaatttactgagacaaaaacttttacacgaaggttctaaatggcttgaaagtgtaaccattatcagtatatatcaagataaaagcttggaaacacgaaataaaaatgtttctctacgcctcgtattccaagattatgagcgaacattatctaaccaagacattgaagaagaatactgtcgtttggtagctttacttaacgaattgctaacagacactaaagggactatcaattcatgaaacaattacttttctgtgtttgcgtatttgctatgtcatgttctgcttacgcatccccacgacgacaagatccttctgttatgaaggaaacattccgaaataattatggcattattgtttccggtcaagaatgggtaaagcgtggttctgacggcaccatcaccaaagtactcaaaaatggagctaccctgcatgaagtttattctggaggcctccttcatggggaaattaccttaacgtttccccataccacagcattggacgttgttcaaatctatgatcaaggtagactcgtttctcgcaaaaccttttttgtgaacggtcttccatctcaagaagagctgttcaatgaagatggcacgtttgtcctcacacgatggccggacaacaacgacagtgataccatcacaaagccttacttcatagaaacgacatatcaagggcatgtcatagaaggaagttatacttcctttaatgggaaatactcctcatccatccacaatggagagggagttcgttctgtgttctcctccaataacatccttctttctgaagagaccttcaatgaaggtgtcatggtgaaatataccacattctatccgaatcgcgatcccgaatcgattactcattatcaaaatggacagcctcacggcttacggctaacatatctacaaggtggcatccccaatacgatagaggagtggcgttatggctttcaagacggaacgaccatcgtatttaaaaatggttgtaagacatctgagatcgcttatgttaagggagtgaaagaaggtttagaactgcgctacaatgaacaggaaattgtagctgaagaagtttcttggcgtaatgattttctgcatggagaacgtaagatctatgctggaggaatccaaaagcatgaatggtattaccgcgggagatctgtatctaaagccaaattcgagcggctaaatgctgcaggatagtttgcggtaatggctgatgacaccctcattcctaaacttatgaagaactcgctttcgcaggcgtgttctgagggtttactgattgctaagtatcctccactccaggttatcgttcactttgataataacctagttgttaaaacacatctttcagtagctcctgtcttctcttgtctttttttaggaccagcagctcacaaagccatgcaggaaattgttttatggtgttctcgctatgccaacaaggaacatcctcctttttcctcgcattttgctaaagacctcatcccctcacaatatctcgaaatcctaaactgcgttgcagagattccctttggagagcagcaaacctacgctgaaatcgcaaaaaaaactgatacgcaccccaggactgtaggagccgcatgcaaacaaaatccgtttctgctgttctttccctgtcatcgcgtcgtaggaagccatggagagcgtaattacgtcctagggcctgtaattcacgagatcttattgaaatttgagaatagctactaatccccagctatagatttaagagtcttgcagacggggatctaaagcatcacggactccgtctcctatcagagcgatcgcaatcagcaacatcgttaatataattgctggaggccaaagaacagcactctctgcagggaatcctgtaacaccctccctcataagatttccccaagacgcggaactctcttcccccagacctaaaaaggtcagccctgcctcacagctaatcatagccatcatagcaaacggaactaaagagatcacagggacaatggcattgggaaggatctgatgcaccataatataatagtggctataccctaagtttgtagcagcaagaacataacctcggtctcgctgtttcaacacctcaatacggacatacctactaaaccctgtccaactaaaacagcctagcaaaactgtgttcaatagcaaagatttctgctgtgttatggaaatcaccagcattaagataaacagcacaggcatggtctcccaaatttcagtaaaccgagataaaatcatatccacggtcccaccgaaatatccagaaaccaacccgatcataatcccgatagctaaagctatcgtaatcccaatacctgcgactaccaaagctatgcgaatgccaaatactaaagccgctagtaaatctttccgagtgactctgctaagctgccaccaaggaacatacttgttcatttctcgagatcccccagcatcatcttcccaatggaaactactgaaaaaggggttaatcaaaatgcgaagatcttcagactctttctcgatccacaaacgcttatcttgaatgaaactgatcgcgctgcgcagcttggcatagtcttcaagtacctgacgaatctccaacaaagattttttatagggctctgctcgtttctctacattagcataagcaatacaaaggtcttcaggttgcccccagttgttgtaatccgcgaggcggagctcatgctctattcttgtcaaggccatcagaaacggtcggtagttgtccgtagcacgattccaagcttgctgcgccatctcatagggacgctgcatcttgtcgactctttgctgtaatcttttaaggcaaatgccttcatttttcatctctaagtgacgcaatgttggcatcggagactgccgtttttcttcaaaagcgacctgatacttctttacagaagcctcttgtttctttcgatactttgccttaatgagaatccccaactgctcatacgtactcatataccgccgttccatctcccaagtacgtgtatctttggggagcagcatgaccatctcagaattcaccttactgatgttttctcggaccttctcagctcgcattttttttaaattctcagtaacgcgggatcttgaactttcccactataggcccaagcaaaaatcatacattgagaaatgatgcacagccctaacaaccaacgacgtaaccaccccctagtcaacttaaaagaaagtatgaaaaagggaaacgtgaccatcaaaacgttgaaaaagagatccactggtttagtgtaatacccagggaaaaacaagtacctcagtaaaggaaaaaagatctctccatgccaggtgactagtaaaggtttactactcgcaaataaaggagcgtagatgccaatcagagcgacagaaataaaaaatttccatgataaagaggctaataaatttttatagtaagcagatagaaaacgttgataaaaggaaggatgcttctgcatttatatcctccttccctctagctgaactcgaggatctaagagtacgtagcaaatatctccgagcaaatatcccactaaagatagagccgatcctacaagcacagaaaatagaactacattgtgatctcgatttaaaattgcctgatagaagaagttcccaaagccatctatattgaatagggtttctacaaccaacgcccctccaagtaacgttcctaaatgaagaggctagagaggtcactatagagactgcagcatttttccctacgtgcttatatagaatatcaaaccaacgcaatcctcgagctttagcagcacaaataaaatcttggcttaatacttctaaaaatatcgaacgacttaatcgtgactgtgcggcaagagctccgtaactcactgcacagaaaggtaaaaacccatgcgacaccaagtcaaagatacgtcctagagtactgagctcattaaaaacctctgggggcgaacgtaacccagagtaaggcataggaattgtggtaaatggaatcgttttattaataacaaagttatctaagatccagggaaccgcaacaaagacaggaatagaaaatagaataaggaaaatgaaatttagagagtgatctatccagcggtttcttttcaatgccatgatcataccaaagatttggcataacacaaagcctacaatcataggtaaaattgacaagaccaaagaacaacgtaaacgcttgatcacttctgaaattacagtcttatgtgcgtcatttcgtaaagttccaaaatctaaccgcaacacccgggacatatagcgagcaaagcgagtctctaagaaaaaagtcttccagaactgcttagagctatagcaaaaaacttctgttcccccatgatcttggaaccacccttttaaagcttccaccttagtatcgagatcttcttcgttaagctgtcttactaaaaaagcattactttctgcgatctctttattttgagctctttgttctgggctaagattagggccgacaaatccttggaggacgccaccacgaataaacaagtctgcagcaatatggcgatatttatcatctcgcgaagcatcgtcagcttcaaataacaatgcgggcataacaaacttcgcacaatccccccaatagactaaggacttagcagcatttttcgcacttggagtagtattatttgcatttgcaagttcttggagtgcagtctgaatcttcttatgagtgatcttagggcgagtgttaaaaaaaatggggagcgtgaggccataatgctctcgaaactgcaaataacggtccgggcccttgtaagagcgcatcttatcggattttccagcttctcccaaagcgtccctagacttttcttccaagacatctccaggagccgcatttaaaattacaaaatttatagagacaatagcaaataaagtcagggggattaaaactagacgttttaggatgtacttaagcacggatcctccttcttctcaagccataccatagttacgttgacagtctcatcctgagcttcaggaattaaatctgttctatgtgtaggtacgaaaatattttttacataatccttataaagtaaggaacaatgtcgtgagaacaagaaagcataaggagcttcctcatgaataatttcatggaaacggtggtacaggcgattacgttctttcagatcgtattcgtagctgagtctgtctatgattttatcagcttcttcattatggaaacctacaacattcgctgaacccttttccatagccccttcagaatgccataaagccctaggatcctcaggaggaattcctaaacaccatcccattaaaagagcatcgaaattcttttcatcaaaagcttgcgaaagatcggccatatctagtcctagaaggctacactcgattccgatttccttacaagcagtagctacgtaatctgcaatggtatgagcggtgacactctttacataatagcataaacggaaacggaacgggacaatcacaccatcgataactttttctcggattccatcgccatcggtatctatccatccctcttcttccaggagacgagctgcttcttctggagaataatgccacccttcgatctgtttattataagaaggagaactcgaagcaaaaggcccactaatcgtatagccttggccatccaagcactgttcgataatcctctctctatcgattgccatgttcatagcacagcgcacctgtcggctttggaaaaataatgaaaagcaattccatcctatgtacgtatatgctcgatctgctgagactgtttcacggacggctcctcccttagctacctgtttgttataagcggagcttttcataaaactatagaaattatctctttggttgggtggaaggtaagagatgtctattttccctgtcttaaaatcttggaatagggagtctgtgctttccttaaaatagacgaaacgcttgtcaataagagccgcaagaggatcatagaagtcaggatttctagaaaacacgattttctcatcatccatccctgcaaagtagtaggctccacaacttacaatatagttgtttgcccaatgcatagtgaagttttgcgcccaaatggaattggttcggtaggtatcgatattctcatcttcaatgattttttccccgttagcaaaatactgatatacaaatctagggaggggctgcaagcttaaggtattagaaaatgcagagtagagcactttgcgctcttcctttccttcttcattgattaccgtgtgtgctttccatctgactactaattttaaatcgttttctactgagacagaaaccacatcttcataacaagagcgcagagccactgctcgcatggttgctacataagggttcataacagcgtcgtagaaaaacttaatatcatgagctgtcacaggatgaggacgttgaaatacttcgtctaactgaacgtgttttggaagggccttaggatctataggacgccaaaaaacattcggcctcagatagatgtgaaactctttatccccagaaccatcttcaacaagatgttcttctattttcacagcgagatctggagaaaattcttcgtatttccctacgtggggagaagctaaactagaatacagagatcgtaaaagcccacgacatatcaaagccattaaaaggctcaggntttcnggtttnccgacatgggcagtgcgtaggataccatgagggtggaaatttgttcctagaagttcaggaagagtctgctgtttataggggtctagggaaagtaaattaggataactaggatctccaaagagtagagcaaaagcttcgtctctgacgagcttaggagcgagcatcaccccaggtgccgcagggatagcttgtgatgtctgctgttgtttcactacgcgtgagatttcacgaatgtcttcttgaatatctcttacgttaccttttatcgacttaatgtctctttcaagtaggtctgaggaccagtataacaaaattaaagaaccggcgacaatcccctttaaaattttatctagcacacatcttttatacatgtgaccactctccctccgcttttagaggcaaggactcatagggatctctccccaaccatttaatccgagggaccttagatgctgcatagtattaaaatctctcaaaatcttatacaataagtgctgcttcgcacgattaagagaacatgtttcttccttcaacaaagaggaaaaggtcttttgttgatatttagatagcaatatgatgagctccccgtatgccaatctgtcttgtttgagttgtaaattcactggctgcaaacatggatcaaagtggtttggcagcatgttctgaaatctctttgcttggcataaactgtattgaaaagattttttaatcttcatgtaaccatgttatgctttggactatgaatgggtcaagaaatttcagaagagagggataaggagcaaagactcttttagaaattatttgtcgctacatagaacaaaaacaatctccaaaattttaatataagagagttgtgagtatggaaataacttgtcaactcatgggggananagacaaatagagggctttcaccctcttgtttgtcttttaaaaactaaaaactattcagcagtattctcttcagaaccgccttcttcatctttttcagtttgagtgtcgctatctgaagattcgtctcgtccttcatcttcagaaccttgagcttcgtcttgtggtgctgaacaagattcgtatccaaaagcagaacctgcaacaggaagcacaagagctaaaagaagggctaacattaattttttcatttttattctccttatttaaaatacgacagctcaaacctgagattggccaaataatcagtaacctatgacaaaataaaggctgacgtaaaggtttccaggcactatataaaaaaagaaaaataatctgcaaataaaaagtataaaaacaaatggatagtgttattactcgcgttgttgaggaaacaagtaaataccatagagtaaaactataattcctatgattagtagacctataaccaatgggataggtaaaagccctaaagccaaacagccatctataaatacctgagcaagaggggttcgcagtaaatataatacttaccgcagcagaagcacaaaaggcaactaataagcctagaattgctatagcactagcaatttcgtaacgagaacttacagacaaatccgcacgccaagaaaccctgactctattccacagactgtcttgccttaaaagaggataattaggtgttatttcgtccattgaattaatgatatcgtcggcatgtattctaggaaattgctaaaaaattagtatttatattcaacaccataaaatttaataagtttttgagattttttataatctcttttttttatctcttcgtaaattcttagacctttagcattcataccttgctgaaaataaagtattcctaactttgacatcgtttctacatcattaggttttaattttaggacaatttcatactcttggatttcttccataggcatttgcaagtcatgatagctataagcgagttgtgcgtgtacccaagcgttacctggagcatactcatttaaaatttggaactcttcaatagctcttcgcgccgttgcaaaaaacttttcttgaatctcagcgctatatctacccgaagggatccaataattagcatcaaactctgggtatttccttggatctgcgtaaagaccagaaagagctacatacgcatctgctaaagagacatgcgcactaagatctacagggatggcttgaaccactttgatataagcttcgatcgctttttggagtaaacattcacgaaaaagaaagtaatctttccaaaaacaaaaacaactaaatttcctaatgagatcatgcttgggcaagaatttgaatatctcagaaagaagagagtattcttgattctgaagatttatagataatttagtagctgctgccgctaaatgcgattgctcttctacaatgttctgggagcgtttattgggaggaacagcaccttgaagatactctgaagcgagatcctcaaaaaaatcacctttccccgaaagaagatagagccgtgtgacaaggcaaacaaacaatgtaagaaaaaaacacgcaagacagaatgctggaatgactgttttccctgagaatagaaagaaatatagaaaaaaactgaactcaagagcgatgagaagagaggctccacaaacaaagaggatctgcttaattaaatacttaagtaactgacgacttgttttattacataaagcttctaaattctcctgaaaacctaaaggtttcataaatcctgagtcctactttgttaattctaatggaaaattatgagattaattgttttaatgcaatgtttggtctccctatttttagcaaagaaagtcaccgtgacaactccagcctatctactagctaattttggaggacctcgtcatgctaaagaccttcaagaatttctgatttctctacttactgatagagatgttacgggcactttccttcccagagtactgcataggcatctctttactttcatcgctaaaaaacgtgttccgaaagttctccctcaatatcaatctttgcaaaattggtctcctatttattttgacaccgaaactcttgcaaaaacactctctgaaatcttacgagcgcctgtaattccatttcaccgctatctacccagcacacatgaaaagacgttgcttgctttgcgtactctacatacgcgtcacgtgataggtatccctttattccctcacttcacctattctgttacgggaagcattgtacgtttctttatgaagcacgtgccagaaatccccatttcttggattccccaatttgggagtgattctaaatttgtctctctcattacctgccacattcgggatttccttcagaagttaggaatcttagaaaaagagtgctgcttcttattttctgtacatggacttcctgtacgctatatctctcaaggagatccctatagcaagcaatgttatgaatcattttcagcaattacgacaaacttcaagcaatctgagaattttctttgcttccaatcgaagtttggtcctggaaaatggctctccccgtccactgcgcaactatgtcaaaacatagatacggataagcctaatgtcattgttgtgccttttggcttcatttctgatcacttggaaactttatatgaaatagaaagggactacctgcctctgctacgttctcgaggatatcgggcattacgaatcccagcgatttatagctcccctctttgggtatcgactttggtagatatcgtgaaagaaaactctacagtagttgccgaggagttaataaagagcgggaaaaaacacacagggattcgataagattttagggaagacgataccgctgttttatagcatcgtattttcctgagcgtcgtgttttcacaagtcctgcgttaaacccttcaagcaaatctccgtttgtccctttcagtattgcaagccgcaaaccatctgcgtttaagggttttgaaataattttcagtcttcctttatatgctgtttctattagcgcggtcacttcaattacaggagctagaagagcgtcgtaacaattcgatgttaaggcttccaatgctattggaacatgttggtagaggctaatcacagcgtcagggatattttgagctacaagaactgaagagtcaaacttatacactccaataagacgacctttaagatcctctatagattggtaaggagagtcttgagcgacgacaaggacaggacctgtgagtaaaatgggatcagaaaattgatagtgttcgagcatctcaagagtaggcaatacagatgtaaatgctccttgggtctttttatcatctaaattctcaaagagatgcacccaatcttgatttacaatattaatatttagattctctttatagttaatctcagaaacaagatcgtttaaaaatgcgttggtatcggatgtataaatgccgaattgttttggaaaccaggtggcatcacgacctacgagaacttctctttttactcgagagcacccgaaaaagatcagtcccacagccagtaaacatattaaaaaatttaccttccaagaaaattttatcttcacgtttagctgtgcctcgctgttctgcctctttttgcatcatattctagataagaaatttttatccagcgcgctataaagcctaattttaaagaagagggattcgtataaatatctgaaaaaatagaaacatataaaaaaattatcacattgaaaatcagtactttctgatattaagaaggactattcgatatttcctcagtcttaagggtccttttccacaatatactcagcaagatatgttttcccaagttttcttcttcgccttagggtcaaaccttcacaagcaatctcttcatcggaggcattctctaggaatagagtcccttcaggattcaggatgtttcccgaaacaatcttctgtaaaagggtttctacgtaacaattacaaagttcgtaaggaggatctatatagattagatcaaaggatctcttttgtttgataagtctttgaattgccgattgagcatcttgtctaaagatgacgacaggaagttgttctccgagtaaagcactatttgtgtgtattaattgtattgcttttatagagatgtccacgaatacgacagaagcagctccacgacttagggcttcaaaacctatcgctcccatcccggcaaaaagatctaaaaaagcagccccttctatatcttccctacagatactgaaaaacgcttctttcactaaacctgaagtaggtcggatatgtggattagaaaatgtttttaaggatttccctttgtacttacctgctaaaattctcacatcacctcttgaggaacaaagtttacgtaatcagcagccactagtatgtagtggatccctcggatattaccgaatccatctatagggcgttgcactttatgaatatgaccaaataggcatagagagactcttccatcagcttctaagaattccgaaataggtcctggagtaccgtcactgctgattggggggtagtgtgtcatcacaatcacctcagtgacttctttaggaagggcagcaaaagctctctttaaacggcccaactctcggagaaaaatcttttcatcctgttctgtataagattgttcctgagtagaaggagtaaggaaattctccttcttcacacatattgtaggactatcccacagtcgcactcctacaacagcaagatggggtgttaacagagcaaacccttgattcaaatagtatagagagggaggaagtgcttgtagaattttacttgttgaagcagaactccagtaatcatgatttccacgaatcatatacttcgttcctgggagatccccaataaaggcgaaatctttatgagcctctgagaggttcatagcccaagaaatatctcctgggaggagaacaatatcctctggatggacaacagcttgccattcagagcaaattttctgatggtatcctatccaggggtctccaaaaacttccatagttttttcagggacgcctaaggctagatgcaaatctgccaaaccataaatatgcatttgaagggagccagtgtaaaaacgcaattgccgtctactgtaggaactctaaccataaaaagcaaatgtctctgaagttcctatctctagagcgtcacgactgaccttgggagctacactttgccctagaagatatagttgtcaggaatgtgcgtgccttgaggaacaatgataatattatctctcacaaatagctttttatcaggagaatcatatttaatatagcccttgagattctgtagtttgacaccgtttccaatacaacaattctcatctataatcgctttacgaatctcacagtctttcccaattcctaaagatggcatggatggagatccgtaccgagcattgcccataattatagactgatcgactacagagttctctccaatcttactacgaatccctaagacactccgagatacatgactcgtattaataacacaaccctcacataataaagaacttgagatcatagaatccgtaatgattgctccaggaagatgatgatttttactatagatcattccgttatcatcataacaattcagtcctcttttctctgcatgaggcttttgagttaacgctatatttgcttcataataagattctatagttccgatgtcggcccaatacccattataaaggagagtttgtacttgtccccgcttcatctgagcttggatgagatgctttccaaaatcgtttccttcttcttcgcgaagcaaagaaaacaaactgtctcttcggaataagtagatgcccattgatccaagaaagtctcctgaatcttcggttaacttatgaatacggcgatcttcagaagaaagctgaaaacgcttgagtacttctttttcttgaggtttttcatagaaatcgatgagttttccttcagaatcaatatctaagactcccattctataggcatctttttctgggataggctgggcaacaagaaccatatctacatgagttcgtatggctgtatctacaatagatctaaaatccatattgtagagctggtctcctgataagattaaaaagtattcgatttctgtatcttcgaaataaagtaagttttttcgaattgcatctgcgtaccctgataccagatttggtcaccctgacgtgcttcaggagcaagaagatgtatctgatcctgcaaaactccatgataaaaatacgtcttaaataaatgctgttgtagagtgtaggtaaggtactgacctataacaaaaatttttgaaaaacctgcactaattgcatgagatattggaatatcgatcagcttataccgtcctccaaaagatacggtaggcttacagcgacaattagttagaggagataaccttttgccctcccctccacacaagataattactccaaccttatctcgataaaaatgagagctctcaaaatttgaggcctccggaaaatcgttttctatcatttgtattcgcctgttctaatttaattttaaattagaaacaaataaaaaggccaacacaacaaaacaaataaattttgttaaataattaaattctttttaataaataggttctagaaattaagattcaatttctagaatttcggaaattttgtttgccagggttagatcaccactgcttagcttcccataagcgatcaaagcttttatcagagtgggtacagtaaataccgaactgacttttattccctgtggaccaagtggttgacacgcttcttttctacgatctaagaataccaatgcttcacgaactaccagaccattttcttccagtgcgactgctgtctctattatagattttcctgaggaaaccatatcattgatgactaaacaagtttgtcctggagtaaataacccttctactttaatagcgtccgaggggtctacattctgtaattccttccttcgcaataccatagggatgttatattttaaagagatcgaggttgctagggttagagcagtataagggactccgcagagtaagctactattgaatgaggggcggaggcgccaaataagagttgccactgtctggagaacttctggagaggagatcacaagacgcatatctacatacagaggagtttcttctccgctagcgagaatatgttttccgaactttatagctccgatttggtatagaattgctacagcttgaccgcgtaattttgcatcttcgtagttcatcattctccagagcctccgaccgtttttgacaaaatacaaaaaactcacttataagggaaaacatgctaatacgcctgtttcttggaatttctcttcccaaaggctttcccttatatttggagcctcctctagttcttgcaacgtttcaaggaactcaattcgtgggaacttatagtgaggctacaaaccctttgtatatcgataatttgaatctaaattaccactatactcaagaactactttataaagcagtcccgtgtaattataaatctatatatagagagatacctttaattattttcccagaagtactcataggaagcacgccaacacaatctactgagtgacgtcctacctaaaagcataacaaagattaagcaagactattctttgagtgacaacaagaattctgcgttactattggttttcttcaaccttcctagcaagagatgcatggcgtctatagtagtaagatctgctatggcctgacggaaaaggtagaccctttctaattcactaggatgatagaggagttcttcttttctagttccactcttaattaaatcaatagcggggtaggttcttcgatctgacagacgtcgatccaagacgagttccatatttccagtgcctttgaattcttcaaaaatcacttcgtccattctggaaccagtatcaattaaagcggttgcaagaattgtgagcgatcccccgccttcaatatttcttgcagcaccgaagaaacgcttaggtttgtgcaatgcactagcatcgacacccccggtaagaatttttccagaatgcggctgaactgtattataggcacgtgctaatcgtgttatggaatcgagtagaatgaccacatcatttccatgttccactaaacgacgagctttctctataaccatctcagcgacctgaatatgcctttctggttgttcgtcaaatgtcgaggcaacaacttctccacgaacttgccgaatcatatcggtaacttcttcgggtctttcgtcaattaacaagacaataagaacaatatcaggattattcacagcaatcgcgtgtgctatgctttggagaatgacagttttcccagatcttggtggggctacaatcaatccccgctgtccttttccaatgggggcggtaagatctaagactctctcagccaaatgatctttccccatttccatcacgattctttgattagggtagaggggggtcaggttttcaaaaagtacacgttctttagctttatctggagtagatccgttgatcttatctactttcaatagagcaaagtacttttctttctctttaggtgagcgtatcgtaccgataatcgtatcaccttttttgagatcaaatctacgaatctgagctggagaaacataaatatcttcagcagaaggtaggtaattataggttggggatctcagaaatccaaatccgtctggaaggacttctaacacgccttcacctatcagcaattcatctgggcgctctgacttggctttaacaatctcaaagacgacctgagactttgttagagatcctatatttttcacaccgtattggcgagctaatatattcagctcttcaattcccattctttgcagtttagcaatttttgtaactgtgacagactcggcctcttcagactcactggcaactacagcacactcccctacacaagatttttcctgcatagaaacgtaagcatgttttttcgtttccttcaccctaggcaagatttctgaagaacgctcttctttcataatgctccctttaaagcgtaaaaatattcttcaattttttgatgtaattcttttttagttccgttgttttcaacaacaacatctgcttgtgctaacttttcttcgacatttagaaaacgcgaacacctttgatcaaagtcttcagaggaacgccctgttttcttcatgaatctctcgcgtcgaatatcttcgtttgccataacaaggatcactgaatcaaaccacttagcatagtgtatttcgtataataaaggcacttctgcgacaaaaaacggatagttcccatcttgaatactttgatgatattgttcctcaataattcgacaaacttctggatgtagaatggcttccagaccttgtaatagaacggaattgtaaaaaactttggctgctatggcttgcgcatcaaacgccccatcaactacaacatccgatcctaaaagatctataacacgacgacctatgcgtgtatgagggataaggaaactatgcgaaatttcatcagcactaactacataggctcccaattcctgaaaaacttggcaagcttcagtcttcccagaagagagatcccctgtaatggaaacttttaataattttaacattctgcccaattttttccaattaagatattcacaactataggaacggataaagtcatagctgattccatcttctctctcactagtctttgcatctcttctatttcttcttcaggaacctcaaataataattcgtcatgtatttgtaataacatacgactcttcatttgctgttgctttattgcttgtgaaatatctagcattgcaagttttatcaattcagcagcacttccctgaatgcgagtatttacagcaaaacgtcctgaagctgctcttgagccaggaaattcattccaactatcgataattctttctcgacctaacatcgtggtcacccgtaaatctttagctgcttgttgtatagtttcttcaacaaaatgagcaatttcgggataacgagagaaatatgcttgaattaactcttggacttcgccaatagaaatttttaaaacttttgccaaaccaaaagcctgttgtccatacacgataccaaaatttactgtctttgcctgcattctttgttcttttgaaacctgttctaaaggcacatgaaacacttgtgatgcagtaaaagcatgaatatcttctcctgactcaaaagcaaattttaatgacttatcttggcttaaatgtgctaaaaatcttaactcaatttgagaataatcggcagataaaaaataactatttttctcagataaacgaaaagccttcctaagtaagattcctcgttccgatcttataggaatattttgtaaattaggatctcgacaagctaatcttcctgtcacagctcctgtctgatcaaaagaggggtgtattctctgtgtatgggaatctacttgtttcggtaatgcttttacatatgtggataataatttttcaatcgtccggaaagctaaaagtttttcgataattgggtgctcactacgtaaagcctctaacacctctgcacgtgtagattttgccttatctatagggcgaagacctaattcgttatataaaatatctgataactgttttggtgattttatattgaatggccttccagaaagatcatagatttcctctgtcagtacggctaattctgtttcaaagagggcttctaaaatagccaactcctcaacatctaaaggcactccagctctttccatagagaaaagaaccttctccaagggcatttcaatatcacttaagatatggttgagattcttacggttgatttcttctaaaatagcgtcttttattatgggaaggtaggcaacaaattcaccaaaatattgctcaggttgttctggtagacgacctataggcaatcctgaatttccccattccttagcaaaccggtgagcagtttctgtaaatccgtgatttactaaaagagattgaaaggagatttttcctcccccatttgtcaagtgctcagctaaagctaggtcataagaaatttctcgaattacaattcctgcatttagaagagcgtggcaatcgcgttttagattataaccatagaaagtaagatcttctcttaaaaagaaatcttttaatatagggagtatcttcgtgccttcctcttctaaggcaataaaaaatacccctgatccctgtgtcaaagctaaaccttcaagcttcaaagagagaagatggtttcctgtatatgctacagcaaaggcaatgtcccccccttgcacaaggtttaaaatgttggtgaggctttccgcatctttgattatctgaacatcgactgtcgcagcctctgtttgcttggacggcacaagagttttaaatccttgttgtatataaaagtgtatgagtttctcttcatccacagggtgttgtggaaaggtaagggactctattggtactgggatagggatattagaatccaagagggcaagccgtttactaagctttaaagtctcctgccgttcactcagcatagtttgacttaatcccttcacggcgtctaaattttctaaaagtccctcaacacttccaaattgtttaagaagtgctgcagcttttttaggcccacaacctgggagccctggaatgttatcagaagagtctccaactaacgctagataatcagggatattccctggaggaatcccataacgttctatcacctcagagatccctacaacaccttgatctgcccaaggattccaagctacaacatgatcgtttacaagctgcaacagatctttatccgcggtgcatacgtaaactttataattctcttctctagccttcttagcaatacttgcaatcacatcgtcagcttctaccgactctttttctaagtaagctaggcctattaaagagcagtactctttaactagagctatttgtggagggatgtcttcgaattttttctgtcgattacttttgtaatcagcataaatcgcctgacggctttgtttattattaggaccgtcaaagacggagatcatgtattctggagagaattctttgataagtttatttaaagaacgaataaatccaaaaactgcttgtgttgcttgtccttgatgatttttcatttctggcaaagcaaagtaggcacgaaagataaatcctgaggcatctaatacaaacagtttcttcattgcatattcccttctaggtctctctacagtgccaagtagggaggtatgtatgcagcgtcatgggataaaggcagaatatcgtgtttaatcatgccagtaactaatggacttgaagctgcagctgaagccacccgcttccaccaaccatcaccaccagagccaatcactctatagttatcttcaatcttacaaacagcaactatgtcttgaaggacttgttctttagttgcgcctacaacatcaatatagccttcttgtttggccttctctggagaaaaaatacgtgctccgagagtgtgaactaacttctctttagtaagcagaggacggttttgtgtaactatatcaacaaattgtccgtagagaaaatcaagagtcgcttgccgttcttctctatcatgagaagtccacggtgtataaggattcattggagccttatcttttccagctgtcagcagatcactttcaactccgtagcgatttaaaccttcttttacattgaagaatggtccagaacgcactccgatagaaccgataagagaggaggaggtggcataaattttagttgcagcgcaggatacataatagcctcccgaagcacaaagaccattcacataaatataaatagggaatcccttacgttctttccaaaagcgaagcatagagtaaattctatctatttcaaagacctcgcctcctgggcaatccatatcaatgacaatacctttgacacgatctttaagaggagctttctcaaatccttctaaaatattctgaatcgttttggccgtattttttgaagaagcaattacatctttcatttcgataacagcaataatgggggctgttttccctagatcttttacttctccttgggcgtcaggcaagctaacgaaggtagcatccccatttcctaaagaggaagctatgagtgcgaatataacgacaaaagcaagaacaactccgcaacacagtcctactatcgataaaaaggctttggatacgaagtgccacaacgttttcataacgacctataaattctagtaaattctaaaatggataaaataagggatgagcagaaaagcttaaagatgaaaattataaaattctcatgctcaccgagaataacacagagtttttctatcaacctacagaacagccatttcttcttgttctacagattcctgggcttcacgtacgattgaagaggaaggttctttaggttgtttcaaggttgctacagcatcagcagctctagagtagtattctttaccgatataggcaacaaccgcaatccaaacgaccataataatgagaagaactagggcgatgacgtttaaacttgctgcaacagaagagaaaataacaagcagcccttggtaaattaaagagcctccagactttcctatccttgaaacgacaccatcaatcgcggctttcccatgatttttatcctctggagaaagtgggataaaggccatttccttggtttgatcaaagaacgtaaatttcgtcccccgggataggacattttgcatccctccagtccaggcagctagagccagaggtgtcattccaagaactcccccaaaaatagagatgtctctttttgcagcaaaaatagttccgaaaaagagcagtcctgaaactaacattaccaatggagtgactaaagcaccgacagtccatccccatttacggatacactgtccggtaaggagtacagctgctaatacagaaacgacgccaatgagggtagtgattctactcatatacccattgaattctacgtgagaactgtaaatctggctaacttgatccttccaaacgacttcgaatagatggatcaccaaattataggataggacaataatagcgagccctaataaataacgagactgaatgaggtgtaagaaaaggtttctagctttggctttaggttttttcttttcctttagattagcagtagctgctccctcttctgccaagacacgtctagatggagggatcgaagtatcaatagtcaaatgatgaatccgcctatatagccagatcataattaaaccagaacaagtgatcagcatggtcaagttgagcattacagagtgccaggaatcacatgcaaaggagtaggcaacaaatgtttgtttccccatccaataggagatttctcctgcgcatattgaggagagatttaatcctgtattgataagagcgtaaaaacggcccgcttcagtaattgtagtaatctgattggctagtccccagaacaacatcgaaagaacaaccgaactccacagctctgacattacgtaataaatactgtaactccagtaacggaccatcacaataaaaccacgaagtccttgaggaaggagctcttgtaatttatcagcgagagagttgagatgcaggctatcccctacaggataaatgatcacagcaaacaggaagaaaaaaccaaggaatgcggccatgaagcaataaaaaacggtatcccgaggataccgactgcctaaccacccatagaccatagtaacaataacagctcccgggacaattccccaaaccttaaggaagggaatcacttctgccccagcatctgaaccgacaatgaccagagtatctttcatgtttttcagcaggcagtagttaaagccaacgaaaaacgctagtagaaatagtggaacaaacttagaaaattctgatttataaataggacaaagatatgcccgcagccttgaaaagggtttcacttctgatgactgcataaactccttcccaactttatggcgtataaagacttatagacatttagtttacacccagaagacatcgcatgcttatagctcctataatactggttacttagcaaacggcaaggcataaattaacgatcacgataaaaagagactccattttactgcaacgcgccgtaaagttcaagcggttcgtggataaacttataatccttgctcacaatactttttctttccgggttagcggagaaactgttttttataatccataattctctcgaggaaatatagaaaaccgagagccacgagggggactagtccggtccaaggaatttcaccccctgccgtgacccctagtaaaataataaattgaactactgtaaagatcttgccccaaaataaagagccataatcatagcctttccaacctttaactaaagaaaggtagaacacaaaggtnataaggaataagtctcgagcgcaaatgaaaaagaggtgtgctattgataaggatccttccatatagaggaccgtgatacaaacgaacacaaagactttatctgtaatagggtctaggattgaaccgagacgacttgtcgctttatagcgtcgagcaagatagccatctaagacatcgcttagcatagctccaacaatagcaagtaagcggatatgcaatttttcttggcagaagtatagcgctagccacaaacgtgatagagaaagtaggttgcaaaattgtctcataattttggctaactagtacgatccttttaggaaccttataattcggccccattatagagcatgctaaatctacaaacaagcatagagttcgctcaaacggtttctcatcttgcaactgttcggctctacattgacatatattaggctttctttaaaaagaatacgaaaaagggtgcgaactacaactagcttgcgttancaaggtagaggttattcggaaagagagggattcgaaccctcggtaccctttaggggtacgcgtccttagcagggacgtactttcgaccactcagtcatctttccttatttattcatcacagcctaacaatgaattttgatctcactgttattgttaggataggttaactatcaaaatgaaaaatgtcaacttgtgcaaacctgacaagaaaaaaggaaggcaatctcttaaaattcacctctgaactccctatagatttggaaacttgcaataaaaggttctgagcagttcctcgaaaatctctctgagcaactagcacttgagggatatatgctagataacataacctatctagaagtatcctaaaccctcacgaattacgaaagttcgcttctaatggacaaatctactggtgtacctctcccctctcctcctcattcgaaagaatcggaaatgatagttttaggttgcatgctgacaggggtacattatctaaatcttgcagccaaccaactctacgaagaagatttttattaccttgaacataaaattatttttcgagtcctccaagaatgccttcaagcaagataaacctatcgatgttcacttagctggagaaagaactcaaacgggcacaaccagattactgtaattgggggcccttcgtatctaaattactttagccgaatttgcaggtaccgnagcctatcttgaagaatacgtagacatcatccgatcgaagtcgattctaaggaagatgatttctacagcaaaagaaatcgaaaaaagagctttagagcagccgaaaaatgttgccgaagccttagatgaagctcagaattctttttttaaaatcagccaatcaacatcggtaagtcagtacactttagttgctgacaaattacgcgggttaacaacaactacagataagccttaccttgtacaattacaagagagacaagaattatttttacagaatgctcaaggagacaataagtctttcttcactggcattcccacacactttattgatttagaccagctgattcacggattttctccttcaaatttgatgatcttagctgcccgccctgccatggggaaaacagcactcgctttgaatattgcagagaatctttgttttcaaaaccgcctccccattggaattttttctttagagatgacagtggatcagctgattcatcgtatgatttgctctcgatccgaagttgactctaaaaaaatctctataggcgacctttccggtcatgactttcaaagaattgtttcggtaatcaatgaaatgcaggaacacactttgctcattgatgatcagccagggttaaaagtttctgatctacgagctcgggctcgtagaatgaaggaaagctatgatattcaatttctcattattgattatttacaattactttccggctcagggactttgcgtgctacagaaagtcgtcaaacagaaatttcagagatttcccgaatgttgaagactcttgcccgtgagttaaacattccgattctttgtctttcacagctttctcgaaaagttgaggatcgggcaaatcatcgtccgatgatgagtgatcttcgggaaagtggaagtattgagcaagattcggatttagtgatgttcttacttcgtagagaatattatgatcccaatgataagcctggcactgcagaacttattatagcaaaaaaccgtcatggttctataggttctgtccctctagtttttgaaaaagaactcgcacgttttcgcaattattcggcttttgaatgtatcagctagttgattcgcaatgcgaatcagagtcaagtagattggacaatccgatttgtcttaaaacccaagaatcagtatagttgtttggtcggctgaggatagcaccatatttgcaaagaaatagcgtctgcatcctattgaaccagagttccgccggaaaaattcaaacttcggtttgaatatgaagaatcttcgtcacttatgacgaaggggatgtcaaatcgatacgttaaccataaagatattatgtcatctgttaagaagaaacgaagactcaagatcgccaagcacaagcgtaaaaaaagacgtcgtagagatcgtcataaaaacaagtagtttttagtaacttatgtggactcacccaattgcttatgatgtgattgtagtgggagctggacatgcaggttgtgaggcagcatattgctctgcaaagatgggtgtctccgttcttatgctcacctccaatttggatactattgccaagttgagttgcaatcctgctgtcggtggtatcggcaaagggcacattgttcgagagatcgatgcccttggtggtattatggcggaagtgacagatcaatctggcatacaatttcgcattctgaaccaaaccaagggacctgctgtccgagcaccacgagctcaagtagataagcaactttatcatattcatatgaaacgtcttttggagaatactccgggccttcatattatgcaggccactgtagagtctctattagataaagaaggtgtgatttctggagtcactactaaagaaggctggatgttctcaggaaagactgtagttctttcttcgggaacttttatgcgcggcctaattcatattggggaccgtaatttctctggaggacgtttaggcgacccttcatcacaaggtttatcggaagatcttaaaaaacgtggttttcctataagcagattgaaaactgggacccctccccgtttactagcctcttctataaatttttcctgcatggaagagcaacccggagatttaggtgtgggttttgtacacagaaccgagccttttcagcctcctttaccacaactttcttgtttcattacccacaccatggaaaaaactaaggcaatcatttcagcaaacttacatcgttcggcactttatgggggctgcattgaaggggtaggtcctcgctattgtccttctatagaagataaaattgtaaagttctcggacaaagaacgtcaccacgtctttctagagccagaagggctgcatacccaagagatctatgctaatgggttatctacttctatgccttttgatgtacaatacgatatgatccgttctgtactggggttagaaaatgcaattatcactcgaccagcttatgctatagaatatgattatattcacggcaatgtgatccaccccacactggagagtaaacttattgaagggctcttcttatgtgggcagattaatggcaccacaggttatgaagaagccgcagcccaagggttaattgccggcattaacgctgtgaacaaggttttcaacaggcctccttttattccttcacgccaagaatcttacatcggcgtcatgctagacgatctcaccacacagattttggatgaaccttaccgcatgtttacaggaagagcagaacaccggctcttattaagacaagataatgcgtgtgctcgactatcgcactatggttatgaattagggttactctcagaggaacgttacgaacttgtcaaaaagcaaaaccagctattagaagaagaaaaggttcgcctccaaaagacatttaggcagtacggccagtctgtagtctctttagcaaaagcactatctcgtcctgaagtttcttatgacatgcttagagaagcattcccaaatgatatccgtgatttaggagcggttctcaatgcctccttagaaatggaaatcaaatattctggatatatagatcgccagaaaattctgattcagagtttagaaaaagccgagagtttactaattccagaagacttagattataagcagataacagccttaagcttagaagctcaagagaaattagcgaaatttacacctcgaactcttggttctgcatcgagaatatcgggcatagcttctgctgacattcaagttttgatgatagctttaaaaaaacatgcccaccactaactgtattttcctagatttacggggacactctattcttcaccaactgcaaattgaagaggctttactaagagtcgcgaatcaaaatttttgcattataaattcaggtgccaaagactctatagttttaggaatttctcgaaacttgaatcaagacgttcatatttctagagcacaagcagaccatattcctatcatacgccgctatagtggaggggggacggtattcatagattccaataccttgatggtatcttggattatgaacagttcagaagcttctgcccaacctcaggaattattagcatggacttatggcatctatagtccactacttcctaataccttttctattcgagaaaacgactatgttcttggtcataagaaaataggaggtaatgcacaatatattcaaagacatcgctgggtacatcacacgacatttctgtgggatatcgacctagataagttgtcctactacctgccaattcctcaacaacaacctacctaccgtaatcaacgctctcacgaagaatttttgactacgttacgtccttggttcccctctcgcgatgacttcttggaaaggatcaaggcatctggtagtttgttgttttacctgggaagaatttcttgataatgagctagaagaaattcttgctcaacctcatcgtaaagcaactacagtactaaactaaacgagaggtttcgaagcgttaacaacttctatcttactgaagaagtaagcgatttcgacagcagcattttctaaagtatcagatccatgaacagcattcacgcctatagattccccaaacttagctcgaatggttcctgaagcagcttctgcaggatttgtagctcccataagttcacgatttcgggaaacggcatttgccccttccaatactaaaactacaacagggcctgagaccataaaatcaacaagttcttggaaaaaaggacgctctctatgcacaaaataaaacccttcggcttcagtttgggataggtgcatcattttcatagcagctatacgtaatccagattgttcaaaaatagataagatctctccgatatgggctttgctaacagaatctggtttaataatggatagcgtttgttccatggtgtatacatatctcctttaaataaaatcgttttattttaggaggagtatagcatgatctttaggaaagtctagtccttgttcactcctgaaaaattctttttcagagcgataggaaggatatctgttaaagaagatccctcagggagatctttgattgcttcggcaatcatacgttcagcagcaatttttgaataacccaaagctgctaaagcctgaatgccttcctccaagcaagaagaggtggtatgtgtttggctggtctccactctcgagtctagaggaagtaaatctggtaatttttgtttaagctcaaccatgagtttttcagcagtttttttcccaattcccgatacggaagctaaagcacgaatatcttcagatcggactacagaacatagtacctttaaaggtagcgcattaagaatcgcgagggctagcttaggtcctattccagaaaaagaaattaaaatacggaaacactctcgctcttctcgagaatgaaacccatagagcaagtgttccgtttcacggaatatcacatgagtgaagacgagaaagtcttgatgtaaagccctgatgcattctattgcccaacgttctgtaatagcaatatggtagccaataccttggcattctataacaattgcaccagtatgcacataggtcagtgttccacgaatatagtcgtacatcttatctcactccacaaagagggctacgcgctacatgagtatgacatatagcaagtgcaaaggcatcagcaatatcttcattcgaagggtgcaaaacttcgggaacatttagaatcttgcttaccatcacctggacctgtcttttacttgcatgacccttaccgactactgctttcttagcaacatttggggcatattcaaaaatgaggatatcacgctgagctgcagccaataaaacgattcctcgtgccatagctaatttcatagtactttgaggattcttatttacaaattgcgtttctaggaccatagcattaggttgcgtatcatctaatactcctgagagttgctcaaacaaagtcttatagcgcataggcagtggcatgtcggaagataaacgaatggcaccataactataaggacgtaattgatagcgctgttccactgcaatgatggcatatcctgcgactatcgttcctggatccacacctataatcagttctgacacaatcgattcctgaaatactttgaacttattgtctttaaaagatgatcctaacctagataatcacttctcaagtagtgaattctcggtttctagaaaaaaatttcctgctatttaaaacagtcctgtttactacgtaggaatcttaactccctaaagatttagattctgagaatactacgtctacttcactctcaggttctttgcctaaaagtcctttcaaatgatctaactttgtatttgaaggcatagccatacctttctctttatgtagatctcgaagctgacaatattgatcctcaacaatatcttggagtaaggctatggctttctttttttcagctagatcggtttgcacctctgttaacttctcaatagaacaaacctcagagctagtttgagctccttcttgtcgctgtaatttttctcttaacttagcaatctctgaatgatatgtttttatataaatatctttttcttgttgcaaatctataagacttttcttcaaacggttgatctctgcatatgcggctgaagatttgtcttcttctatctctatagagggggctccgtgttgcgaaacataacgctgtagttgttcttccagctgtttaattttatgctcatagcataaacgacgcccttcactaatttctgttcgctgtacactttgaagcagttctttttttatctcgtcgataatatcactttggtgtcgaatttgttgtaatttctcagcaaggcgattttgcaaccaggtattttcttgttgtaacttttctaaatcttgatttttagcttcttcacgacggcgatattcttcttccaaagcagatagctgttcccgatactgtaagtgaatacgttcatgctcctgatgacaagagtcttgggtttccttctgcaaagaaaccaactttccactcattctgctacagactcctgaaagaatattgcaaatctgctgccattccataatatcagcatctttccagcgacaaagcaaatgaagcatggaacgggagcatgaatgataatagtgaggggataatgaactggaagatcgtagcgagaagagatgcagcttaagtatagataagagccgcacagagtacctctaaaattaacctaatcattcatcgtatagcatacgactgagttcttgtcctaattcgtcataagtgacttttaaaaagacaggcaacttatttggataactctacagattaaaaaacttagaaaattgctcagaacaagactcgaacttgcacgggcctacgcccaagggattttaagtccctagtgtctaccattccaccatctgagcacgaaaagacagtctgttcagagaagccttcaattaaaaggcgtgttctttaaagatgatctttttccataaggatagaaaactaaagaacatcttatcacagttttttttctagatcaatgatttttcaaaaaagggaaaggtatgccttaagttaaagtgaacttaaaccatacctttaaaaatagctattcttcttctgtagcagaagatgtttcggggaagaacattgcagaagactcttcaaaagaagctgaggtaggttcctcttctgtctcaggaaaatgtatagcatcatctgccgatagcaaagcattgatgagatcgctgctctcacgaaccaaagcttgtaacgactcgttaagatccgcagaagtaactactggatctacaacagtttgagagataacttcggagatcaactttgctgggggtggaagtaaagaaaacttcttctgttcaacaatctcattttcttgagattcttcccaaagctcttccttaacagtatccaagatttcttgagatgctccagttacttcagcaatctctttatgatttctacgacggctgagctttttcttttccttccacttctcccctttaaaggaatctttccttgcctctttcttttcctttttactaggagatgtaggctcggttccttcctctgggctatcagctagaggcttctcatcaatcacaggaagcggagtcgatttggtcaacttgattagagcttctctaccaccagcaattttcactccacgatctaaaccgacagctttcaaattgattttagtatcacggacttccataacctcatagtctccggcagggactaaaaaaggtttactatgatcacagttacggaaaaaacaaatatttcctaaagagatcacttctatagcttcaaccataaaaggatcttgtgaaaaatgctttgtattccttaccgacaacttatacccctctcgagaggtaattacagtttctatgacggggtctcttgtaaaatacacgtaattataaccttttcatttagagtttttttctacatactctaataagtctactatacgcgtggcatatcctgtttcgttatcataccacgcaactaacttgaagaaccgatcattcaaagcgataccagctagagcatcgaatatcgaggagtactcagatcctataaaatctgaagaaactacctgctcatctgtataatctaaaatgccttttaaatcagtttctgaagcctgtttcatagctttgcaaatgtcatcgtatgtcgtagacttatctaacctgacggtcaagtcaactacagacacgtcttcgataggaacccgaaaagccattcctgttaattttccctttaactcgggaagacatagagttacagcttttgcagctccggttgaggcgggaataatattttgtaaacatccacgacctcctctccaatctttcttagaaggtccgtcaacaactagttgagtagcagtagcagcatgaactgttgtcatcaaaccttctgtaattccgaaattatctagtaaaactttagcaataggagctaaacaattcgtagtgcaagaagcattcgatataacaaagtctttttctggattgaaagtcttatggttcactcccataacgaaagtaggaatatcaccttttccaggagcagagattaagactcgtttcgctccagcttgaatatgcttctcagcatcttctttttttgtgaacaatcctgtacattcaataacgagatcaacccctaaatctttccaaggaagattttgaacattgcgttcagataaaaattgaatttttctcttcccaacgatgaggtggtccgcttcacaacgtacatcctcaggaaaacgtccatgtgtagagtcgaatttaaatagataggtaagcgcatccccaggaacaagatcattaatggcgaggacttctactgaagagtttctctttaagatttgtctaaaaactaaacgaccaattcgcccgaaaccattaattacaactttcatcgcttaccctcagagttcaataaattggaaattgattagctttagctagctaaaaactctataatacacttttgagcattatcaccaagttctattttgcagttttagaatacgtgtgtaaccaccttttctttctacaaaacgattccccaactcatcgaataacttattcacaaccaaacgatcgacattatatacagaggtgtctccacctttagcttgtcgagcttctttgcttgttaatttattgtatctgaccataagccgtccaatagctatacgtcgtgctgctaaggagttttttttagctaaggtaatcattttatcagcatgtcggcgtagttctttagctttaggcaaagtagtctcaattctttcataatgaattagagactttaacatgttagctaacatacagcgattatgcgaggaagtacgaccaactctaaatttttttctagcgtgttgcattacttactatccctttatatttttagcccgaatcttttcggcataccacttcattttttcttttacgttatctaaacctacgccaaattgcgttaggtccattcctaattcaagcttcatttctttcaatttattcttgatctcacacagtgatttctttccaaaatttctgaattgtagcaatcgaggttcaggcataataacaagttcgccaatagtctcaatatttgcattagacaaacaatttgttgatctgactgagagttctatttcattaattcctaaaattaacttatgaagaatatcatctttgttttctttctcaatagaaatagcttcttcaaatacgattttcttctcatccatattttcaaaaatggaaaaatgtttagtcaaaatttgagttgaaaaagccagagcttctttcggagtcactcttccatctgtttcaactattaaaactaaacggtcaaaatctgtatcctgacccacccgtgtatcttctacaaagtagttgactaaagtgactggagaaaaggctgcatccaaaacgatttcataaacacccttatcttccaaaacaatcctttcagaaggtgtatatcccctaccaaaagcaattcgtagatcgacttccaactgtatgggttgagtaacagtaaaaatgacttgatctgggttaacggcttcaaagtccccttcttgcaatagatcttgtagagtcacttctttttgtccattagctgcggctaaatcggaagcatctatagaaattgaagcttttaagacctgagtggttcttcctaaagaactatcctgcatggggtacttttttaatagggcaccttttaaattcagaatgatgttagttacatcctcaataaccccttcgattgccatatattcatgaagtacgcctgtcatagcaaacgagattaaatacctggagcttctaaaccaataagcaaagcacgtcttagagcatttcctaaagtgtggcccattcctctttctagaggctcagcaatgaagcgagcatgtttgtctattggaagcccttcaacaggcaacattttaactgcttcaggcagttcaaacttatcataaagtaaattgtgtgcgttatctgacatccctttctccttccctaaaactacactctgcgcctttttcttggccggcaaccattatgaggaacaggagtttcatcacggattacagaaactaccaaaccagcagatatcaaagcacgaacagcagactctctcccagctccagtacccttcaaacaaacctntanttcctttaaaccagagttcatggcagttttagcagcgtcttgagctgctacagtggcagcaaaggctgaagattttnttgaaccagaatatcctactttacctgctgatgcccaagaaatcacattaccagcaggatctgttatagatactattgtattgttaaaggttgctttaacatgcacaacacctgaaggaatattttttagttgttttctttttacgctcttttttgcctgcgcttgatttttaaccaaaacacgactcctaattaaaaattatttcttcttacctgcgactgtttttcttttaccttttcgagtacgagaattagtttttgtacgttgtcctcttactggtaaagaaagtctatgtctctgacctcgataagaatggatggcgatcaatcttttgatatccgattgaacacgacgtcgcaaatccccttctacggtatattctgattgtagcagagagttcagtcgtcctacttcttcttcagttaattcagaggctcttgcctcaggatctaacttcaactttttaatgatttcatcagaacgagctgatcctattccataaatatatgtcagacttatttttaactttttctttgcaggaatatcaattccaatgatgcgtggcatacgttgggcctcccttaaaatagtataagcatcttaggtcaaaaattgttatttttcaatgtcttcctttcgtccgatctgttttcagcacgctatcgtagcgacgcattaacaaaaaggcatcaacctgcttcattgtatctaaaacgacccctacgacgataagcattgcagtaccgcctaagaaatagcttacattagaatccacacgaagcagacaacctaaaagtgaaggtaatatcgcgatcgccgctaagaacaacgctcctaaaagggtcacacgattcattgtatactctaagtaatgttgcgtaggcttgccctgacgtatgccaggaataaaggcattattttttttcatttcagaagcaatttgttctggatgaaattgtgtggctgtccaaaagtatgtaaaaaatataatgagcaacacataacatatagaataaactaaactgcctggagcaagtaaagctgctatacgcttcatccaagaagactctgacgcaataaactgtcctatagttgctgggaacatcagtagcgaggaagcaaaaatcacaggaatgacgccagcatagttaacttttaaaggaagataggaccctccaccggggacttctcttcttccaattacccttcgagcatattgcacagggatttttctcactccctcgataatcaaaatcgtagtaatcagaacaaaaacaaaaacaagagcaaggattaaaattgaaattagacccaaatcagaggagtcttgagatcctaaatttaacttattaacaatagatcccaatacagaaggaaatgaggatagaattccaagggcgataattaaacttatcccgttcccaatccccttatcggagatctgttcaccgatccacatcaataagagagttcctgtagtcatgactacaactgtagtgatataaaaaatccaggggactccaaatagttttgaagataataaagtgggcagaacaatccccggaatagttagattcattctaagagcaaacttagcaaataagagagactgtattacagctaaagcaacggtaaacaaacgtgtgagtctaccaatcctacgtttcccttgatcagaagactccctcatttctctttgcagcgcaggcataaagactaggaacagctgaacgataattgaggctgaaatgtaaggaaccacacccagcgcaattacggtcatttgggcaaaagcgcctccagaaaaaatatcagctagttgaaataaattctgacctgatcccaataactgcttgaagtaagctacagctaattcaccattaattcctggaacaggaataaatacacccactctacaggccgtaagcaaagcaaaagtatagaataacttttgtcgtaattcggtaatcagaaaaaattgtctcaatgtggtcatatacggcctaaacaatcttattttttaagtaatgcctagcaaattttgtactccttgcgataggactacagcagtatcttgccatacaaaagtcttttccaaatctcctttgagaatgactttgactcgtacagcttgtctcgcaatggctttctttgcttttaatgcatctaaagtaattgcttctccttcttggaaaagctcggctaaacgtcctgtagtaatttcttcaacgcatttatcaaaacgtttatgagaaaaccctcttgtaggaactcttctatataaaggaactcctcccccttcatagccaaaacgacgtttgtatcccgaacggctaccgtctcctttatgaccacgaccactggttttcccatgaccggaagaaggaccacgacctaataatttttttcttcgtttacgttcagaaatatcaaataatgattctaacttaatcatttatagccgctcctcttcttaacaaatccttacgtgggctgagtcctgtaagagctttaaacgccgctttcacttggttcatagggttattagatccgaaacttttagctacaatatctttaataccagccatttctaggatcaaacgaatacgagaaccggcaacaattccagttccaggttttgctggttttaacagcaactgtgctccatcgtgatggacaagaacttcatgaggaatagaaccatcttctaaagcttctatcttcattaaattcttttttgcagcttcaccacctttacgaatggcatctgtgagttcattggctttagcaaaaccatagcccaaacgacccttgccatctcctactaaaattaaagcagaaaaactgaactttcgtcctcccttaacaactttggagcaacggttaacaacaagaactttctcttctaattgatcttctttatgagaattctttgatagcgacatctcttcctaaaccttcattaaaactgtaaaccaccctctctagccccatcagctaccatagaaacaattccgtgatatttgaaaggaccgcgatcgaaaacaactcgatcaagttgaaggttttttcccaattcagcaatttgagttcctaatactttagcaacttcttggttttttttagtcagaccttgactcttatttaattttgatagagtggaaacgggaagccaacgtcttgccgatagaatcgtctatcaactgtacataaatatgtttatttgttttcactacggacaaacgaggctttgtaggggaacctttaatactttacgcactcgcaaagctcttcgtcttttcattaatgactttttacataacgaactttccataaccctcgacctattttttgcctgttttcgcagctttaccagctttacgacggacatattcattttcataacgaattcccttacctttataaggttcaggaggacgtttggcgcgaatacttgcagcaaattcaccaaccaactgcttatcaagccctttcactgaaatcagagtatttttttcaactgatacctgaagagtagatgggataggaaatttttgtagggtgagaaaccccaatggagagatccaaaaatgcaccttgaacagaggctctgaaacccactccaatcatttctaaacgtttttcaaatcctaaatggacaccttgaaccatatttgaaatgagcgcccaatataacccctgcatacagctaggtctatcgacaacatggggagctgcgtgtacaaatatactgttatcttttaaggtgatttctacttctttgaccgatttctgtgttaaggaccctttaggaccttttacaataattttatcatcttgaatcgaaacttctactccttgaggaagtagaataggttctcgagccttacgagacatgctttaccgttcctatacttaatcctgttaccacaccaaacagagcaattcgcccccaatattcttagatctggctagagaaccttccataactccctgagaagtggagaggactgaaattcccatatttccaaagacgtaagggattttcgcagccgatacatagactcttcgagagggttttgatacccgtttcagttggtgtattactggtttacgatcatcggaatattgtaaaaacacacgcatagcgcgtttgcngtttncttcctntactaaataatgagccacaaaacctttatgcttgaggatttttacaatagcctctcgcattttactgtgctctacgtctacatacagatgttctgccatcaaagcgttacgaattcgcgttaacaaatctgctatagaatcacttgtcatgcccatatagatccttttcctctttattgagctttcttaaatcgtaagcccatcaactctaatagagtggtgcactcatcatctgtttgcgcggtagttacccatgtgatattcaatccctgggtgcgcttcacacgatctaaattaatttctgggaaaatttgttgatcgtctaatcctacagaatagcaaccccttccgtctcctttattagaaaatccgcggaagtcgcgaatccgtggagaaacaatattacagaaacgatccataaaatcgtacatacgaattccacgaagggtaacttttgcaccgattccttgaccttctcgtaatttaaaaccggcaatagaatttcgagcttttgttactaacggtttttgcccagagatcatggtcaattcttctaagtgggcttggaataaatttttatctttagcggcttcagcaagtcccatacttaagacaatttttttaagaacagggatctgcattttatttgcatagccaaacttttcaaacaaagatttgcgaatttcttcagtatagaatttttttaatctactcatattagcctttctttcccctcactagacgatacagctgggatgttccgtcagggcgtctttgccacaactcccgcccctgttcagtcactttgacagagagtttggcaggttcaccagctatggttaaacgtacattagaaatatggataggagcctctatactaatccgtttacctttaggattttgttgactacgttttatattttttatgcgaacgtttacaccttcgacaactactttatcttcagtaagagaaaggacttttccttcttttcctttatcattaccagctaatataaataccttatcaccaacacgaatgttttgctttttcataacttccttctccttaaattacctcaggagctaaagaactaatttttataaaacctctatctcgaatttctcgagctacggggccaaaaatccttgttcctttaggatttcctttatcatcgataattacacagctatttgtatcaaattttaaagtagacccatcttttcttgtaatatgccgacgtgtgcgcacgatcacagctttgataacgtctccctttttttatagaactattaggttcgacatctctaactgagcatacaatgacatctccgacagtagcataacgtctacgagaacctccaagaaccttgaagcattttacttttttagctccagtattatcggcaacttttaactgactttcttgctgaatcataatctctatctacctaatgttgctaacttaccacgccaacatgttctataacgcgccatcttttaagcttagacaaaggtcgtgtttcttgaattttaactttatccccttcagaaacttttagttcagtgtgagcgtaatatttctttgaacttctcactactttaagatactgaggatgagaaaatatcctttctactcgaacaacgacagttttttccatttttgccgagacaacaacaccaatcttaacttttctagagcctcttggttcactagccatggactttaccttttctttcttgttttactgttagagctcgagcaatatttttcttatgcgtagaaaacatatgaactttcacaactttgttttgcagtaaattttctgctcttaaagcaaacaaagcctttttgttttcatgaacatacgcatctaaatcgtcgtcgcttttgccccttaactgggtcaataaatccttttttagcagccatgtttataccctttccactcgcttaacaaaacgtgtttttattcctagtttggcagcagctcttcggagggcatcttgagcatcttctttagagacattcgctacttcaaacaatatacgtcctggacgaactactgctacccaatgatctggggcccctttacctttacccatacgagtttctgcaggcttttttgttacacttttgtctggaaaaatacgaatccatacttttcctcgacgttttaaatatctattaatcgcaaccctgcaggcttcaattttacgactggtgaccaagccacgctcaagagtttgcattgcatattctccgaagtctacaaatgtagctcccttacttaatcctgcaaactgtcctntttgttgcttacgaaattttgttcgtttaggcattaacataataattcactcatccttatttacaactttaagcagctgcagagggtgctgccggattgttaggagttgtagaagaggagttctctccaagattaatccaaacttttataccgataattccgtaggtagtttccgcacaagctgtagcataatcaatgtcagctcttagcgtatgaagcggcacacggccatttttataccattcagaacgagcaatctcggctcctgctaacctgcctgaaacttgaatttttacaccaacagctccagcatccattactgattgcattgcctttttcatagcccgtctaaaagagactcgacgttcaatttgtcttgcaatgttatcagctactaattttgcatttagttcgggacgtttaatttccgcgatttctaaccagacttcttttccggtaagagctctgagctcttctttaagcagatcaacttcagcgcctttttttccaattaccaacccaggacgagcggtttggatggtcacttcaattttaccactcatacgacggacaacaaatccagcggcaccttgacatgaaggtttttttcttaaaaactgtcgaattcttacatcttctatgagaaatttaccaaattcttgtttatttccgtaccaaagagaacgccatttttttgtaacccctgtacgaaatccgattggacaacctttctgacccatgatccttcttcccttttaccgttccttctcaccaacaataacagtcaagtgactggtacgttttaaaatgggagagcgtcctcctctactttttgatttagatcgcttgtagacaggcccggcatctactcgaacttcggtaacgcttaaattttcacgctttatattttcatgcaattcagcattagctacagcgctatttaaaaccttttttaaacatcttccagctttcaactgagaaaatcccagctgttcctcagcctcttgcacacttagatttctcataagcccagcagctaatctagctttacgaggttgtacccgaatatatcgggcggtcgctttaaacatgctatgtctcctttagacttaccctttcttcacaggatggcttttaaatatccttgtgggagaaaattctcctaatttatgacccaccatagtttctgaaacaaatacggttaaaaatttcttcccgttgtgaacttcaaacgtatggccgatcatctcaggagtaatcattgaacgacgagaccatgttttgataggagtttttttctcctctatgttcattgcacgcactttttttaggaggtggtgatcaacaaacggaccttttcttaacgatctactcataatccttatttcctacgatctttaacaatccatttattacttttgttcttgtcacgtgtttttaatcccttcgtaacctttccccaaggtgtacgtggaatataaccattatggcgaccttctccaccaccgtggggatgatctacagggttcattgcagtaccacggactgtaggacgaactcccatccaacgtcttcttccagctttgccatctacacgtaggttgtgatcggcattggaaacttcaccaatggtagctctgcatccctcatttaacatacggaactctccagaaggcatctttaaagtaacgtatcctggagacttagctataacttgagcagctaatccagcagatcttacaagctttccacctgaagaaggacgcatttcaatattatgaactgacaatcctaaaggtatgctttttaaagtcatacaacatccaggcttaaatggacttccttcacctgaaacaacaacgtctcccctttggatgcctttaggggcgagaatgtaacgtttttctccgtcttcgtagcttaagagagcaatgtatgcagaacgattaggatcgtattctacagtaactactttcgcagtaatcccatctttattacgtttgaagtcaacgaccctatacaattgttttgctcctccgccacgatgacggcaggatatatggcctaaattatctcttccaccagaactcttcttaaagaaagagagctttttatttggtcgaagacttctttttgacttcgtaccgcgcaactcaccacgcgttgttaactcatcaaaagcgggaaggaccagctgtctagttcctggagttactggtttaaattttttaaacatgctgtttatctctctaataaattatccgacagagtgcccttgatagaaagttacaattgctttcttaaatcctgaggtttttcctttacggcgccctcgaaacatgcgggcgggttgaggttttacatttatggtgttcacactctttacttttacatttttatcaacgtaaattgcctctaaagcttgggcgattaatggctttgttgcatcatgagagactataaaaacaaatttagggtctttacaaaagcttccctttttctttccctctccagttccagcgcttaaatgctctaacattttagctttctctgttacgtagtgacgcttaattacatcataaggatctttcatatcctaaaattccttcttaatctttcgtttcagaaacaagacgctcaacaagttcctgcaaagcttttttagaaataacaatattatgagcagaagctaagtcatacccattgatattgattccatagacaaaacccttaactgcagtgaggttacgcaaacttaatcttaaattttcattcttctctacatgatctaagtgatcaataaagagaatgctacgacactcaacattgcaatcttttaaaaaccttaacgctgactgagttttaggagctgttaaagcatctacaaagaccgtatcgtcaactacagtcaatttgtttgtttgaattttttgcgccaacaaaagcctgattgcggcttttctttctttacggtttatacgtacgtgttgattaaatttaggcttaggcccaaaaacaatcccacccccacgaaactgaggagaagctaaacatccctgacgggaattacccgtacctttttgtttgaaaggtttttttgtagaatgactcacttcagaacgatttctagtgcatgcagaccactgtcttttattcgcgcgaatagcaacaatataatccttgatcaattgaaggccatcgccctcatctgcaaacaaagagtctgctacttcaacttcgcctattttatttcctgaaaaatcaagattttgataataaaaccattaggtcctctctgtatcacccctgtccgtatcctaagttctagaagaatgtttcactataacaatagagcctcgcgctccaggaatggcacctttaactaacagtacttttttttctaaatctacttttattacttctaaattttttacagtaacgttctctgcgcccatatgactaggacgcttacttccagggaaacaacgaccaggagtcgatcgcattcctatagaacctgcatgacgatgaaaccctgaaccatggcttcctggaccgccacgaaaaccaaatttcttcatgacaccttgaaaaccttttccttttgaaattccacgaacatcaactgaggaaacatcttcaaaaacttccaatccaaaagcatctcccaaagacaccccattaagagcctcttcagaacctcggacttctttaagaaaacgaaaaactcgaccaccagctttacgcaaatgtccgagtttaggcttactaacacgttttgtaattgtatgagcgggggcattcatttcttccgctcctatttgcaaggagaaatatccgtcgctttccttagttttgatctgggtaacaacgttaggctcaacgcgaattactgagcaagcaaccaaggatccatctttatcaaagatgtgaatcatcccttctttttttcccatcacactaatatgagaccgcataaacttatccattaacaataatgatttgctttcctcttggaggaacaaagaaacaaatctgcttagtattttacttatcgaattctctaaaaagaaaaggaaattttcccttaagaaaataaagggacaggttatcagagggggaagatttttacaataggaaaagtactctaggtactaagaactcaaagataaaagattcttggaaaattcctatttatagaaatagaaagtcgcttccaaaaaattttttagaagcgacttctttaaaataaagataaaactagcttatttgccagactttgttttctgccatatgctatataagccaattcctgcggatgctgccgtcaaggctccagaaattgcagcggagcaagccactgtaatcggtaaaggaatgagtttgactccatccactaccaactctaaagctttttcaagaagagttaaaacatttctttttagagtagcaacgtgttctttacgtaatgccctttccgcgcttagaatcacgtccccactcaactgagattgttggttttctaaggcacatctctcattgtatagggattccttcgcacgtttgaacagcttttgttctaatgcgattccgccaacagcaccagcaactcctgccatatgattaatggtcataattccagcaacagccgtgccaaaattgcctacagtcgctttgtctaagaatggttttgctgtgagtttattgattaacattaacggacgtaaaacaccgaatgtcgctgagtaagtcgttgcaccgactgccgtacaagcttccctggaagctgccaataggtaatcacctcgagttaatagcattttactatactccccaggcgtttttctttcttttgtcttgcttcctaactcgaaggcttgacgtgtgtattggtaacacctctgagtcgagttaacgatagatggaacagctccattgagcacattagctaaggcaacaacttctcgagttgtttttaacataccctgggcgtttctcgcggaggtcaatgcgtcccctgtgcatcccgcctcttccagcgatcctacgacacagtcagaaaccgccttacttagcttaaagcatttatctaaactttttgttgcccctacaaactttgctaacttattcccagggtttgtaaaaaaattgttgaatacaataaatccctttctgagcaaaggagctgacagccgctggttctttggcaactggcagcagcatcttacttgctgcacttcctgccgatctaattgcgttagtcgccatttttacctccttacaaggctttttaaaaaaaaattagagcctataataacataaaacgacttaatttagtttaaatgccctaaataaaaaacacgttgtaaagttaattatttaaagtaaaaactatttttaatttctttgctggatagccgtttaaaaaggattttgagttcgtagaacccttgccttctacctgcacttcgtgcaagcaaatggctccctcagaacaggcaatagcaagctcttgcctatctgttacaacaacagtcccgggggctccatatcttcccgcctctgctaaaagagaggccttacggatcatcaagcgttttggcgctttttcagaaaaagagaatagggtccacgctcctggagctggcgtgactcctcgtatatgagcataagcctctttagcaggtttatcccaaggaacctgtccttcttccttagacaattttggcgctattgtcgccaaagcagcgtcttgactgacgagttgcagttgacctgactcaatttgttgtaaagtttttattagaacttctgcgccctgcgatgcaagagcatccgccaattctcctgaagtcatatcaggacctatggggacacgcgtaatatttgccatgtcgcctgtatccatacctgcatccatacggatgacagtatttccagattctgtagctccttccataatacagcgttgtatgggagctgcgcctcggtaggctggcaagagccctgcatgcagattgtaacaaccataacgaggaatatcgaggactatctgacgaagaatcgctccataggcaaccacaataaaaacatcagcattaaaagcccgaagttcttcaataaattgggggtctgacgctttactaggttggagtaaaggtagaccgtgagttagagctatagtttttactggagaaggaatgagttgtgccgatcttttttggggcttatcaactcgggtaacaacagctgtaatttggattttgtgatgcaacaaatcttgcaaaacggtggctgcaaatgtgggtgtgccgaaatagacaaccttaagattcaatcaaaactccttctttgtctgcgctttcttcttcaagggcttgcttatctatgcttcgttcgatgccgcgcttacttgggctttgacaaaactcaatgaagttttttacttctggaatgtctccatattcttctagagtttcttctagagattcaaaaaaacatccgtcagcacgataaatctttttaaaagccttaatgagggctaatcgcgtagcaaaaggaacctgcctacgttgtagtcctactttattaataccagcgagttggtaagggtttccacttccaatggtatagggaggaacatcacgacgaatcccactgagggctcctaccatagcatgcgctccgatgcgaacaaactggtgcactccaaccatcccaccaagaatagcgtaatcaccgacttgaacatgtcctgcaagttgtgcatggttacttagaacgacattatttccaatagtacagttatgggcaacatgagcccagggcataatcaaacaattattcccgatagagactgttgtaccttcgaatgttgaagacgtgatgatagcgaactctcgaatttcgcaattttcaccaatagtcacataggttttttccccttgatactttaaatcttggggtttattaccgatcattgcagagggccatattgttgtccccttgcctatggttgtattgccatcgatatatgcgtaggacttaacaacaacgttgtcacaaagggttaccgtagcttttataacaacgtacggttcaataacaacatcctttccaattttagctcctggctcgataattgcagttgggtgaatgctcgccatgtttctccgtgattatatggattccttatctaccagagcaaagctcagctctgcttcagtgactagctgtgaatctacacgcgcctgtgcccaagctttacctcctttcgatgatattaaagaaaaatctgcttgcagggtaagtacatctccagggcgaacagcttgacgaaacttagctttctgtatccctaaaaataatgcgatacgcttattcctatcattttctagaactaagcctatcaatacaccagcagcttgggccaaagcttctaatatcaagactccaggcataataggcgcgttaggaaaatgccccataaaaaaaggctcatttattgtgacatttttttgtgccgtgatactgcgagcctcgatgtcataagataaaactttatccactaataaaaaaggatatctgtgggggagtaaatctaataattcgcgtaatttgatgacagagggttgattcatttattctttctttatagttctaatgcttccaaaatttttttaccaaaagcaatattggaggagtggccggagccgacagctaatacatgcgcaacaaaaggcctgccaactaaggaaagatctccaatcagatccagtattttatgtcgtactggttcatcggcaaatcttaattgtcctctactaataataccatcgtccttaaaaactacagcattatccaaacatccccctccaattagccccttttccattaagaaacatagctcattgtatagagcaaatgttctacaaggagcaatttcctggcgaaaagactcttcattaatcaccaaagatttgtattgagtccctattgttgaactttgaggataatgcaacgtataggaaatcttcagctcatcagagggaaaagctgctaaaaaaatgtcctgatgttgataatatacaggacgtgttagtctcgcaatggaaaccnatatcttcttgttcacaaatacctgcttgatcgattaactcaacaaagacatttgagcttccatcccctatggggatttcctctccactacattggataattagattatctatattgttagatcgcaatgctgccataagatgttcgacagtggcgattacagcactacccctagataatgttgtacttcttcctgtagtgtagacatgatctagtaaagcagggacattttcgtagttacctgaggcagactgtctttgaaaaacaatacctgtatttgtttgtgcaggttgcaaatggagagttgaggacttccctaagtgaattcccactccagaatagcgaacctctcgctttaacgttctttgagttcgttctaacatgtaaaaacctgacaacgagtctccgtatattatcgaatttcttttttagcaagcaagcgatatcctaagaatcctcctcctagataactgactgcacagaaagctatcaaaatcatagggtaatctccacaatacccataaagcgttttataattaaatagaggcaaagaggtttccaatacccctgagggggctttagtttctctagtatcataaggaagaattttgagtattcgacctagagaatccacagttgctgtaacaccagtttggcaagctcgcacgcaaggcatcccaaactcttgatttctcaacatcccatggaggaaatggactttagggagtcgtgattcaggataccatccgtcatttgttaagttaacaaggagttcggctccttgtctcttgtaggattgcaaccgatagccgaaagtttcttcgtagcaaatggtgatcccgatacgaggtaaacctcggacctgcacaactccagaacgtctacctggaagtctcttgcatcctagagcatatttaggaaatagttgtctacaaattagggatccgaatttccctcctggtatatattcgccaccaggcacaaggatacgcttatcgtatcctacggaaattcctttgtgtgatattacctcagcagagttataccaatacaaaacgttctcttttttcacccaccgttctaagccaataattactggacactgaaagtgttgtgacagagctgtggcacaatcactattcgatagaaatgccttaccttcgggaagtggagcaaaagaagacaataaatgtgcgcaggattcatagggatagacttgcctatgcttaccaaaaggcacgactacttctgggaaaatcagcaaatctatgggttgttgtattggggatacgagttggaggagttgttcccagacgactattggggacttaagtttcggtcgtatggggggatgcgcgggttgaacaacagcgacacgcagcgctctcttatcttgttgaaacgcgtgtttaagatactcataatgaattgctccaaaagtatagggcaaaagaagagtgagcacccataacattttagcatgaggttttttcagtagtagacaataaaagctcatatttacagctatgacagcgaagctctgacctgcccaccccaaaaatccgccaaactgccgtccataagcagaggctgtcataggccaaccaagataatcgaaggacatcccagaaaagatcccataaaatcgaagcatctcgatagcgacccatacgccaggaaggctccataaaaaagctgtgcgtttctgacgtacgattgcaactagaaggcaagaaaatcctgaaaatagaacggacaaaatcgtgattaatgtaagccataccaaatagatgagtttgcctatatattgatccgagagcatccaagaaaaatgaatcccctctattgtgaagatccagaaaaaacaggatacaaaaagagtccttagaggtaatgagggtttttttaagggttctagactataccaaaagaatccataaccacaggcggctcctaatatggaaacgaatccacttaaatctggttgagcaaaagctataaggcaccaagaaataacaaagcaaaagattcgtagcacaggctctccttatttcagttcaagccttgcttgacgtcgtcgatctgcttcattataccgacgtttttcttctggagtttctggaacaatctgatggacaggaatgggctggttgtcttcgttgacagcaacaaatgtaaagtatgcggaggtaatatgacgtcgttcctgcttataaatattttctgcccacactttaaccccgacttctagggaagtacgccatgttctgtttactgcagctttacaaatcagattttcccccatatatgcaggagcatagaagcggagggcatcaacaaaagcagtaacacagacggattctgtgtgtcgttctgcgaccactaaggctaaacgatcgagcaaactcattaataatcccccgaagacagtattattagcattaagatcattagggaaaattttataaatatgtccgtcaatacagctaaacgagacgggttttttcttaagcattgttgactctaccgaaaggatttttatagggtattcttggttgcgatagtatcggtcaactgaaagaaaatctatgattttctntcataagttactgaaatttttgattattttttagaaatcgaagtgcttacaattccataaagggattgttaacttgtgaaaatccggtccccttttgtctatgcttgatttcatgacggatagaaaaaagaaggtctgaatcgaaatccatttttgatgcccattgaagataggcaagaggaatttctgaaaaacatcgtcccttgtgtttccctaggggcatatatttcattttaataggttttgctaacacctgtttcagttgttctaacgttcggaaacgtttacaaagatgtttaaaaatattgatattaatttctacatccttcatggcacgatgattcccatcatagggaacattaaagtgtacggctaaggattctagagaattattaggactatctccatattcttttgctaatcggagggtatcaataatggtatactttgagaggaaggtctctccgattctttccatctcttgagcgagaacctgcaaatcaaaaccgacgctatgtcctacgatatagtcgccttctttaaaaaatgctttgatttgaggaaaaacttcggcgattttcggctgatctctcaacatagcgttggagatatggtggactctctgggactccgcagatacaacgcgttctggattgattaaaaattctatcgaactaattacactatcgaaagtaaagcgaacagcggcaatttcaataatacgatctttttttacatctagacctgtcatttcacaatctaggcaagtaaaaaccgtatcttttaataaactcataatttccttctacttcctctatctttgtttgatatccttctgactgtagaaggatttctgtgtttaactttatattttgcatctgtgcagagaatgccttgcgaacagaaaagggttccagggaacctatactattattacatcgcggctcactcttctttatgcctatcagtatgcaaggatactatggagaataaagactagcgcttctctataataatttctctttccatgtttgtttgcatggtaatgtagatatttattgtatcacaaaatcgtggcttaggcaagcgatccgcccattcaatacaaaggacatcgtcttcttctgcatcttgaaaaatgtattcctgatttttctgatcaatccggtaaagatcatagtggcacaaccgcttaggttcattaccataaacatgtaatatagagaacgagggactagcaacttcttccgcgatagtatctccgagatatccagagactatgccacgtacaaattctgtcttaccagccccataatcaccaaataagagcaatacagctcctggaacaaggacttgtcctaactcagttcctagtaatagggtttcttgagaagaatggcttactcttctgtatctacccattggctaatgtacacatgaaaggctgtatcgtctgctaaactttctataaatgctgcgatcttatcttctaccagcgcatcttgcaatagagaaaggaaggaactttccaattgaaacttagtttgattttgcacttcttccagggtcataggacgcaagtagctagagataaaatcctctaaaagagggggtaaactatggaacaatttacctgtaattgccgaagcaaacactgtttttataataggttcttttggtgggactgcgtattcttttatcacatcaggatcttctgatacgaggaaacgcttgattcgcaccccaccctgtttttccatattttgagggcaagaagacagccagtcataaattgcgtcttgagggtttgcatagacgttgtcagcaaagaccttaccggtaaatgggcaaatatagatacgcttcgtattttcgtttacctgtggcttttcagaagaaatttggatttctgtttctctccaaatctttttatcctgttcgagaatacggaccgcatcttcnnggagttttgaaaattatcttgtcgcgaacaaacaccacaggacgaaggcttagagcctgttccagatagaaaagatacgttgccaacaattctggttttttttgttttcccaaaaactgcaaaagtttctgtttgactgctccagaaatatccatgcctaccctttttcagctaatgacttaacgttcttaagcaaactccccataaaaggaatataaccacatatgggttgtcttacctcacgttaaatcagaaatactatcagagccgagaattatgttgaacataaaggtatcacaacaaggttcatccaaaaaaatctgctgtttttctttaaaaagtttcttaattgtgttttttattatctatagtctacaattttacgaaacgcagctatggcgaaatcggtagacgcgctagattcaggttctagtgagcttatgctcatggaagttcaagtcttcttagctgcaagaaaataacagggacagtaattcgatttttcgagaagggaaacttatggtaaagatcatatcaagtgaaaattttgactcttttattgcatcggggctcgttctcgttgatttctttgcagaatggtgtggcccctgtcggatgctcactcctatcttagaaaatcttgctgcggaacttcctcatgtcactattggaaaaatcaatatagatgagaacagcaagcctgcagaaacgtacgaagtcagctctattcctacgcttattctttttaaggatgggaacgaggtggctcgggtcgtaggtcttaaggataaagaattcctaaccaatcttatcaataagcacgcttaaaaagacgctgcaatattaaaccgtaggattcttttgcaatgctacggttttctgccttaccacttcatataaaacgatccctacactggtagctaaatttagagaacggatgtcttgttgcatgggaatgcgcaggcaatttttataatatttttttaagatctcttttggaagacctttggattcagatccaaagacgtaggtgcctgaagatggcaaggaaaattcagtataagatgctgaacctttggtacaaagacaaaaaatctgatcttcagggacatcatgtagtgcttcttctatagaatccactactgtcaattggagtttgtcccagtagtccatccctgcacgtttgacaaatttatcggctaaagaaaagcccaagggccgaaccaaaatgagttcggcgcctagggctacacaagttctacctatatttccagtattctgtggaatatcaggacaatgaagaactactctcattcaccttgatttccttcttggggtacagcagcaacttcatctgctgaagcctgaatcaagttaatttcaaaaattaataaagagtttggaggaagttgtcctgcggttccgtaagcaagatcaggatggatgtagagaactcgagtttctccttctttcatgccctgcatacctaaagcaaaaccaggaattgtttggcctagaggaagcaagataggctcattgttgccttctgaactgctaaatacttggccattgatgaaggaacccttgtagtgcaatagagctgaaggtttacctgaaattgctttccctgcaccttctttaataattttgtattgcaatttacttggttgcacttcaacaacaccagcgttcttgctattttcttttaagaatttttctgccaatgaaagattttcttttgattttttttcaaaaaccaacttctgtacttcagccattttttcttcatactctgtttctgttaaaggagcacttttacaaaccaattccgcctgcaaccccttagccacttctgcaatatcaaaaaacatatcttctgacttgcgtaattggcgtgctaataaatgaccaaatgttctggataacttttgattatcggataattctatgtcattggtatctttgttatctttatattccactaacgacccctgatccttgtctttatccttagaccgtacgtcacaagaagcgacggagagtgccagagctactgttgctaaaactaaattccaccgtctgttcattttccttctcctatctttgatcttaaggcaacgactatgctacatgcccgaagcaattacaacttatatcaaaaagctaccttaatacttagctcttttaattgggaagacataatttctgagggagcattcatcataagatccgatgctttctgtgttttaggaaacgcgatgacctcgcgaatgctctctgctgctgttaaaaccataaccaatcgatctaaccctaaggcaatccctagatgaggtggggttccaaaactcaaagctttgataaagaatccaaatttttcttggatgctctcaggacttatttttaaaatagtaaatatttgactttgcaagtctgggttatgaattctttgagatcccgaagcaatttcatatccatttaaaaccaagtcatagcttgacgaacgcactgctagaggatctgtttctaacagaggaatatcctcctccaaaggtgctgtaaacggatggtgttccgccacaatttttccatcttctaaagagaaaagagggaaatctgtaatccaaacaaagttatattgattgtcgctatacaattcgcgctcttttgcgatcaatctacgcagatgatcgagagactgattcgctactgattcaggagctgctatcaagagcaaaatatcctgatctttggcatcaaaataagcaaagagttcgtggaaaacctcttcatccataaatttagcaatattggaagcaactttcccctcttgatttttaatccagacaagccccatagccccataacgctttacaaactcggtataaccatcgagttgcttgcgggacatagtagccccacctggaacacaaaaacctttgatcgtacctccgtgagccaactgatctaagaaaatagagaatgaggaacgttttgcatagtctcgacaatcttttaatttaagatcgaatcttaaatctggtttatctgtaccataggaatccttagcttcttgataggtcattttagccaaaggcaaaggaatctctataccttgcgtagcaaacagtgttgcgaccaattgttctataatgggaagtaggtcctgggtatccccaaagctcatttcaatatctatttgagcaaattcaggttgacgatctgctcgcaaatcttcgtctctaaagcacgtggcgatttggaaataacgatccaagcctccaaccattaaaagctgcttaaaaagttgtggtgattgcggtagagcataaaattttccaggatagattctagagggaacaagataatctctagcaccttcaggagtggattttcctaatacaggggtcacgatttctgtgaatccttgagcatccataaagttgcggcaagcaagcatgacctgatgacgacaaagcaacttctcaataatatccccgcgacgcatatctagataacgatactctaaacgcagctcctcattcacattgatgtggtcatcggcaatggaaaaagggagattttgcgacttggatagcacttcaaagcttgcaacttcaacttcaatatgtcctgttgctaagttaggattttccattcctgcaagacgtggacatactttccctcgtacagaaagaacccattcagaacgcacagcatccaaacgttggtgcagttctggttgctcatcttcacggcacacaatttgagtaataccaaaacgatctcgcaaatntatgaagacaacacccccatgattacgataacggtgcacccatcctgccaattgaacattctcacctatatgattacttgtgagttcattacaacggtgtgttctgtatttcatataacaacctttgctctacttcttcttttgttccaaagaattctttacgcagagacatatttttaataactaactgttgagaaattaactctcgctcaccgattaagcaaacgaaagaaacctgttctgtactcgctgcttttagagctccttttacttttttatgagaccaatcgacttccgtagggattcctaaccgtcgcaaatgttgcgaccattccaaacaaaactgatccgcatctggttccattggaatcaaacgcagtttatgagggaactgtggctcaatacgcttttgagctaataacgtttgaatcgctctttcaaggccaacaccgaaaccacaggcaggaagagaagctcctccaaaagctgaaatcaagccgtcatagcgcccgcctccccctaaggcataagagacctcttggaatgtggtagtcgcttcaaagactaagtctgaataataatccaaaccacgcactaaacgaggattgatagcatatgggatttctaaaactctcaaagcgtctaaaatttcattaaaatacttaagatcttcatcagaaacatagtctagaatcgggggcgcttgacggataatttcttgatcttcaggctcctttgaatccaaaatacgcaaaacattcgttgaaaatctctgctggcttaatgccgataattctcccatggactctttcaaataagcgcgtagaaccttatcgtatcgaaatcttgtctcacttcctcctaagaaattgagttgaatttgcatatgttgcaaaccgacacgagagtagaaatcccaaagcaaagcgagaacttctgcatctcttagagggtgacgcacaccaatagcctcaacaccgaactgatggtgttgacgatatctacccgcttgctgacgttcgtagcgaaacatgggaagaatataatagaacttattatcacttcgatgagaggccccgtgttcaagaaaagaacggacaacagcggcagtcccttcgggacgcaaagtcatggaacgaccttttctatctaaaaacgaatagacttcttttttaacaacatcactttcttcccctacatgtaaaaacacttctgatttttcaaaaataggagtacgaatttcacaaaatccataaagcatgcaaacggtatgaattgccttctcaacactatgccaaagtgaagtgtgacgccacaattgtttagcatctgcaagataaggaaatatatcaaagacccctttggggagagttacagtcacgtgatgtcttcgctcaaaatgattacttttttagataatggaatatctggagcttagtgactcctgcctaagcctaagtcatattcacactcgaatctaccctctttttaatgaagggcatttcgcacgaccttgctagagataatccaggagcgcgctacgcgcacgaccataattatatgctagcttatggtttttgtaactaagtattggagaaaaaccgcgccctatgaatgctataaactattcttaaaattctttattaagaagcatgtttacagacgaaaacaaaagataattttgcttttttctagatcgttataacctggaacttgttatagtttacatcccttcattcaacaatcaaacccacccttcataatgtaccaggcaatcgggagaaataggctcgataacttcgtgtacagggaaaacatcctgaacaaagaacaaattatactttgctctggccgcttttaaaacagtcgcgtgagcgtcgtgttccttattggtatttccttttattggaacaagaaatatccctatcaaagcaatcaattttttcattgcatgcgcctcccaaagttaattatgtcacgatgagactttcaaatctggagcagtaaaaatacgctgttttagtatttcttatttaattaaaaataaccaagaaaaacactctactaatgcatctttactctcgcaacctgaaacgattccctccttgttttttcatccttgatatggtaaagtaggcttttcttcgcatttcatctcagtgaaaaagattttacacatggaaattgaaagatgaacgtttggactaaatttttccaacctccaaagcacattaaagaaattgaagaccaagaagtggtcaagaaaaaatacaaatactggcgtattcgtattttctatagcatgttcatcggctacattttctattatttcacaagaaaaagctttacctttgcgatgcccacgctaattgctgatttgggttttgataaagcgcaattagggatcataggaagtaccttatatttttcttatggaatcagtaagtttgttagcggagtcatgtccgaccaatccaatcctagatatttcatggctataggattgatgattacagggctcactaacatctttttcgggatgtcatcctctattgtattatttgctctttggtggggactaaacggatggttccaagggtggggctggcctccatgtgctcgtctactcacccactggtatgcgaaatcagaacggggcacttggtggagtgtgtggagtacctcccacaatattgggggagcacttattcctattctcacaggattcattattgattatagtggatggcggggagccatgtatgttccaggcattctttgtattggaatgggtttagttttaattaatcgtttacgagacacgcctcagtccttagggctacctcctatagagaagtacaagcgtgatccccatcacgcacatcacgagggcaaatcagcctcagaaggaactgaggaaatcgaacgcgagctatccactagagaaattctttttacctatgtccttacaaatcagtggctttggtttttagctgctgcctcgttctttatttatatagtacgaatggcagtcaacgattggagcgctttattccttattgagacaaaacattatgcggcagtgaaagccaatttttgcgtatctctatttgagattggtggtttattcggcatgctagttgctggttggttatctgataagatttctaagggcaatcgtgggcctatgaaacgtcctcttctctttaggtttgctgtttgctattttaggcatgtggttttcacgtagtcataatcagtggtgggtggacggaaccttacttttcgttattggttttttcttatacggccctcaaatgatgatcggtctagcagcagcagaactctctcataaaaaagctgctggtactgctagcggatttactggatggttcgcttattttggagctacctttgcagggtatcctttaggaaaggttactgatgtttgggggtggaaagggtttttcattgctctcttagcctgtgcatccatagctttattgctctttttaccaacttggaacgctacggagaaaaacactcgtagtaaagcctagccgttcttgaggattttttttgacctggataccccttcactgtcattctcaatactctgttcttgatgcaatgagctccatcaaagatttcgttgcgaaaggtcaggaatttggaattcccgctctggctctaacagaccatgggaatctttatggagctgttgatttctataaagaatgcactcaaaaagggatccaacccatcattggttgcgagtgttatattgctccaggatcacgtttcgataagaaaaaagagaagcgtagtcgtgcagcacaccatctcattttattatgtaaaaatgaacaagggtaccgcaacctttgtattttaacctccctagcatttactgagggtttctattactttcctcggatagacaaggatcttttgagacagtactctgaaggcttaatctgtttatctggttgtttatctagttctgtttcagatgctgccttaaaatctccggaagctctgcttcttgaattgcaatggtttcaagacctattcaaagatgattatttcacagaagtacaactacacaagatgtccgaagagagcattgcaggctttaaagaggaatggttaaagcaagaatattactctctcattgaaaaacagatcaaagtcaatactgcagtgttagaagcaagtaagcgcttaggcattcctactgtagctacgaatgacatccattacatcaatgcaaacgattggcaagctcatgaaatcctgttgaatgtccaatctggggagactgtgcggattgcgaaacagaatactcatatccccaatcctaaacgaaaggtctatcgcagtcgcgagtactattttaaatcccctgcgcaaatggcagagttatttaaagatattcctgaggtcatttccaacacattagaagttgccaaacggtgtgattttacttttgatttttccaagaaacactaccctatctatgtccctgaatctttaaaaaccttaaacagctacacggaggaagaccgttatcaagcttctgcagtcttcttaaaacagctagctgaagaagctttgcctaagaaatactcttctgaagttcttgctcatattgctaagaaatttccacatcgggaccctatcgatattgtcaaagaaaggatggacatggagatggccatcatcattcctaaaggaatgtgtgactatcttttgattgtttgggacattattcattgggccaaagcaaatggcattcctgtaggccctggaagaggttcaggagctggatccgtattactatttttgttagggatcacagaaatcgagcccatacgatttgatttattctttgagagatttatcaatcctgagcgtttgtcttacccagatattgacatcgatatttgcatggcaggacgtgaacgtgtcattaattatgcaattgagcgtcatggcaaagataatgtagctcaaatcattacttttggaactatgaaagccaaaatggctgtcaaagatgtgggaagaactttagacatggccttatctaaagtgaaccacattgcgaaacatattccagatttaaatactacgttgtctaaagctttagaaacagatcctgacctacatcagctctatattaacgatgccgaatctgcacaagtgattgatatggcgctttgcttagaaggctccatacggaatacaggggttcatgctgctggtgtgattatctgtggagaccagctgaccaatcacattccgatttgtatttctaaagactccacaatgattacaacacaatactctatgaaacccgtggagagtgttggaatgcttaaagtcgacttattagggctcaagactttaaccagtatcaatattgcaatgtctgcaattgaaaagaaaacaggacaatcgctagctatggcgacactgcctttggatgatgccaccacattttctcttttacatcagggaaagactatggggatatttcaaatggaatccaaggggatgcaagaattagcaaaaaacctacgccctgacctctttgaggaaatcattgctatgggtgctttataccgcccaggccctatggatatgattccttcttttattaaccgcaagcatggcaaagaaattatagaatacgaccatccccttatggaatccattcttaaggaaacctatggaattatggtctaccaagagcaagtcatgcagattgctggtgcattagctagttattctcttggagaaggtgatgtattacgacgtgccatggggaagaaagacttccaacagatggagcaggagcgcgaaaagttctgtaaacgcgcctgcaataacggcatagatcctgagttagcgactgtcatctttgataagatggaaaaatttgctgcctacggctttaacaaatctcatgctgctgcctatggcttgattacttatacaacggcgtatctcaaagcaaattatcctaaagagtggcttgcggccttacttacctgtgattctgacgatattgagaagataggaaaactgattcgagaagctcagagtatgggcattccgattcttcctcctcatatcaatgtctctagcaatcactttgtagctactgatgaaggcatacgctttgcgatgggagctattaaagggattgggcgtggtttaattgagagcattgtagaagagagagatcatcatggtccttatgagagcatccgcgactttatccagaggtctgatttaaaaaaagtttcgaaaaaaagtatagaaagtttaatcgatgcgggttgttttgattgctttgattctaaccgagatttgctgttagcctctgtagagcccctctatgaagctattgccaaagacaagaaagaggctgcatctggtgtgatgacgttctttactttaggagctatggatcgaaaaaatgaagtccccatttgtcttcctaaagacattccgactcgctctaagaaagaacttttaaaaaaagaaaaagagctcttagggatttaccttacagagcaccctatggataccgtgcgagatcatctttctcgtctttctgtagttcttgctggagaatttgaaaatctcccgcatggttctgtagtccgcaccgtgtttattattgataaagtaacgactaaaatttcatcaaaagcgcaaaagaagtttgctgtccttcgtgttagtgatggcatcgattcttatgaactgccgatctggccagatatgtatgaagaacaacaagaacttctagaagaagatcgtcttatctatgctattcttgttttagataagcgcagtgattctctacgtatttcttgtcgctggatgaaagatctttctattgttaatgaaaacatcatttatgagtgtgatcaagcttttgatagaataaaaaatcaggtgcaaaaaatgtcatttacaatgtcaacctctggcaaagaaactaaagctaaagggaataagcctaatgagaatgggcatacacaagctttagctcctgtgactctatctttagatctcaatgaactccgtcatagtcatctatgtatcttaaagaagattgtgcaaaagcaccctggctcacggacattagttttagtttttactcaagataacgaaagagttgcctcgatgtctcctgacgacgcgtatttcgtttgtgaagatattgaagaactccgtcaagaacttgtgactgcagaccttcctgtgcgtgtaattactgtttgagattttctagacgctaggttgcatgcttgaagttctcaaagacatgagggcatgcctatctatctatagatcttgaaaagattttcccgtgactgcgttgatgtattcaacacggacactattatctgcagaaactagggagatcttatagacaggtacatagaccatcgagctacgtacaattaaaaaattatctccaaagatcatcttcactaaatgacgcacacgatcttcggaatactgcgcagggaacacggctgcgtgacgtggtttttgcaaccacacaggattgttattgagtgttgttgtacaccctcggataggctggaactgttggaagtgcgttcctatttgattcccggaggcaaagatcagttttttcttctgacattccttaattactcgctctgcacggatattctttagggctaaggcttgggctaaggattcccgggatgtggttccccctaaggtagctagcgtttgtatcacccgcatatcttgcttaccagcgtgcaaaaggaggcactctcgaaatcccttagagcatgtccaagtccctgtatgcaataccatctcaccattaactaagctccaaaggatttctccctcttggctgataatatgctttttgacaggttcttctttagagaagcgtacgtgcataagggtatgtgggatgaaggcgagctctacaaaagacttgccatcacgatattctgggaacaatgccaacgcctgttctggagagacgtgacgttcaaaaacttgtaactcttcaaatcctgagatttttcgtacaaagcggcagctcttagaaaatacttctgagctatggtcagcagcaagccgcataattttttgtgcacaaggaactcgatcccacaaaaaaacaccacaaaaaagagaagcaacaaaagcagcaaaatatagaattaacttcttcataaagtaccttttttgtattttacacaataaagaaatgttttatcaaataaaaaaaataacaagttataaataaaacaaaaacaaggcatttgacaaattctgtttttcttttttatgatggcgttttgttgttgtaagcccccgtctaattatgaaatttctattatacgttccacttcttcttgttctcgtatctacggggtgcgatgcaaaacctgtttcttttgagcccttttcaggaaagctttccacccagcgttttgagcctcagcactctgctgaagaatatttttctcagggacaggaattcttaaaaaaaggaaatttcagaaaagctttactatgctttggaatcattacgcatcacttccctagggacatcttgcgtaatcaagcacagtatcttataggagtctgttacttcacgcaggatcacccagatttagcagacaaggcatttgcatcttacttacaacttcctgatgcggagtactctgaagagttgttccagatgaaatatgcgattgctcaaagatttgctcaagggaagcgtaaacggatttgtcgattagagggcttcccaaaactaatgaatgctgatgaagatgcgtacgcatttatgacgagattctaacagcgtttcctagtaaagacttaggagctcaggccctctatagtaaagctgcgttacttattgtaaaaaacgatcttacagaagccaccaaaaccttaaaaaaactcacgttacaatttcctctacatattttatcttcagaggcctttgtacgtttatcggaaatctatttacagcaagctaagaaagagcctcacaatcttcaatatcttcattttgcaaagcttaatgaagaggcaatgaaaaagcagcatcctaaccatcctctgaatgaggttgtttctgctaatgttggagctatgcgggaacattatgctcgaggtttgtatgccacaggtcgtttctatgagaagaagaaaaaagccgaggctgcgaatatctattaccgcactgcgattacaaactacccagacactttattagtggctaaatgtcaaaagcgtctagatagaatatctaagcatacttcctaagatagaaatcaatatgagattgttttctttaggcacgatttatctttttttttctctagcactttcgtcatgctgtggttactctattttaaacagcccgtatcacttatcgtctttaggtaagtctttattacaggaaagaattttcattgctcccataaaagaagatcctcatggtcagctctgctcagctctaacttatgagcttagtaagcgttcttttgctatctctggaaggagttcttgcgcaggctatactcttaaagtagagcttctgaatggtattgacaagaatataggttttacgtatgccccaaataaactcggagataagactcacaggcattttatagtctctaatgaaggcagactatcactatctgcaaaagtacagcttatcaataatgacactcaagaagtccttatagaccaatgtgttgctcgagagtctgtagactttgactttgagcctgacttaggaacagcaaacgctcatgaatttgctttaggccaatttgaaatgcatagtgaagccataaaaagtgctcgccgtatactatctatacgcctagccgagacgattgctcaacaggtatactatgaccttttttgaaggagaaaccgtttttcctgcagtacttagtgaacttcatagcatgttggacttaatcaaacgtgcaggaaaacaatctaagtgcccccaagagaagttgttaaagctcgagcttgcttgtgaggagcttctcgtcaatatcatttcttatgcttatcagggcgaaaattctccaggaacgattgcgatttcttgcatctcccatagaggagacttagaagttgtgattaaagaccatggaccttctttcaatcctcttgctgtttcaatcaacattcaggaagatcttcccttagaacagcgtaaactcgggggcttagggatttttctggctaaaagttctgtggacgagtttctttatgctcgtgaagatcattgcaatattgtgcatttaaaaatgctcaatggccaacattcctaaacctagtgatcgttattaaagcggaaagaacgcagagcattttcagtatctttaatatccttaagatataactgcagggcttcgagaatcagcgacgactgattgtattgtccagaggcttcgaaagccatttctggttcatagtttccttctccttgggaaaccgcaatatatccccgagtgactgcctgtccttgaacaagctcaggaacgagccaaatagcaaaatcagcgttaaataatgtgagtttatctttagattctgcaataataaaatcgttgtcagactggctacagagaaagtcagtgttagcatcagtgcaatgaggataagagagtatttctgcaatatttaagtatccttcggggaaggacgtccctgtattgagtattgactgatgatagaactcctcgaaaaaatctaaactcatagtatatttcctctgatttatggtaattctttattttcagagccgtcaagtcctttctattctgttgaatttcctaataacgtaagtaataaacaatcaaaagtccgcatatgaaaagacctttttttacctatctatgcatcatcttctacggatcttgtgcatcgttatctttacatgcaggactctctttcccagaagtacgtggagctacggctgctgttgtccatgccgactctgggaaggtattctatgataaagacatagatgctgtaatctatcctgccagcatgacgaaaatcgcaactgccctctttatcctaaagcactatcccacagtcctcgatactctcatcaaagtcaaacaagatgcgatcgcttccatcactccgcaagcaaaaaaacaatcaggatatcgtagtcctccccactggttagaaactgatggatctacaatacagctccatcttcgagaagagcttttagggtgggacctgttccacgccttactggtctgttctgctaatgatgctgcgaatgtcttagctatggcatgttgcggatctgtagagaagtttatggataagctgaacttcttcttaaaagaagaaatcggctgcactcatacccattttaataatccccatgggttacatcatccgaatcactatactacaacccgtgatcttattagcatcatgcgttgcgctctgaaagaacctccatttcgaggggtcatctccacgacaagctataaaataggggctacaaacctgcatggcgaacggatcctatccccaacaaacaaattgcttcttcctgggtctacctaccactatcccccagctttaggagggaaaacagggaccaccaagactgcagggaaaaatctaattatggctgctgaaaaaaataaccgcctcttggtaacgatcgcaacgggctattcgggtcctgtgagtgatctctaccaagatgtcattgctctatgtgaaacggtatttaacgagccgctattaagaaaagagctcgtccccccctccgactgtctccaattagaaatagcgaatcttgggaagctttcttgccctcttcctgagggactctactatgacttctatgcctccgaagatcgcgaacctctttctgtatcttttattgcacatgcggacgccttccctattgaacaaggagatcttcttggtcattgggttttttatgacgatgaaggcaagaaaatttcttcccagcctttctatgccccttgtcgttttgagcgcactatcaagccttggaaactctatatgaaacgtgtcttcacatcgtatagaacctatatgtctataaccatgctgctcatgtattttcgcatccgcaagcaccgcaagtataaaaatttaaaacactattctaaaatctaactttttcttttaatttataaaaaaccaaaggtttatgtaagatttgcgcttttcaatccaacaagaatcccttgtgcgcacattactttgctgtttacttgtcttcacttgtacttcttcaagttatgctcagatatcctttcctaaaaaggattctctcctctcttttttattgtcttggaactcttagggaaaatctacagaaggaaaagcataccactgtttccttaagcaagtgtctattgccttaaaccgagaagaagtttgggataatccccatcacttaatgtttatcttaatgcaattccaacaattttcaggggaacaggatcgttttggaagtttcttagaagcaaccatccgtgatcgggtctcttttttagtcttacaagaaaagattgccactttaaagtagcagtttaaaactctgcataccaaagatagagcttcttatcgttactttagggaacggtaatgtttgatttcttttgaaagattcgggcgctctacagcgcctctattctagattttttgaaaatgagaagtaaaaaatgcgtcgcccttacctacttgtaagggaagcgtttttctgtggacttctttccaacctaaagagtgcatgtaggcaacatgagcctcattttcttcttttaaaagagaacaggtaatgtagacaagtcgtccccgaggtcccacataagcacttgcttgttttaagatgctcttttgcactcgcacatagttcaacaacaatttcttagaaaattgccacttatgttcgggatgtcgtcggaaaactcccgttccagaacaaggagcgtctacgataactacagaaaaggatcctaaacgtaattgatccgctaaagaaaaattcctagctccagcacgtaataaacgatgctttgcagtttgcaaaatagctttacgactgtcattgatcacaacatgttttgctttctgcgcaaagataaggcttttcccgcctgctcctgcacaaaaatccaagacgatatctttatctgttagggaaatgccctgagaaattctctgagagttttcatcttggatttcgaaaaacccacgacgaaatgcttctgtagattgtaagggatgacgtttggaaaagtgcaatgcctcaggaagctctccaggagaacttggatattctaacttctcttggagttctttgacggagattttatctgtattcacacgaatcgtaatcggagcttccgttaaccaaatcttggcgatctcctcggcctgttcttctccataatcttgaactaagaagtgcgcaagatcatcagatatagagtaacgcacaggccagggaatagcgctgtaactgtccaagttctctagaaccccttcgtttactttcgcaacgagagcttctggagttacttgttctcccgaatcaagaattaaagtttcaagaagacggcgatgacgcaaaatattaaaaataatattttgaatccactgacgatccttagaccccaaagaacggttttgtttaaaatagtacgaaactctatctgcttctgaaattgcagacgtgtgtagctgttttaacagctgataagcatgatgctgacgaaaaggaaccatagtgacatagagtatacctcgtcatcacctattttgcttggaaaatcttacagaagacaaaataaagagagccatcagtatagtaaaaaatatgcattacggacgacgttgccataatctcaagaattgtctccaaaaagaaggatgcggattatagtattccgctgcttttcttaaggctataccgatatctctatcatagtctaacaaccaacgcataagtaacatggtaatcattttatcccacagggcgggattttggtctcgaatactataaatattccccacctcctcaggagtggtattgtcggacttagatacatggagtttcttttctacgatgactttccgcaatacttctgcaagaaagcccagggctaatttagaatcttcaggggaggctagggcagtctcttgccatagacctacaaaagtcttcccatgaaatgttaaaggctggttcccaataagagagtttgccaatacctcagatagagaatctgagataatactcataataatcgtttggaaatcctcggcactcaaagaaaaaagctggatcagctcgcgtaacaatacgtagctcttttctgataatgtttttaggggttgcgctttttctcctataaactggttgagcaattctaaacttaagggaagatacgccgtatgcccttcaagtaatgtggttaacgcttctatgatcatttgtagagaggcatctgctgccaatcttctttgcacctctccagccagaggcgtctgaacttctgataccgtaacctcatgagtaaaatcttcccatgaggaaaaattacttttccctttagagaacaccttatttgcagcttgcacaattttatcgacaggacgcttggactcaaaaagaatcaaagacttaaacatacatagtttgtctacaatggcttttttgatgtgatacttggaggggaagaacagccggtagagccatcctgtttggggtttttcttcatgcaaacgcaattcaataattgctaaaagtcgactcgatatcgaataagaaattgctgaccaggaaaagagctcgtgaattacctgacgaatcgtggatacgcttgtatcatagttggtaggtaaggggtcattgaccggccatgcatctaagagaagtcgttttctgtcatatgcgagtatgcgcgtgccatccctaattgctagttcaagaacccgtaaataatatcctatagaaaattgaaaatctaaaatcatagatagtggtacttagagcttttctatgttttattcttcaggagaaatattatttcatcatatttatttcctgaagttactataggcaatcgttaacaatgagaacttttattaaaaagtcctgaatactagtctttgggctctattgatgtcagacgctcgctacagaaaaactgacagatcacatagtttaatntcttctgatatgctaggggatgcgagcgatagtcttcttctaagatagggagatttacttctaagatagcgagaacgacatcntagtttacttctgaggcgtgctcttctgaccacatcattaaaaagtctccgagctctttgctacgatcttgacgtactaaatagaggatgtctttcataacgagagcttcgttctctcctttatcggcaaactcatcaatttgggaggcacaggcaagtacctgagtatagttacgaccaagatcatatgtttttaggttgtcaacaacgctgacgcattgcccagctcctaaataaggagaggtaaattaatcttagtaatcccacggacgttagctaacccatcaatacgtttgtctgagtataatagttcggagagccttttggagacttcttctactgttgttgtagcttctaaagaaaacgcattatacattcctgcctcttcgatgacttctaaaggcagtccttcttgaactgcgtccgtagctacccacttgcagcaagaacgtaagattaaagcaaatgcaactgcagcttctggacttataggatctgtaccacaaaggtctaaaggagcctctgggtgttgacgacgtaaaagagtgaatagccttaaaaatacatgaaagaaaaagcttcggcatgaagctagtgctgtttctaaagcataaaagtatggaggttccgcagtttctttagggagtcgcgttgctttgagaagatcacaagggatgtcccccaaggaacgcactccctgttcttttggatggcgttttgttttaacatgcatccaaatctgcgatactgctttacgaatccgcgcaagcatcgtagttaacaggcttccgcgagcttcatattctactctatctacaaggtcgctatttaaatcactattcgtaccttcagatggagttgcttctgggatccccgtatccgctatggtttctatcacttgggtagcactttccgatacccgatcctctaaatctgaatccccctcttctgcggcactttcttctaaaggatctgatatcgtattacggtcaccatcattgccagatataggagttcccatcgattaactactccacaacaatgcttctgccttttttattcaaaaagatccccgattaaaactgtcattgtattcgcccaagctccgaccgataacactttcataccttgaagtagtctactcgactcattggccattcgcacaacgtcacgagtgtgattctttcctgcatttgcgattcggacggaagtagcatgagagtgtacagccgcaccgagttctcgtgctaatgctatccatattctaggcatctcattaggatgattttcgcgtacccgatctaaagctgaccctaatcgagctatatcacttgtataatctatgtcgctatcatctccaccgaaatccgaaaccctagtttctaaaaagttttggatagattctcctgggtctaatgtaggtccttcgatacctaagcttataaccacttgcatgagtacaccatcaggatcattacctggcttaggattttctaaattcttaattgcgcctctaactgtctgagttacagcatccttagctacagtcactgcttgcggaactggtcctgtagatgaagtcccttcgataagcatagattgttctgtgtatgtttgctgcaaagctcgagcaatgacacgataaccatgcaaaagatagtctggacccctattattttcccaatccgtccactttgtttgtagctcttgagatacctttttaagtactttttgagactccgcatgactatggactgcatcttttaattcactcacaagtttagcgacttcagaactcatggcagtaggttgctctgatcctgaagaagaccccgccgtaggaggttgaggtgctcgacctttcccatgcgttgcgggacgtttcgcattagccccacccgttgtaggaggtggaggtgccggacgcgtaggccgtattgtaggtcctgaaggactttgcattgcaggtcccgaagcaccctgagaagaatcgggtgatttcttccctaaaaagaactcccttaccgtctgccataactgctttgctttagaagcaacttgcggctgtgaggttgatgtagttacgttgtgagcaccaagatttgagtttgtagctcctgtaccttgggtactggagctatcgccttgagctcctctaacccatacatcatctggtgatctattacccgaaggattgattcccattgcaattctctatttatttttcttttttaaatttaattaattttaaaaagaaaataattatgtataaacttttttaaattaattaataattaactattacaaaaaccactaaactataaagatcgcttactaagacgtagaatgtgcgtactacctctgtaagttccgtaatacccaagcccaatagagagaaagcaccccgccaatctcttagagagacaggcctgagtggttctcttgttcaccgccttttaaaggaaaaccttagtggctacatttaatcttcgtcagaccagctgacacgcttctttcctgaagtcccagactgcccaggctgtttcaaaatgcccttaggaggttgaggtgctggacctttcccatgcgttgctgcgcgcttagcattggtcccacctgttttaggaggctggggtgctggacccttcccgtgcgttgccggacgttttgcattagttccacccgttttaggaggtgggggtgccggacgcgtaggctttagtgtcgtgctacctgatgaacgttgggcccctcctccaggaacctgtgggatagtgactttcatccctggttggtacccttttttaattaagttcctaccagctccctcggtagcgcgagcatcccctcccggcaacgggctacgtacagtatctgcagatggagcagagggttgttggctacctcttggagctcccgatctgaagaagctcatccgactaaaaaacccggttactgcttctttgattcgtgctaataacccttggcgtcctcctgaggcagtcactctatgacttcctaggttagcacttgtaaccccggattctttaacatcgggatgctgatcatgagctcccgtaatccagagatcgttcttggaatttcctgatggattaacagacattataattttctatttttatttttctttattacttaattttaagaattaaattaatttatctataaacattttaaataaaattaattcgcaattagaaaatataactattctatttctaagagaaaaaagacgtttttataataaaaaacatctaaagttcagggagttatctccagaggagtcctctggtgaaaatttgaaaaatcggaatgtattaaggtttggagaattacaacctaaagatagaccaaagcctgggggaaagagttacccacacatagacaagcaccgcagctctccatgttaagagagaagaagagcgcgatgcatcgtgtttacctaaacgacaacaagatacatctcttaacacgaattcttaagtatgttgatttaagagtactttagcttttggatggagataaaacttctgtacctgggaggaagccctgctctagaaactctaaagaagcccctcctccagtagaaacatgggaaacttttgtagagcagcctgccaaagcaaccacagctgccgcatctcctccacccacgacagtaacagctgaagggtgattgcctaaggcattcgctatagcaatagatccagagtcaaaaggagggacctcataaacacccacaggaccattccaaaacacagtcgctgattggtttataatacggataaattcttcggttgttctaggtccaatatcaaagccttgaagatgcggaggaatgccttgatctatagaaatcacagaatattccttagattggagattttcggctgctttcacatcgctaggcaaaactatggtaacattacgacttttagcaattttcaatacatttctagcaagatccaaggcagatttctccacaagagagttccctagggattttcccaaggcttgtaggaaagtaaatcccatacctccagctaataagaggtagtctacttgattcagtagagcctctataactccaattttagaagaaatcttagctcctccaaggatggcagtgaaaggcctcttaggggaggtcaatagatgtcttcctaaaaattccaattctttttccataagcaggcctgctgcggctctacctgggaaagcctgcggcactacatagactgaagcatgttttctatgcgaagttccgaaagcatcgttgacatagaaatccccgtaggaagagagttctgcggcgaacgtcgggtctttttctggatgttcttctcctatatggaaacgcaagttctcaagaagcaaaacgcgaccaggagaaagctgagctacagcttgacgtgcaacctcacccacacaatctggagctagaggcacatgatgtcctaagtatccttcgagaacatccacaacgggttgcagagaatattcctcttggaacccctgtcctttaggtcgccctaaatgactcattaaaatcactgcagcatgtttcttaagtagatagttgattgtaggcatcgcactgcgaatacgaatgtcatcgagtatcttgccatcttgcatggggacattgaaatctacacgtacgaggacttttttttcttctggagaaagatcttgtactgttagcttatccatatatcctcaagaacctactatttgatttttcttatttttaatggaacaaagctcttaaagcaaagaaaaagagtatggataataaagctcctgcaggaagcgtaataaaccaggagagtacaatatctttgataatgtttaagttaatggcacggatccctcgtgctaaacctattcctaaaacagctccaacaacaacatgtgtcgtagatataggaagtcctaaaatagaagctaaagcaattgttaatgctgagcccatccccacggaaaaccctcgagacggggttaactcggtaattttacagcctacagtttctataacacgccatccccaaatcgcaaggcctatgaccaagcctatgcctccaaatgccatgagcctaattaatgtatacgacgtataggaagcaggatatgcctgacgcaagactccagctacaggagcaatggcattagcaacatcattagatccgtgagcaaacgccataaagcaagctacgataatctgtaggtaggcaaagattctttctacaacaagatactttcttccataatttccgcctcgttctttcaaacgataggtaagactgcctttttttggtgtatctgaaatgtaggaacagtgcttggtatggacgtagtaaaacgtaatgatataacttagaagtccacaaaccagaaccccactaactgcccagggagttgaagaaaccttaaggatcacgcccccagagatcatcacggttcctaaagtcatgatcaccaaagctgctaaaaacggagcaacacgaaccatagcaagaacaggatcattcttataaaaaatatggcgccgaatgaaagaaaagatcaggtaagcaacacacccacccataaaaggggagagaatccagctaattaaaataatgcctacggaattccagtaaatgattgttcccttaccaaggaccaatccaaagccaatcacagctccaactatagaatgcgttgttgagacgggccaaccaaaaaaagaggccagctgcaaccacacgcctgttgctagtaaggctgccgtcatgccgtacatatagtccccagaggcaatcataggattggtcacagaaacgatactactttctatagtccctgcaacacgatctccaagaaggagagcaccaaaaaactcaaagatagcagcgatgaccacggcttgtcgcaatgtcaataccccagatcctacactagggcctacagcattagcgacatcattagctcctatattccaagaagtataaaagccacatagaaggacaaaaatgattaatggaagcatggagtattacttttcttctagggtcatattaattctatgtgcgagcttttcagaactatctgaaatccccgcagtgcgtcgaattacttgtaaccaaagataaaactctttttcaggaattataaaatcatcagaaaaaaatatttgcataagttctcgttgcaaaacatccgattcatgttcagatttagccacacgccctacaagcaagcgtgctttatctgccttcctccccccaaatgaactttcaagcaattggttgaattcatgtagcaatgtcatagttaactcaaaagcttctagatttttttccaaaaatcggaaaaaaagcgtttccatagatggataaaagtttaatcgtctgatggttaataagatagcaacatcttcagcagtatccgcgatgctatcttgtatagaaataatttctagaatccccgctcgagatatcggcatgaataatcctgcaggaagatgattcctcatatcattttttatacaatctgcttgatactctttatcagaaacaagttttgccatttctaataattcttcatatcttccatctcggagagcagtgaatataggaagcatgtattccacacaagagaccaccatttccagatgagcttgtaaaggagcaaatggagattggccaaatagacgagcaagggtttgcataagaatagcctttttcgcaataataacttgcctaaacgatcttgtaaacgacttatggcttctaatcccattttacagatagaggatctatccataaccttggcaaaacaacgccaacagtaccccatcgtccaatctttatcgtttactatcaatgaaggacaaaccttagcaatcattggagaatcaggatcaggaaaatctgtctctgcgcatgcaatccttcgattacttccttgccccccattttctgtttctggccaggtcaacttccaaggccacaacttacttacggcttcgcgctctatacaaaaaaagattatagggacagaaatttctatgatctttcaaaacccgcaagcatctctaaaccccgtgtttactattgaacagcagtttcgagaaattattcatacccacctagccttaactgcagaagttgctaaagaaaagatgttatacgctcttgaagaaacagggtttcatgatcccaggctgtgcttgaatctctacccccaccaactctctggagggatgcttcaaagaatttgcattgccatggcgctcctctgttctcctaaacttcttattgctgatgaacctacgactgctttagatgtttctgttcagtatcagattctacaattactaaaaacactacagaaaaaaacgggaatgagccttcttattattacccataatatgggagtcgttgcagaaactgctgatgacgtgctcgtgctctatgcaggacgcatggtagaatgtgcccctgcggttcaaatgttccataatccttctcatccctatacccgagatcttttagcatccagaccctctctacaaccgcaacaactaggttccttcaaccccattccaggacagcccccacactacacggcctttccctcgggatgtcgctatcaccctagatgctcaaaaattttaaatcgatgttctgcggaagctccagaaatctatccggtacgcgaaggtcacaaagtaaggtgttggctgtatgacgactaattttccccaacctttaattcaagcaacctcattaacaaagcactattacaagcgttccttttggtttcagggaaagacaattgccagtcgtcctgttgacgacgtctctttttcactatactccagacgtgctgtcggacttattggagaatctggatcagggaaaagtaccctggcgttagctctcgcaggtctcctacctctcacctctgggttcttaacttttaacggcaccccaatcaagttgcattctaaacacggacgccatcaattacgatctcaagtacggttggtctttcaaaatccacaagcttcattaaacccgcgaaaaactatcctagatagtttaggccactctctgctttaccataaactcgtcccaaaagaaaaagtactagcaacggtaagggaatatttagaattggtagggttatctgaggagtatttttatcgttatcctcaccagctttctggaggacaacaacaacgagtctctatagcgagagccctattaggagtccctcagttaattatttgtgacgaaattgtttctgctctagatttatctattcaagcacaaattctgaatatgcttgccgagctgcaaaaaaaactcagcctcacatatctcttcatttcgcatgatcttgccgttgtacgctcgttctgcacagaggtattcattatgtataaggggcaaattgtagaaaaaggaaatacaaaacgcattttttctgatccacaacatccttatacgcgcatgttgttaaatgcccaacttccagagactcctgatcaaaggcaatctaaacctatattccaagaatatcacaaagattctgaagaatcttgctctacaggatgctacttttacaatcgttgtccacaaaaacaagaagcttgcaagtcagagatcatcccaaatcaaggagacgcgcaccatacataccgttgtatccattgattcgtcctctacgctattcttaagctaccattaaggaatcccaagggagaggtctgctctatatatcctgagtgatgtttgactttatgttagctagagcattccgagctgcaaacacaattgtaaatacaaaacaaaagccattccatatccatggaatggctactttaagacctaacgcaacatccattcttaatataaaagaagacgctcttagcctaggcaccgtgggatctttcgcaagtaccgctagtattaagatagactctcactgagtgtcccatggctggaaagccaagcttccaacttttgaagatcctgagtattttgcaaatgaaaagagactgtagcctttgatccccgggtttttatctggaccttatacccacaaagatcactgagacgttgttgcaattcttcatgctgctttgacgactctgccatgtctaaaggagtgggcttcaactctatcgaagagccctcttcacttataagctgttcgctatcagttccgcttcacgtactgccaaatgctcttgtatgatgatctcattcagcttttccctaagtataggatcttccagagtcaagatgactttagcatggccgagagtaatctgaccctgcaacaagctttcctggatcgtcttagaaagagcaagtaaccgcaaataatttgctactgtagaacgttttttccctactttataagcaactntgtcctgagtgagtccaaagacatgaattaatcttttaaaggcctcagccatttctatagggtttaaatttaccctttggatgttctcaatcaatgtagcttctgcagcagtaccatcagcaatgacatgcttgagaatcacaggtatcgtagttgctcctgcgagctgcatggcccgccagcgggctcgccagcaataagctcataatataacacccgatctccagtgcaaatttcacgcactacaggaggatgaatcaaacctacagcttttatcgacgctattaattcttgcagctcctcattagagaatactcgacgaggctgaaaaggactcacacgaatatcatctatagctacttctataattgtatccttactgatttcctcagtcacaatatctcctgatttttcctaatagaattttggatttgcaagcatttgaaatcctggacgtacagggaatgcttacagatcaacgtaagcatatccaaatgctgcataaacataacagcattgaaatttttctatcaaacatggttgtagaagtgaagctcttttttaaaacccttaagtaaaaatctgggcttttctatcgggaagtttaggtgctgtaacgacgggtagagcttcctaggtcttctttgctcgcagacataaacagacgaaaagaaaaataactcttgataaacacgaaacaacctccccccacgcatcatcgagtctttagcttatgttctggaaaagagaaaaaaattgaatgcgaatgctaaattgcgataacataaagtgaaagcttcaaatcaaaataggtttaagccataaaactccaaacggaagagcacaaactctagttagaggaagatccataaaaatcttcggcatgcttatagattttcaacgccaaactgtcgttcctttatgcaaaagctagtccataatatttggaaaaaattttattctttttcttcggcaattgccatttgtatcgttcttgcgtccttcctatccctaaagattgtttctaacacgtataaacattcccaagccaaacgtaatagcattcttctacttacgagagcagctgaagtcgctgtttctcaaggattccttccatctaaatctgccttgtcgtcattggaacaagcctatcatcttggaggagaatccatgaagccctatgcagggtttttagcttcgtgcttctatattcataatgagcctttacgtggagcctactacgcaggactcgcttataacaatagtcaagcactgcagctgccccaccccattcaaaaactcctcaaggaaatttcagaagcacaagctgatcaattgtatgatgttgctttaagtaaatcctatcagctcttacaaactgctaacagctctcctgaatatcctactctatcttttttaaccctactacgtgtgatcgaactcaaagaactcctccaccaagatgtaagtcaagactttgcagcattgaaaagctcccccctatttcaccaatttgaacgcatgtatagcgatggagaatggacattaagcaaacgttttggcaaaaaaggataaaactcttaaggacctctatgtcagaatctctagaaatcccggaacttactgaagtgctttctgagcagccgtctctttctactcccgactctccccctaaagtaatcacagggaccttaaccctatacttccaagaagatattgaccctgcttcttaaagccttatgctcatagttcttgctttccgacaggtctttttttcccactctcgttcccagttagaccgtctaaaaaattacctacggctcctaaaacaaaactttgctattaccctccccaaagaacgaacctcaaaaggacattcgctaatgctcacttttgacttcgcctcctttgacttctatacaaatatctttcccttccttgaggaacaaaagattcctgctgttgtaggggtagcttcccgatatattccatcaaatgctgctcaagaccttcacccttcacatcgtttaaaaccctctgaaactctagcattccaagacgagatcttctctaactacatgcccttttgttgccaaaatgaactgatagaaatggcaaagtctccctatatccaattagcatcctcaggattcgcaattcggaatctcatgaataatcctccgtatctcactacagaaattttactttcgcgacatcacatagaaacaataacaggagccaagcccttggcattcctcttccccttcgggaagtcagatcctacaagccggaagcttgctgcagatcactacccctattctttcctgttagggaataccattaacagaaaattaaaaactcataacatctaccgcttagacataaaacctatgcagtacgtctgcccgagtttatttcagagctctaggtatttaaaaaactggattaaagagaaaagtaaacagctgtatctcaaaaaacaacttccaaaaagataaccttaccacgtccaaaaaaatagaagatcctatcgcagacgggtcatctacgaatcttatctaaagaatcctgcaaaacaaggatgaattgatcgatatcatcctcatcattatagattcctaaggacactctcaacacatgacccacattccatcgctccatagcaggttgggcacattgatgacccgtccgcacagcaattcctctaagatctaataaaaaacctagatccaaaggatgggctccatcgattgtcatgcctataagagctcccctgggttcctctatagaaggtccgagaatctctacacctggaatctcaagcagctctttatgtaaatatgtagttagggcaatctctttgtcgtagataaacttagctgacaagccatcgagataatctaaagcagcccctaagcctaaaactccagcaatatttggagtcccagcttcaaatttcataggtgcaggaagatattcaggattctgatgatcgtagatagcaaccatatcaccacctccttctactggaggcaactgatctaatagatcttttttcccatataagactcctatgcccgtgggtccataaatcttatgtgacgaaaacacatagaaatctacatcccaaagctgaacgtctataggaagatgaggagctccctgagcaccatcaacagcaaggtaagcgtcatagcggtggacaagctcagcaacttgttggagaggttggacacaacccgtaacattactcacatgaggaatgcttacaaattgagcaccttcatttagaagcttttccaaatcatcaagatctataagccctgaatcatgaactctgatcttttttactaaagaacctcgccgccgacaggaatctcccaagataaaacattcgcatggtgttctgcctcagaaaccagaacaacaccccccttagggatccagaggtcattaacagaaatggctaataaatttaaccctgcagttgtcccacgggtgaatacgatttcactatcagaggctgcggatacccacttacgcactttttcgcgaacagctgcgtatgcttccgtgacgttcctagaggagctataaatcgcacgatttacagttgcatatgaagaagtataaaagttagcaacggcatctatcacctgttgaggtttctgagtcgttgcagctgaatctaaataaataaaaggctcgttctcttttgctttagcagcaaaaatcggaaaatcttcttttaaattcttcactgatcatccccccccctaaatcctaaacctaggaggtttgatttagctgaaaagaagatcccaaaaacgtatcggaaactaatccttgttttaggaacccatgtatgagtttttcctgagcctctgcctctgtcatgcctcgagaacgcatgtaaaagatctgctgaggatctaaaggtcctactgtagcgccgtgggatgccttcacctcgtctgtttctatctctaaacgtggaaatgtagatacacgagcttctgaacttaataacaacgtatcatgcttttgattcgcatccgacaagtctccttgagaagaaatagaaattgtcccttcaaatagaaaatgccctgaatataaaatcgatttaatattctgacgcgataccgtctcttcagcatcgtgagacattaaattattgacccaagtttttcttggcgattggactaacactagagattctgcgtgtcccttcttcccgactatgtagctcgtattgtcaaaccatccgaaaccttgacaactttcaagcaaattctgagtcatcctgcagatagcatctttctcaaccgtcgcaatagtggaccaactcaaggtatcctcttcagaatatcctggaaccataaacactgtaagatccgccccttctccaacgaagagctcggtaaccccattgactatagttttactagaacccaccatctctaaatcaacatcatgtgatatttgtatttgagcggacgcccgttgtcctaaaataacgacgatcctaggagagaaaatcacatcatgatccgaaactgtaggaaaactaatatgacgtacaaaaataggatcgctcgtctgcatctcttcaggaatgtaaatcactacaccccgatcttcagaacaaacagcatttaaaaatgctaagggatgcttatttacatcaaacccttgcatgaatgaagacaatgatcccctagcttcgtctataccacagacaatcaccccctcaggcaactgggataacgaaggttcgtattttccattaattaaaatacactcaaaggctaaagaatggttattgtgtagccaatgttgcttaattagttctgaagctccagtcgcaagattattagcgatcaggaaaaagagaaagctcctgaatccaagaaaagctactaagcacctcttttgaagaaggctgcttgctatattgagtgtagcaagcttccgcagctttttgcacaggagaacccgaagcaatagaagaaaatgtctctattgaaactaacaccttatctccacgcaacacgcttagtcacctcttggtagctttttgcttctaattcatgcatcaaagaaacgtctcctgaaagcgctactcgaccatctaataaaagatgaacaacatcagggcgaatgaggtttcctaatttggggttgtgagtcacaatgcataaggaactggtaggatgtaactctcggtatttctccaagactctacaaatcaaacgtaatgcatctacatccaaaccagaatcaggttcatctagtaagaccatttcgggttctaaaactagcatctggcaaatctcattgcgctttctttctcctccagaaaaaccctcgttgacattcctatctaaaaatagatctgtagtcgcgttatactcatatgtctctaatacagtcgaaagcagagtattaaactcatcaatagaaatatctccctcttgattcgcacgacggcgggcattataggcgtctcgcaaaaacatcttgttattgactccaggaatctctggaggcatttgaaaaccaacaaatagccctgctcgggaacgctcttctggcaacatagaaagcaaattttgctcctgtaatgcaatctcacccgaagataccaagacactctcatctcccgctaaaattttagcaagagtcgattttcctgccccattaggtcccataatgacatgcatagntccaggttggatattcaaattgaaatcatccagaatcttcacatcattacagctagcatgtaagtgctttatttttaacattgaacctaacccacgctattttctaatttaattaacaataacttcgatgcttcctgagcaaattctaaaggtaattgttctataatttcccgacaaaaaccatggatcactaagctgactgcttcctcaggactcagtccacgactacgtaaatacaataactgatcctcacgtaattttgaggtcgtggcttcatgctcaattgaagatgttgaattttctactacaatcttcggatccgtataggctccggaagccttgcctatcaacatggagtcgcattgcgtatagttactactatgttcagcctttttccctaaggagaccaaacttctaaacgtgttcttagactcgtcagaagaaattcccttagagatcaccgtggatgtggtgcgtttccctacgtgtagcattttggtgcctgtgtcggcctgcattttcccactagtaagagctacagaataaaattctccaacactctcgtcgccctttaaaatacaactagggtatttccatgtaattgcagcaccaacctcaacctgtgaccaggagatcttagaacgatagcctgcgcacagacctcgttttgttacaaaattataaatgccgcctttccctgttttcttatcaccagcataccaattttgcaccgtggaataccttatgaccgcatgctcatgagccaccaattcaacaaccgcagcatgtagctgattagaagagtatgccggcgccgtacacccctcaagataactcgcatagccgccatcctccacaacaatgagagtacgctcaaattgacccgcttccttgttattaatccgaaaataggtagaaatatccataggacatttcacccctttaggaacataaacaaaagagccgtcactaaaaacagccgcattcaaagcagcaaagaaattatcccgatgcgaaacaacggagcctaaatatttttttaccaaattcggatgttcttgaatcgcttcgcccaaagaacagaaaataactccggccttttccaacgcttctttaaatgtggttccaatagagaccgagtcaaaaactaaatctacagcaacattctcgacatttagtaagcgcttctgctcatctaaaggtatacctaattttttgaacgtatctaaaatttctggatcggcatcttctaaacgtccaagaggttttttctgcttaggagatgaaaaatagactatatcatcataggctataggaccataatgcaggcgtgcccaggctggctcatgcaactgcttccaataacggtatgcttgtaaacgaaaatctataataaactgaggttcattacgtagagcagcgatttcttcgattgtctcttcactaagtcctcgcgtcaatccttgagactctataggagtcacaaaaccgtaaggatagtcctcacgctcttctaaaaaaacctttactgattcgcccataacctttaatcccgtcgcgcaaaactcttgaatttatcgtattaaattacacgaggacaaagctaagatagcacacagattattttttcagtataacaaagaaggcttgaaagacgaacctacccctttcaagcccagaagaaaagagaaagaattttctaaaaatcctaactcccttggagatcacaccatcagcatggaatacactaaggcgcttacatgcaaagccattctagggaaataaaaaatttttgtcttctaatttcaattgaaaacactatttccctagtttattgctgtgacgttttttctacttaacatgccttaagaaatagtatctaaacgcctttcaaattgcattgaggagggatctgacaccacagtcttctgcaataagggagcaaacgtagaatcctttttttgcaaaaataaaagctcttttgttgccttatcggtctctccttgcatatgatgcaaatagcccagaagatagtgagcgcgctcatgttctaaattaatagacaacgcgctattaaaagcctcatacgcttcccgcatttgcttaagatccaagtgagcaagtccgacataaaaatgtgcatcagcatcttcagcattgagaaacaacgcttcttgaaaagccttcaaagctaatcgagttttatctaaagtgagataacataaacctaaattgtaatgaccatcagacaaatcaggtcgcagctgaacaacacgttcataagcctcagtagccttgtcccatcgtttgcttcgagaaagcaaaaaacctaactttacccaagctttccaatataagggattcttcgctacagcaacttcaagcaaacgaatggactccgcttcatcgtccatttcagaaaggatcactgccttattatataaactttgtggattccaaggatcaagtgcaaggatcttatcaaaacaatctaaagcctcttgaagtctcttcaaacgatgatatacacttccaagactaaaccagcactcaacatcatcgggatgcaaagcaacatacgcactatactgttcgatagctgcttcatattgattcccccggtctaacgctacaccataacaataacggagatagctgtctcccggctcggatgctaaacctttagaacaccagttcaaagcctcggagactcttccagtctctaaagcaataatccctaaataacaataagcgagtgctgctgtagagtctaattctaaggtttctttcagtcttttttccgcttgctcatattcaccgctcaaaaaaaggttaattcctgaacacagaaattcttttgccaagtgtttcgcagcttcttccatggatatttctcccagcacatgattcgttgatctcaactaaatgaggagcgaaaaccatgccaaaagaaaactatccccttaaaaaagattctctttgttgaattttttcccacatatcaatcatttttaccgccataggagccgcatctcgaccaaattctcctaagcgtaaatagactatgactacgatcgtaggaagagataaatcttgatcagaaaaacccaccgcagcaaaccagatgtctttcattttcatggtaccatattcccgatccagtcccacacgcataatggactctgctgtacttgtctttccaataatacgagacaaaagttgtggaggaaattgactttgtattgctcgagctgttccgtattgaccccagataacattgcgcatgccagtcttaagcacctctactacagcatcaggcatgaaaatcgttcgcttctttttagaagagagataagaaacatgctccccctcccattctccaagcaataacttggggacataaaccacaccgccattaactaaagaagctaacatcactgctgtctgcaaaggagttacaacaagagtatgctgtccaatcgctgttgcgtataaaccggaacggttatacgccaaatcatgaggcaccctacccgcatactctcctggcaatcctaaacctgttttctcgccaaaaccaaataaagaagccgcgtctgctaaatcttcaggatccccaagaccttcccctaccaataatgaaaagtacgggttgctagacatctctaatgctgagactaaatcaataaagcctcttcccatgaaatcatttcccggcaaactccccccacggaaaaacgtgggaatcggtgtgccatctttaaaaaagcccacgtgaggcttagaactcctatagccaaaggaatttttatcaataatgaccaagggattcgcaggctcctcattatgtccccataagatcctctgagataacacagaatatgcagatactaacttaaaaatagaacctaaggtagctgcttgcccgtaggcatgaggacgtaggtatccgtatccatatactggataaaaagaagcagctaaatcttgttctgtctgcctcttatttctcacaatcgagatgggatatttgcctaatagaggacgttgcaattcattgaattcacgaaatgtagaaaaaagtgcagggagatgttctgaaagatgcgacacacgttcttttagaaaaagataatgttcgttccaagataacgctctatgcgctccattatctaattcatttatccataaatctaaaatatcatagtaaggctctaagccttctttataaggggttttagaaaataaatacgcaagaaatgtatccaaatgttcttggcagaacattttatattgccttgttttttcttcctctaagtaatctacataaggtgtaggatacctctgtttccttaatgcttcctcttgacgtttcgcagcaagatattgaagaaattcactcttacgccacgacttaaaatgcacctcaataaaagcatcttctaaaatagtagagaatgcagagcgaagcaccacataacgtccttgaagctctgtaaattcagataacgagagcctatgaacctctgaaggaagtacaggagaaaaacgctctggatctacaatcagcctaaggatatccgtatacaagattttatcgtaattcgcaggaagctcattaaaaacttggtctaatgcttccttaagctcttcaatatctgctttatgctgattcagacattccatgatccatttttgttcctgaagagaaatgacttcttggattaagatatgcccctcttcattagggaaaactgcatcaaaaatagcggaacaaggacacgtcccctcttcataaggaaataaagaaagcaaacgagtcaccaagttttgaacctctatcgcctgtcctacaaagctgtttctttttaactgcaatttaatcacagagttttcagggaaaagaaaatcaaggaagcaatcaaaggttaatggcaaaatctcttcataacataatccagtaagaggattccttctttcccgaattagagggactttcctatcataaatttctgcaatatgctctttattttctaaccatccagataaatagacgatcttaccgctttagaatcttccgcaaccttcgcattcacaaaatcattgttacgataacggggagaagaagccatggctaaaatctctccgttattaggatctaacgcaataatggctcctcctttaatccaagggaacaaaggaggaagcttctctcgtttcttcaatgacttagcactacgaaacgtctccgttttttcatattctaaaagtaacgcatccgcatacgcttgtagctcagcagacaaagtcaactgcaatttagttccaggagcttcaggaacagcaccctccatttcttgaatgaagttcccacgacgatctactaaaatcggtttttttccgatcttacctcgtaattttgagtcccaacagtgcctcaacacccatttttcctactaaagcatttaaactataagcgttgctctccacagactctaataaagcacgcacctgatctatacttgctaatccttcaggcaacttaggatcttcaccctcttcataagcacgcacacactcacgcaattgactcagctcctgagtgactctcttatactcttgaagactgataggtcctacataacctaaaatatctgaagccacgctttcttgaggataatgacgacgaactacagcctctacatgcaatccaggccaatctttagataacattttgagtttcaaataggtgcgctcagaaacattagcagccactaaataagggaccgaacctaatacagaagcttttgcatgaattgcatcttcgatcgcctcgcgatctaaatgcaattcctgagataaaagctcagacaaacacattatataatgcttacgcacaggaatgagctgtttatgcccatgctcatcgacacgccaagcccgagtaggcaaatcacgaatggccccataagcaacgctcacatcatattgcaactgattcacagccaatgtctttccaaaacgatcacaaatcgttgctctttccacatattgaggaagcactcgaatctgtggcttgtatgcctcttctaacttttgttcatgttcaacaacagcaagataccataaacgcaatgcaatcacagcaaatgcaataacaatcccagacaacagtctgttggtcttttgagcaatggaaagataaataggaaattttttcggtcgtttcatgctatggatattatgagcttcactctcgtctgaaaattacagagaactatgctctcacattatttccaatcatagtctgctaaatacaataataaaaagaagcacgatatttaagaagaatagtcaatctaatcgaacaaaatctagagaagatacagttcgcaaaatacaactaattttagtccaatcaaaacatattaaaaccaaaaatcatgttctaaataataaaaataaacaaaaaaatttctcaagagaaaaagacttgagaaggtagtgaggagccatttttaaggggaactaaattatatatataatgaaaagaatatacaaaaaagctatagctttcctatagctcataacagaagttcttggttgaaatatgcggctaaaaacacttaatcttcttatcgtctttactataataagaaaagtttgatatgttttcgactaatgagctgtatgttcatatttaaggccgtttttcaatgataagagcttcctaaatttgcctgcaggatatcttgtctggctttaatttggacgtcgtgtcgccaaaatatgagtaatagcgagcacataaataaaagatactaagcataatctttagaggtgagtatgaaaaaactcttaaagtcggcgttattatccgccgcatttgctggttctgtcggctccttacaagccttgcctgtagggaacccttctgatccaagcttattaattgatggtacaatatgggaaggtgctgcaggagatccttgcgatccttgcgctacttggtgcgacgctattagcttacgtgctggattttacggagactatgttttcgaccgtatcttaaaagtagatgcacctaaaacattttctatgggagccaagcctactggatccgctgctgcaaactatactactgccgtagatagacctaacccggcctacaataagcatttacacgatgcagagtggttcactaatgcaggcttcattgccttaaacatttgggatcgctttgatgttttctgtactttaggagcttctaatggttacattagaggaaactnntacaggttcaatctcgttggtttattcggagttaaaggtactactgtaaatgcaaatgnactaccaaacgtttctttaagtaacggagttgttgaactttacacagacacctctttctcttggagcgtaggcgctcgtggagccttatgggaatgcggttgtgcaactttgggagctgaattccaatatgcacagtccaaacctaaagttgaagaacttaatgtgatctgtaacgtatcgcaattctctgtaaacaaacccaagggctataaaggcgttgctttccccttgccaacagacgctggcgtagcaacagctactggaacaaagtctgcgaccatcaattatcatgaatggcaagtaggagcctctctatcttacagactaaactctttagtgccatacattggagtacaatggtctcgagcaacttttgatgctgataacatccgcattgctcagccaaaactacctacagctgttttaaacttaactgcatggaacccttctttactaggaaatgccacagcattgtctactactgattcgttctcagacttcatgcaaattgtttcctgtcagatcaacaagtttaaatctagaaaagcttgtggagttactgtaggagctactttagttgatgctgataaatggtcacttactgcagaagctcgtttaattaacgagagagctgctcacgtatctggtcagttcagattctaaagatttgcttagaatttctcctcaccttgttatcagagtctacatgttaggctctgatttatgctcagagcttcttaatttctgagcaatttttattccccccctacttcacatcacatcaagacaaatgaattatttacttatgctattttctaatagcttcctgtagattacacgcttgcgttaaaagcattattacactactataccccttaatccagtttgcgcccgtagctcaatggtagagctgtagccttccaagctaccggtgtcagttcgattctgatcgggcgctttctttacacaaccaagactgaaattctggcttttatgtcagaatgccgttgttaacgtattctaattttgaaatagaggtacaaagcttggaatcccaatcctgcaaacttacaattaaagaccttatgagtgccggtgctcattttggacaccaaactcgaagatggaacccaaagatgaaactttacatctttgaggagaaaaacggtctttacatcatcaatctagcaaaaactttacagcaattacgcaatgctcttccccacattcgcaaagtaattcaagacaataaaactgtcctattcgtaggaacaaaaaaacaagcaaagtgtgtcattcgagaagctgcaatagaagctggcgaattttttattgctgaacgttggctaggcggaatgttaaccaacatgacgactatccgaaattccattaaaacgttagacaaaattgaaaaagatttatctagaaatcaggcctatcttactaagaaagaagcagctcttttagctaaacgtcatcaaaaattattgcgaaaccttgaagggattcgttacatgaagaaggctcctggtcttctagttgttgttgaccctagctatgaaaaaattgctgttgcagaagcaaaaaaactcggaattcctgttcttgctctcgtcgatactaactgcgatcctactcctatcgaccatgtgatcccctgtaatgatgactctcttaaaagcattcgattaatcatcaatgtgattaaagaaaatattatcgaggccaaacataagcttggtatagaaattgtttctccagtgaaatctttagaagtgcccgatctctcagctttcgaatctagccaagatgacgaatctgacgaagagaatcgagaagaagatctattagcaaaaaaatttgatggcgaggcaaactaatgagcgacttttctatggagaccctaaaaacattaagacaacaaactggtgtagggttaacaaagtgtaaggaagctttagaagcttgcggtggtaacctagaagaagctgttgtctatttacgtaagttgggattggcatctgctgggaaaaaagaacacagagaaactaaagaaggcatcatagcagctaaaactgacgccaacggcactgcattaattgaagtgaacgtagagacagattttgttgcaaacaacgcagtctttagagaatttgtttccaatctacttaatgacattctcaaatacaaagtagataccgttgaagccctatcgcaagcagcctcgtcccaagatccctctctttctgtagacgaactcagagcagtgactatgcagactgtaggagaaaacatccgtattagtagagtggcatactttcctaaggctacaaattctactgtaggaatttattcccatggcaacggcaagacagtagctctgactatgctttcaggctcctctactgctgacagcttagcaaaagacattgcaatgcatgttgttgctgctcaacctcaattcctcagtaaagaaagcgttcctgctgaagctattgctaaagaaaaagaagtgattgcttctcaaattcaaggaaaacctcaagaagttattgagaagatcgttacaggaaaattaaacacattcttccaagaagcctgtttattagaacaaccatttattaagaacgccgacctttctattcaaagtttaatagatgatttctccaaaacctctggaagctctgttgcaatagaacagttcattttatggaaaataggagcctaataaaaacatggctaagcaaactagacgagtcttgtttaaaatttctggggaagcattatctaaagattctagcaatagaattgatgaaatgcgtttatcccgactggtatcagagctaagagcagttcgtaataatgatatagaaatcgcccttgtaatcggcggtggcaatattttaagaggactcgctgagcaaaaggaacttcaaattaatcgtgtatcggcagatcaaatgggaatgctggctaccttgatcaatggtatggcagtagcagatgctttaaaagctgaggatatcccttgtcttttgacatctaccctatcgtgcccacagttagctgatctttatactccacaaaaatcaatagaagctttagaccagggaaagattcttatctgcaccactggagctggttctccttatctgactacagatactggagctgctttacgagcttgtgagcttaatgttgacgttttaatcaaagcgactatgcatgtagacggtgtctatgataaagatcctaggctctttccagatgctgtaaaatatgattttgtttcctataaggattttttgagcaatcaactaggggtaatggatgcatcagcaatttccctatgtatggattctcatattccaattcgtgtctttagctttttacagcactctctagaaaaggctctatttgaccctacgattggaacattagttagcgaggatgtaaaccatgtctgttctccaagacactgagaaaaaaatggctgcggctttagatttttttcataaagaagtaaagtcctttagaacaggaaaagctcatccagcattagtagaaactgttgtagtcgatgtttatggcactacaatgcgtttgtctgatatcgcttcgatttctgttgcagatcttcggcaattggttatttctccctatgacgggaacaatgcttctgccattgcaaaaggaattattgcagcgaatttaaacttacagcctgaagtcgaagggtctattattcgtattaaggtccctgagcctactgctgattaccgacaagagatgattaagcaacttcgccgcaagtgtgaagaagctaagatcaacgttagaaatatccgcagagaagctaatgacaagttgaaaaaagactcggctcttacagaagatgttgtcaaaggtaacgagaaaaaaattcaggagttaactgacaagttttgcaagcagcttgatgagttaacaaagcaaaaagaagctgaaatagcttcaatataagtatacttagggtttttcttttccctctgacttttttagtcatagagagggaaaaagattgctctaaagagagaaaattagtaacatttattcgtcttggccccatcgtctagcctggcccaggacatcggattttcattccggtaacaggggttcgaatccccttggggtcaaagtataaaattaacaagatatttcgggtctttagctcagcggttagagcacctcacttttaatgagggggtcgaaggttcaaatccttcaagacccatttaatgattcttgttaactttatcttttctaaaaaaaatctttttccccttagttctatttttgctatgtactgagtaccgagcttaatggaacttaactcatggttcactcacctacccaccaatgttatcattgtcaacagcctgccaccatatgctatacagaaatagataaggataaggttatacgctcttatgtatgcgcaacatgtccttgtcctagccattactataataatgagcacctgagtctatctaaaggggttggggttctcactttagagtgcggcaactgtaaaaccgtatggcattcaaagcaagacgacgaacaactgttaggctgccaccaatgttatacaaatttcaaaaatcagattaccagcaaactcaaaagtgagagagtggtatcttcatcctttactatggagaaaggccaaggctctcttcatataggtcgagcccctggggaagcttccaatacaaatcctcttttaaaacttatagcattaaatgaagctttacaagataccttagaacgagaggactacgagcaagcagcagtaatccgagatcagattaatcatttaaaaaccaaaaatccagatgacccttcctaatgatttactagagaccttagtaaagagaaaagaaagtccacaggcaaacaaagtgtggcctgtaactacattttctttagctagaaatctctctgtatctaagttccttccctgtttatctaaagaacagaaattagagattctccaatttatcacctctcattttaatcatattgaaggctttggggaatttatagtgcttcctctaaaagacactcccctatggcagaaagagtttctacttgagcattttttactcccttatgatttggtggggaacccagaaggtgaggcattagtagttagcagatctggagacttcttagcagctataaattttcaagatcatcttgttttacatggaattgatttccaaggaaatgttgagaaaactcttgatcaacttgtacaattggatagttatctccatagcaagttatcttttgctttttcttcagaatttggatttttaacaaccaatcctaagaactgtgggacggggttaaaaagccaatgttttctgcatattcctgcgcttctatattctaaagaatttaccaatcttattgatgaagaggtggagataattacttctagtttattactaggggttacaggatttcctggcaatattgtggtattatcgaatcgttgttctttagggctcactgaagaactgcttctttcttctttaaggattactgcttccaagctcagtgttgctgaggttgcagcaaaaaaacggctttctgaggagaattctggcgatttaaagaatcttatccttcgttccttaggtctacttacccattcctgccaacttgagctgaaagagactctagatgccttgagctggatacaactgggtatagatttaggcttgattaaagtaaccgaaaatcatcccctatggaatccattattttggcaaatacgtcgagcacatcttgccttgcaaaaacaagctgaaaactcccgggatctgcaaaaagatacgatttcacatttaagagctagcgtattgaaggagttaactaaaggattatctcctgagagtttctgataaaattctgaagatatatttttaaagagagatgcccaaagccgggatcgaaccgacgacctacacgttacgaatgtgttgctctaccaactgagntatttaggcatgtcgtaggaagtagggaacaaaaaagccaagaaaacataaagttatacggccgactcttacatcttcttggctttccccctgaatgcaacagagtcagaagctattccacggcggagaatatcatcttcctcttttatataccactactgagcttctatttctattattttaaagtcactttcagcctgtaaagaaggaggtccttggcattcaggagcatggcgaggggccacttgcatggatccttcatcagcttcccaattgtatctgtatccttccttattggtaacacgagtgccttcttcaaagctactaatcaccttaggcttaataaacatcatgatattgcgtttttgcctttggtcgatggtacggctaaataaaccacgaattaatggtatggagtttagcaaaggcactcctgaaaccacttttgtagttttatctctgatatgcccactcataactaagaaacaaccgtcgggaatttgtaagcgtgtggctgcataagttttatctgtgacaggtgttagtgatccagacgcggaatgtaattctgagatcgtctgttcgatttgtagtgtaactacattgttgggagcaactgtagaggtaacgacaaggttcactccaatatcttcataatcgatattttgcgttacagttcctgtttcttggataatagtatttgtagtttggtaagggaccgtttgccctacaaaaaacgaagcttgttgcgtatcctgagccatgattctaggattcaagacaatgacagtatctccatcttgatctaaggcacttaataagcctcccaaagtaaggaaagacttccctttatgacttaggacatttccgatgattcctagaccgaatgctgacgaagagttcagcatatctgagaaccctgtcaattgtcctggcgtaggaagagggatcgaaccaggatttggcgtgccgggagggacagttgcttttgtaggtgtggctatgccagtattattcaatagtccagaagcataagctactttactttgttcatcacctagggctacccattgcactccaaagtcccaggatttctctaagctggtatctagaattaaaacttcgatgtaaacctgtttaggaggtaaatctaaaccgtttaagaggccaataactctgtcgacattcccttggtttccgataataactatggagttattgacctctaaccactggatactattgagagtgttaatgaaatcttcgtccatagctgtggttacatatagattgtaaccgatatcttggagggcattagcaatcacttctccattttgatacttcagcttgtacataaagaaccgcaaactcttagggctcgtggttcctgttcctcccaaagccaaggcagtacttgcaggatcatctagggtatgtgccatttctgggacatctaaggacttcaggagctgctctgccttatttgcaagacgtggtgaagagacgacgaaaattttgttcgttccaggttggatgaacatttggaaagcatcatcttcggccagagtaccaagaacatcttggcagtagctaacaagagctgcgggattggcatatttaacttcgtattcagtcatgtccacagatgtgcctgggcaatctagagctgctagcaaatcactgactttatcgacattaccagcaatatccgagatgataacatgacgagtagcttctgaagcactaacgatagcatcatgggaaagtaaaggttgaataatatttactgctgcagagggctgacgctgtaaagacggaacactcgggtaaccacaacagcttcacacgtttcttttaaggagctgtctgtgactactgtggatagcttagaaagatgaggattacgatagataaggacgttattgccttgttcaacaaccttcaagtcatgcatttttaagacttgtagtaagattgtagataaatcatctacagaagtaggatcgtgggaaacgatcgtgacattgaattgcaaatcgttgctatcaaagacaaagttcgttccagaaattttacttacgaactgcaacaactctaaaatagaaatgtcttcaaaattgacagtatagccgttatctttaaggtcttcacaggtaagttcccgctttgtcaatcgctctttaactttttcttcttcagatttgtcttgaggtacagccactgttgttgctgctttctcgattcctggcatagaggtcgaaggacttgcaacgtttttcttcgaagcgtgtggtgttgcttgtgttttaggttggacgtctttctctgtaactgtggaggtttgctcttcgagttgtttttttatactcagattgatagcatttacggctctgcgagcataattttgtttttcttcccaaacctgtatactatctaattgttctttagaggcggcaggtacaggctcttcgacttcttgtgttggtaagaagcgtggggatctttttacatcggcagtagttctacgctctggtcgaggtttttttctctcttccagttctttcagggtggtaggttttgctgggaatgcggatcctgaagtcttttggaaagttttatcttgggttgcgtcgaatttagagaagactttactggggatagaacctggagtggttttcttggtatgacttttctttgctgaaagtgaggctgctgaatttttaggacaagcagctaacttttcatctctaagattgtgttttacatttgccgaggtctctgtaggcctctgggnacttacaccaagtaaaactaaatctaaaaaaaagagaccactnaaaatcccgatcttttttttctnttttttgatgccttgcaagatttttcttccaatgttcaatatcacagttttcaccggattctttttaagctaatgagcgttgagggagagttacttccgtgctgacgactttgtattccaccatgtatgctctctatgggacagaatatagctttttgccttctatcttgcaactctgcgagtgatagggtttttaaggatgcaacagattcttctaattccagcgtacacactacagcttcatcacctatttcccatgcaaccttggtttctcgaatttgtaaagaagtaattttccctaatcctggggaaaagctctcaaagtcttggacaacccttccctgtctttttatccagaaaacggttttcccacaagctatccaagagagttccttattttctttcgaaatttcgaggcagagtatagagatacccatttcatctatgggtattttcatgcgaatcaagcactcattgatttcgcatactctatctaaaagaggtcgctgtagatcttgttggcagactaaactttttacaacagacaaagctatagttgcattacttataggactgtaacctaaccacagattaaaaacatctccttcaagcaacgtatcatatgcatgaggatacaagggatatccttgatgatagagaactccggatataaaatctggaaacctcagagtttctggggctaaccaaaatcgttgtgtttgcagctgttcatagagagctaccgtgtgatctttaatacgtagatcttcttgcatgtctccagacatgcgatagtgatgtatatcctggataaactctcgggtcgagctgtagcgattattaggagaaggctgtaacgcttttgctaaaattttacttattctttcgggcactaatgaaagaaagacgcgtcctaaagaaaggtgccctaagatcaactcataagctaacaaacctaaagcataaatatccgaagcgggagaatgagactccccttggcgttgttctggactcatataataaggagttccgataacgctaggatgtgctctctgtatttccgtatcccaatcagcgagtccgaaatctatgagtttgattttaccctgaggagtgatgagaatattttcaggcttgatatctttatgtagaatattccgactatggaggtgctccaaagcttgagcaatatcaaagataatatctatggcttgtggcaaagagataaattgcgcgaggatatactctcttaaagagatcccttctatatactccatagcaatgtagaggcaatcttgccatttgccatagcgatggaacttaacaatattaggatgagtaatttgatggaggctctgtgcttccttaagaaaattatagacagagcgactcgtgaacgagggggaaggagaaaaaacttttatgactgtagaatggcgtgtttcaggatgtagaccatgaacaactctacttcttaattttttactcaatatttttttaacatgatatccgccaatcacctgaggttcaggaagagggatgccaccacgacaatccataaatccaatctttctttatacctctaaaacgcgaatacctaaaacatctcctagagcgataatttctcccctaccgaccttagctccatctaaaatgatatccacaccgtatgctggatggtttcccaagctcaatatacttcccaagttcaattttataaattcactgactgctaaggaatatcttgcaacttcgactacgagtctactgtatccagggaggggagctgcggaagcttgtggattttcaggaagaggagggtcttcatgagttaggttagggtaactggtaattttaaattctccagaggagggcgttaagaaacggccaccaaaaaactgatgtttttgcactgtgagtaaagcgccgctttcttcggtttcaggatcataaagacagctatctaacataatgaatgatcctgggactacctgatgccattcttcttgagttagctgagaatacccgacttctacagaaagagagatctgctgcgtttgatctatattatgaagatccgactcatcatggagacctgagaaaaacttctgacaactttggaaggtatcttctggcaataacagacgacatcgaacattttttccatctaggcgcagagaaatatctacgacttggaaagagccttgcagacttgtagctgtaaatatagcatcccctccgactttggcagacaaagagggcacccactggagctcttcaaataatttacaggcttcggcgacaaaataataatggaaccctaggagcttatctttttcatagaaatatgaagcaaggctggcatcatcaaatactgctaccatgagctcctgaaggtcttcttctgatgttaggaacaacagattttctacttcccaaggttggactaccataggttgtattagaagatgcacgccgaattctttcgtagcttctacagcagttatagatccacgaaactttatagaaacctggacatcttcaagtcgaaatttctctctaattttatgttggcacagttccttaggaaactcaggagcagcaacctgctcctcagtcttccctagggaacttaaaaaattattccgagattttagccaacttgcactagaatcggctgctactgccataaagtacctttataaacgtgcttcttcgattttataagaatcttgttctttatcgtcttgtttttgtttttgattctgatctctttgatctttctcttctctatgacggatcgtagatgcaatcatatgtagaggagtttgtacctcttcaattttaggaagctgtactaaaagatttccaactgagaattcttttaatgtgagttgatgaccttttaaagcacttaccaatgaagaaagttggctagggttattcgttacaaggtctgcagcttctgccatttgtgtagcatctacaaaacttgagaacttaacggaaagatcctgtccagattgcactaatgtaagattagctccaacaaaggcttcaggcacactagaactagcatctaataccaactctacaagttgctcaccgttgatttctgaaatcaccatagattctacagtagaaagtatgatattttctatccactgtgtatcgatactactaacagctatgggagcgacttctacaacagcttctgctgatccagctgctgcgatatctataagagacatacctgcaaaggcgttctcagcaaggcaaaattcttgagattcttgctcttcctctttggatcctacttcagcaatctcatcatcaactcgcttctcttcatcagcaaattttctagattctgtacgtgtatttcctttacttgaggttgttttctcttgtcgtgtttgctttccttccaaagaaaatacttttacatcacgactatctctaggttcaggagagttctggtatacagtgtgattgtctgttttagcgctatataatgattctgctgttttctttaattccatgaactagcttccccctgattcacgtttttttttctggcgcagttggaaaagcagctgccccatctcgtcttgttctttttcttcagcgcgacttcttctttgagagcttctttcatccattcttctttatggagtcgtgttttctcttcttcttttctacgcttcgctaaatttacttctgctttttcgagttctttagaagcagcaagcacaacttctttttgtttgttgactttctcttcttcttccgaaagctgtactgcaaccactttaatgtacgattttatctgtaagacggcgtcgcttgttgtaccttcgtccaacaaatcgcggagttgttggattttttgcatatagtgatttttaactttatcgcgttcagcttctttctctcgtaatttctcttgttctatttctaaaagacgtcgtttttctttaacaactttttctgctctatctacacgatcctttttaatcgctaaaacaggctctagtggatattttgccacagcatactactctttatttaccggaaaatggcgcgcagttgttgtgctgcttcctcatagtttgtcttttcgtggatatcttgctttaaaaaccggttcaatttgtcaatatggtcgatagcaaaatctatctcacgatcagaacctcgtcggtattctccaatacggatcaacatctcgttggctttatatttagctaaaacttctcttgctttccctatgatccgtcgttgttcttcaggaacaatagcagtcaggagtcggctaatcgaagcaagtacgtcaattgcaggataatggtatgcttgagctagtgcattggagagaacaatatgcccgtcaagaatcgatttgacttcgtcagcaacaggctcgttcatatcatctcctgctaccaagacggtataaaatgctgtaatggttcctttatcggaggctcctgatctttccaatagacggggtagagtggaaaaaaccgatggagtgtatcctgctctagcaggaggctctccagcggctaaccccacttcccgcaatgcacgagcaaatcgtgtcacggaatccatcataagtacgacagttttcccttgatcacgaaaatactctgcaattgcagtccctacataggcggcattaagtcgcaattgcgacgattggtcagaagtagaaacgacaattacggaacgtttcattccttcttctcccaaatccccctctataaactcacgtacttcacgccccctttctccaataagcgcgattacattaacgtcggcttcttcagcgtttcttgcgatcatacctaagagcgaagattttcccactccagcaccagcaaaaattccaatacgctgccccctagcgaccgtgagcataccgtctatacaacgcacacccgtagacaggatctgtcgtaatttcgccctatgcaggggatctgggggtgcacgaaaaataggaaatgtttgatccacattttgtaatggacctttagtttctacatctatgggttctcccaacccattgagaacacgacctaagaggccgtttcctgctcgaatgtgtaaggggagtcctgtagggatgacttcggaagaaggactcactcctgataactctcctaaaggagagagaaaggcaaaactctgggtaaaaccaacgacttctgttacgagaggttccatgccgttacgtttcactaagcatacttctccaacacgcacattaggaactacggctttgattaacatgccgaccacttctgtaatgcggcctactacagtcgtaagattcacatcaccaagttgtgacatgagagtgtcgaaatccgttgttaactgatccatgttaacctaattgcgttgtcataatcgttttcacgctacttacagaggtaccgacaatactcgcaaacagttctgctctttgtgtagctcgctgcacagcatattgtactttaaggaagtttgctaaactctcacgattcccatctctatcagagaagtagagcaacgcacgattgaggacctcttctccggaggagacccaatcaatgattttcctagttaccgaaccctcttctttatcttctttccgagcatcttgttgtgtgtgctcagcaatcgtattcaagtcttcgttaattaaatctatgatgactcctacagcttggaaatgctcgtctgcaaactgtgctgttgtctgactatcttcgaaagttgagcggaaatcccagaggcgccctttcaagttgttaatttgctcttggagctcttctgattccaaggcctcttgcaactcaggatcgattaaattagaattttgatcctgcatcattgccatcggatttggtttaaatccttgaacaagggtcgtatctttaggagcagcataagatcccaaagcaaatggagaaatatctttttttaattcacttgctaagggggtgccagaattctgagttatagattgcgcttctgcatctccatcaaggttggggaaacattctacagggtctatcataaagcaaaaaaaccgttttactgttttaaaagcctagcccaaaggacctgcactttttgccactaaagtgtcatgccaatctaagacagattgagcaagagctcttgtggactctattttacaatttgctatcacttgatcagcaaattttaggcaactttctagactctctctgcgcacttcaaaagaacttccttgatgcaagacgatgagcatatgggtaagagataaaaatgcttttatactccaattatcttcattgccttttatcagcgcactgaggcgttcttcagcatcgaaaagatccattttatgcaaagaaatcaatgcgagtcctagatcatgaccataatgattagggtttagaatatggagagattgaaataactttcttgcgctatcttcatctccctgtttaatggccaaaaggcctgcttcaaataacaaagcaaagtctgcttgaaatacttccaaatctgccatgatctctctcttatattattaacttcctttaactgctctagccattgtgatcatctctgtgttcacagcggttaggatgttggacaccgattccatatactgtgataagatctgcatacggaattgcaaattaaacatggttcccaaatcgacagtgccttgtgttgatgtctctaactcagttaaatactgttgaacacccttcacgtaagtacatacgccgtctagcatcttattaaaatcgaatgctgtgcaacttttatttgtagccatagatttctctcctctggacctttatatcatcttgcggttgatccgacccagaactttctgtagagctacatagcctgctaacaacgactgttgttgcccaaaagattctttgtcagaaccttctcgaagcagcgcatgtaacttatgaactttatcttgcacactagctttaagttcttgagctctgtcatgatcttgcatatcttgttctaaatctaacagcggttgagaatttttttcttctttcgctgtattttccatattaaacatagaatatctacctaaatataaataattaataaaccccaatacttggttatttattgtagtctattttatatttcaacccntccttctctaaaaagatcgcgttaggttgtatacttgttactgtcataccatcaatcacgtcccctcttgtgaggattctgccattgacaactacattgatacttatttctccgtatctagaatagcctgtaacacgatagcgattggggtaacgtaggtttaaatctatgattccctcttcagctgggagtaagacagcaaaattcttgaccaacctcacaccaggaatccccgacagctcttgcactacagcacggaacttctctgcatcatcgttattgacgtaaccagtaaggataacttcaccgttcacaaaggccacatggatgtttgcaaaacctccttgaagaagatggcctgcaattgcttttaacatntgggtttnaacaacaactttattctctagtaacgagagggaattaaaatgtatatttaaataatcaacgaggcaagctgcttgctcctcagtcttgacatagcctgtgatgatgaatttcccaggttctggggaatgcatgctgatgcctttaaactcgggtcgctttgataacaggatgttcatctcctgccaaacagcttcatcatcaataacattatcatctacggatttcacaaaggaaagggcgtctactttatacagcagctcgcttttgtccgtactatttttgacatgtccgattaagaaaagttggctgttcgttttattaaacgtataacgcaccgtagggaactgattgataacctgggcaagatcttcttgataatcaatattttctaaaggaaccacttctttggtatggaaaagagaagctgttcctataccaaagagaatagccaatcctccaacaaacagggtaagaatgaaagatcctgcgggtagtgtagcgcgtttttgtttttcttcttcttcttgggcctcttgtctttctaaggcttcggcgtcttgctgtctcccaaacaaactgtaatcgtctggggatagagaagcaactatagtatcagcgggggcatgatgatctataagtaaaaataatgtcgttcctaaagccacaacttgattcgagctcaatgtagaggtcttatcaatttttcgtccttcaacaatgacaccgtttttactatcgagatcctcgataagaatgcccccgtcattaccgacagtaattttagcatgttgatgagaaacacttaagtcattaaatactatgtcacaagttgtaggatccgtacctaaaatataggtttttcctgagtctaaatggaactctgctccaaatattagctccggctaaaactttgagtaaaaaacgagaaggctgcgtcaagtctacagagatattttttttcgcaatatcatcaatctctgctggaaaaattgtttgatcgaatcgaaataagtcttgaacatgaaatggggatagaactgcgctcttttcgttctcgacttttttaggagtttctttgttatcctctgcagtatggtcacttgccgtgtcgtcatttgcatcagcggcactgtcagaatcttctttattatcttccgtaaggttctcttcttcttcttgtacaaaggcttcttctgcttccttatcctcggattctttttgtgaatccaaaggtgttgcttctattttagagccttcctttttagaaccttcctcaggttgatcttttttttctggagaatccggtgttgctttcttattagccttctcttctacaggtttattttctttcaagggagtctcatccctggctgtgtttttaagagagggttctgctgactttggttgcggatcttgcctaggcgaagtccgttatcttccataatggcgttctggggtttgttggttctttcctctcctttcggagaatcctttgcattttgttcctttggattcaaagactcgtttgaagattcttttaaacccttcttagcaactttggctcttggttgatttttttccgcttttgctgatgctaaaaaagcatcagcaagctcctgatccccacttgtaattggatcgctacttccctgatctttggtcagcttttccttaggcttcggtgaatgatttgtttccgaagtttgccgaggctcaagatcttttccctgttcattactatcggacaaatcccctgaatcattagaaaaattttcttcgggaatatcaaaatcataaacaagatcttgaggatcaaattcatctgataagaaagaatactgattgcttcctaataagatagtatcttcattttttaactgtgtagtttcttggatcgctacgccatttacaacaataggaattgtatcatctaaatttgtgatgtagtagcttccgtcagtcttattgataatggcttgcgatgcaccgagtttaggatcttcaataggaatgtcattagcactagagtcgcgtcctatagaccagcttatcccatcttccagaacaaaaattacaccagacaaggggccttcatcaacaattaatcgtactgccatttattccaccttgttactgtttacctaggccaagatctgacagccatgtctctgaaaaattcataaaactctcaacatgtcgtacaaaatcatcatatgtagtatccccagaaaatctgcggaccatgacaacattgccctcggaatccaaacctaaagcactgcctcctgtttctctaccgaataaattgccaatcatcatttgcaagtataattttgctgtatcagcagatggaggcaaagctcctaacgaagcacttaaaacaatttcgttatcagcattttgctgagcacgcactttaactacctcacttataggcaggacataggctccgtcagcatctaactcgagagttgacgttatacccatatacgtggcaaaattttttattaatttttccaacatactcgtgttttccaacgcagcaatggttgtctttgttccctgaggaatggaaacaatctcatttctaaaacctgctttttcttcctttaaatcgagttatgccaatacgaactttaaaaataaaaacgatttcttatttgcagaaacagcattgagcgcttttctttgctcatctttttcattataaagaacaagaggccacaagaaaaatcgagctgaatccataacaagaataattataatctatcaattaacccgagcacgcccattccctcacagacatcagaggatattcgtacttctaatgaaagcttagagtattttcgaaagctgtatatgtcaagcgatgaattaggcattaaagcatcaatagcttagaacggaaggaatacgtggggatgaaatttgcctctgggttatatgtgagctctttttttcataaatttcccattgttttttcgcggcacaagttaacaaaagttttgctttatttactccttctttggtgcattgcagtcttttttgcacgcattcactgatgaaatctatatctaaataaacaaaacctgtaggggtttctttccataaaaaggttcgtggcacgttaaaatcaaagacaatacgtttgggaatgctagcaagactctcacaggaaagatcggaaaattgtgaagctgattctgaagagccaaagaaaatcacatcatagggttgtcgaaatgagagcgtttctcgagacaaggttctatagggggccgtgacttgttgtctagagcaaaaggtaatcctatgatacccatgttgatataagtaggcagcgactttcctattgatatccgagtatcctacgaataaaaaattcgtatatatcgacttgtcgtagctgagtagaatttcttgaacgacagattctatggtcacttgatgatcgggaaacccgatgcgtgagcgatactccttcccttcctttagagctttttgaaataaaaaatgaagatcaaaaggcaactctctctctttgcttccttttaaataggctcgttttacctgtccttgaatttccgtttccccaaagatcaaactatctataccactggtgacctgaaacagatgagtaaaacaagacaaacctctatgacggtaaggacgtattccctgggatgtcaattctgaaagtaaggcggcttgagcaatttcaggactttctgaataataataaagttcggctcgatgacaagtaagtaacgggataaacgctcctcctttgcctaaaaaacgctgtgcaaggaaaagatttttttcaaaagattgcagatattgaatcgcacgctctctttctttcaaagcggcttcacgataactgattccaacaactcctaacaccataagcacgattcgataatttcagaacagtatgaaggaaacttatactaaatttataaatgaaaagtaacttagctgtatagacgaagagaaaattagaagccatcaaataatctattttctctgctcattgcgttttgaaggcggttgcctatcccatataccagaggatctttacgttgctttaaaaattgaaaggtaattttgactacgatctctaggagaaatcaatgaagaaggcaggcctatgttttgcagttcccgtgttttgttcttccttgattaggaaaaagaggttcgggtaagatgcgttttgagctcctcggggagttccaaggattctgtccttaaatgataagactttagcggatggatatgcagtttaaagctgagttcatgtaatagcgatacattcccaagactaagatccataagtttcgtcttagtacgaaacttatatgttgagcttgtcccttttcttggcgcaaaatagataagcaatcaaaagattgtcctatccgctcttcttaaaaattcaacaaaatatcacacatggcggcatacacagaagcaagcattctttctttggcctctcttgatcacattcgtcttcgggcggggatgtacattggaaggcttggcaatggttctcaaaaagaggatgggatttacactctttttaaagaagtggttgataatgggattgatgaatttatcatgggtcatggtaaatctttaaaaatttctgctagtgacaagcagatctccattcaagatcaaggtcgtggcattcctttaggtaaacttatagattgtgtttctaaaatcaatacgggagctaaatatacccaagatgttttccatttctctgtagggctgaatggcgtgggactcaaagctgtgaatgcactttcagaaatattttctgtacgttctgtaagaaagaaaaaataccaccttgccaccttccatcgaggagttctgcaagagtctaagcaaggttctaccaaagatcctgatggaacttttgtttcctttactcctgatcctagtatcttccctgagtttacttttaaccacgacttcctaaaagataaaatccgccaatacacctacctacattcgggattagagatccgatttaatgatgaggtgttcatatctcacaacggtctcaaagatcttttcgatgcagagatcactgagccccctttatactctcctcttttttttcaaaatgaggatttaacttttatcttttctcaccttgaaggaaatacggagcgttatttttcttttgtcaatggacaagagactcttgacggaggaacacacctgactgcctttaaggaagccatagtaaaaggggtcaacgagttttttggaaaaacatttgtttccaatgacattcgagaaggcattgtgggctgcatagcaataaaaatagcctcgccaatttttgaatcgcaaacgaaaaataagcttgggaatacacagattcggtcttctttaattaaagatgtaaaggaagcgattgtacaggccctacgtaaagataaagtggctcctgagcttcttttagaaaaaataaaattcaatgagaaaactcgaaagaatatccaatttataaaacaagatcttaagagcaaacagaagaaagtccattataaaattcccaaacttcgggactgtaaattccattataacgatcgctctctgtatggtgaggcctcttcgattttccttaccgaagggagtctgcgtccgcatcaattcttgcttcaagaaatcccctcacacaagctgtcttttcacttcgaggaaagcctatgaatgtcttttccttagaagaaaccaaaatgtataaaaatgatgagttattttatttagcaactgctctaggcatcacgcaaaacgagattcagcatttacgttataacaaagtcatcctggctactgatgcggatgtagacggtatgcatattcgtaatcttttgattactttcttccttaaaacactcttgcctcttgtagaaaataatcacctctttatcttagaaacccctttgtttaaagttagaaacaaaacgactacgctctactactattctgagcaagaaaagatgcaggcgttacagcaatttgggaaaaaggactcctctttagaaatcacaaggtttaaaggtttaggagaaatttctcctaaggaatttgctgcgtttataggtcctgagatccgcctcaccccagttacgattacctctttagagagcatttcttcgatcttacaattctatatggggaaaaatacaaaagagagaaaacaatttattatggataaccttattactgatttttaatttatgcgtgacgtttcagagctttttcgaacacattttatgcattacgcgtcttacgtaattttagagagagcgattcctcatattcttgatggcttaaaaccggtgcagcgtcgacttctatggactttattccttatggacgacgggaaaatgcataaagttgccaatattgcaggaagaactatggctctccatccccatggcgatgcccctattgttgaagctcttgttgtcttagcaaataaaggctacctcatcgacacgcaaggaaacttcggaaatccccttacgggagatcctcacgctgctgcccgttatatagaagcacgactcagtcctttagctcgagaaacgctctttaataccgacttgatagcttttcatgactcttatgatggaagagaaaaagaacctgatattttacctgcaaagctccccgtgcttttacttcatggtgtggacgggattgctgtggggatgaccacgaaaattttccctcacaattttgcagaacttttgaaagcgcaaattgcaattttaaatgataaaaaattcactgtgtttcctgactttccttcgggaggattgatggatccctcggagtatcaagatggattgggatcgattacactgcgtgcatctatagacattattaatgataaaacgcttgtagtgaaacaaatttgtcctcaatctacgactgagactttgatccgttctatagagaacgcagcaaaacgtggcacaattaaaatcgataccatccaagacttctctacagatgtccctcacattgaaattaagctgccaaaaggctctcgagccaaagagatgcttcccttgttattcgagcatactgaatgccaggtgattctctattctaagcccacagtcatttacgagaataagcctgtagaatgttcgatatccgagattctcaaactgcatactacagctctacaggggtatcttgaaaaagaacttttgttgctccaagaacaacttactttggaccattatcataaaaccttagaatacatctttattaaacataagctctatgattctgtccgagaagtcctagccataaacaagaaaatttctgctgatgacctacatcaagcagtgctccatgctctggagccctggcttcatgagcttgcaactcccgttacaaaacaagacacctctcaacttgcttcactaacgattaagaaaatcctttgctttaatgaagaggcatgcactaaggaactgctagccatagaaaaaaaacaagcagcgatacaaaaagatcttggaagaataaaagaagtcaccgtcaagtacctcaaaggacttttagaacgccatggacacttaggagagagaaaaacacagatcacaaactttaagacggcaaagacatctatcttgaaacaacaaaccttaatttaaaaaactaagtttatctaaaaaacttctgattaataagagatggtaaaatattttctttttaaattagaattaaatttatagacactataaccattgtagtacgtatggaaccacgtcacatttatataagaaaaccagagactccaaaagctcctgacgtagaaaagcctggtgtacctgagtacatgacgatggcaaacactcctaccttcgagggtcctgtaaaaactcttgatcactacgccgagctcttatcgagcaacgaggagctgaggaagggcaaaaaatgtatgataatttcattcagtctattttaatttcaacatttgggcttgtacataaggatatggaccgagcacaaaaagcttctaagcgtatgagatctgtctataaagagcagtaatgtcgtttacctatttcctagcgcttcccgtagataggcttatgcaagaacggttcctctgttctcccaaacgttgggctccttttatcaattcgcctttataccttactctcattgctgaccacgatactccttatttggctaagaatcttgataagtttcccttacctgtagagcaatgggaaaaaacggtcctgcacgtctctagcctattgaagtctatatttttatgttcagacctttcctctttaaggttgctggcctgtacaaaattcgaaatcttgactttgaacgacctttattgcgcccaaaatatctaaaaaattgctttacaaagacactcgcatctttcccttgactaaaaattttgcttgtcaaactgccatcgaagtttgtcatgatgatgtttgagctacataggttagcctcagttgattccagcattttatcttaattcaacgcatttctatctttttagactcattaaattatttttgaaaaattctaagtgtctaagattcaaaaagagactctttctttcaataaaatcgctagatccttaactgattcgatattaaactagtaaagaaagttatcaagatttcaatgaaaactgtgacttcctttactgtatgtaaagaaaactcggggcgtttagacaagtacctgactgaggtgcatcccaaatattctcgagctttctaccaagaacatatcttaagtggtcttgtccaaatcaatgggcaaataaacaccagggtggcaacgcgcttaaattgtggtgatatagtcactatagatatccaagaaaaggaagaacttcttgagctcctacccgaagccatccctctagataaggtttatgaggatggaatgatcttagtgatcaataaacctcgggatatggtggtccatccagcacctggtcatttccatggaaccctggttcatgctcttctccatgaaataggagagagactgaaggaagaattccctgaggaaccttggagacctggaatcgtacatcgacttgataaagatacctcgggattgattattactgcaaaaacgcggcaggccaagaaggttttcagcgagcttttttcaaccaagcggttaaagaaaagctacttagcagtttgtatagggaaacctaggagtactacgatccatacacatataagccggcatcaaaacaaacgtaaagaaatgactgtaagctctcaaggaaaagaagccgttacccactgccaagtccttgcttttaatggaaaactgagttttgttgccttgtctccagagacaggaaggacccaccagcttagggttcatatgaaacatttagggactcctattcttggggatcctgtgtatggaatcccctctatgaattcgagttacggtcttgataaacaacaattgcatgcctatagcgttgatttcactcatccagaaacccggcaattttgttcattaaaggcgggtttacccgaggatatgcgttccctcttaataaaagaattccgcaatgaaacaactatattaaataaaaatttattggaatcgattttaaaagaacaataattcattaaaaagttcatttattttaggaaacgcattaaaattaattaaaattgaatttcattttttaacatctctttttaaagacaacgcgaattagttaaggattactatgaaagaatttttagcctatatcattaagaatctagtggaccgccctgaagaagtccgtattaaagaagttcaggggactcacacgattatttatgaactaagtgtagctaaacctgatatcgggaagatcattggcaaagaaggccgtacgatcaaagcgattcgtactcttctggtttctgtagcaagcaggaacaatgtaagggtcagtttagaaattatggaagaaaagtagccttaagcctagcttaagtacttctcattgaaattgctagcctaagggaaaccgaaggctaccacttcaataaaaaataattgcacgcataaagataaactcggaccgagcaggactcgaacctgcgaccattcgcttagaaggcgaatgctctatccactgagctatcggtccctattcttgtacaaccttggggtattgagcacgaaagcgagcaaaggaaatccctcaatcagtataggtctaccaagaaaaaagtcaattctgacacaagattttcttgttccctaaagaacttctttcaaagctatataaaaagcgaattccacctccttacctgtaattttataggtaaaattaaggagcaacttggattgtattctccgatcttataacctggaaagttagaaccaaaagttgctttattctaaaaaaggatggtcatgttcaataacaaaatgatcctaattgctggcccctgtgttattgagggggaagatattacattggaaatcgcagggaaattacagtccatactcgccccttattcggatcggatccaatggttttttaaaagcagttacgacaaagcaaatcgctcttccctaaactcatttcgagggcctggtttgacagagggattgcgcatccttgccaaagtcaaagaaacttttggcgtgggcattcttacagatgtccatacgcctcaagacgcttacgcggctgccgaagtctgcaatatccttcaggtacctgcgttcctctgcanacaaaccgacctcctcgttgcaactgcagaaactggcgctatagtaaatttaaaaaaagggcagtttctctccccttgggatatggaaggcccaataaataaagtactctctacaggaaataacaaaatcttacttacagaaagagggtgtagcttcggttacaataaccttgtttctgatatgcgctcgattcctgttttatcccgttcaggatttcctgtaatttttgatgccacgcactccgtgcagctccctggagctctatctacagaaagcggtggtctgacagaattcgttcctactctttcacgagctgctttagctgcaggagctcatggcctttttatagagacccataccaatccaaaaatcgctaaaagtgatgcagcttctatgttgagcttagaagaattcgcagctctcctccccacctgggatcaattatttacttgcgtcagttcctttgatatggtctcagcatgacaaaatttctatactgcgggctcttttattctctaggactacttgtcttggcttttgggactatggtagccattattcaagtggaccagatttgcgatgtttcctgtatgaacaagcacttccaagaatcccccccttttttaaaaataaaaaaggtgaatgtctccaaacaaatttgctctcctgaagaacgattcttccattgtaaaattgataaatcgtgtatggaactgcattttcctcagtctagttattcctgtaaagaatacctcacccggatctcagggcatattctaacacaaaattttgaaaagcaaatgcaattccgaggaaactcaggattactaaattaccaagatggttccttacatgtgtatgactgccgtttccaagtagatcctgtacctgggtatgggtctccagataaggaggacagttcttcaggaggtatgaaaaccctctatttatctttattcaggaattaagcctctatgcctatactttctgtgtgtaatctcgtaaagaagtataacaagaagcccgtgacaaatgatgtgtctttccaaatcaaccccggggagattgtcggcctactcggccctaacggagcaggaaaaacaacagcattttatcttactgtaggcttaattcgccctgactctgggaagattatctttaaaaatgtcgatgtcaccaaaaaaactatggaccatcgtgcacgactgggaatcggttatcttgctcaagaacccacaatttttaaagaactcacagttcaagataacctgatttgcattttagagatcatttacaaagcgcgtaaacaacaatcccatcttttaaacaccctggttgatgatttgcaactaggttcctgcctccataaaaaggcaggaaccctatctggaggggaacgacgaagattggagatcgcctgtgtattagctttaaatcccagcgtattgttgttagatgagccttttgcgaatgtagatcctctcgtcattcaaaacgtcaagtacctaattaaaattctagcaggacgtggaatcggcattctaattacagatcacaatgctaaagagctcctttctattgctgataggtgttatttgattattgatgggaagatcttctttgaagggtcttcaagccaaatgatcagtaaccctatggtaaagcaacattacctgggagactcgttctcatactaatggatctcacaaaagtctctagggaaaggagcgctactgtattctgtaagaatccttgctaatacctcaaagccatcttcttctaggatagtgactcctggtttgactcctcgctcagctaatttaaatgccttaaatgtattgcaaatacgtcctgtgagtctgatgcccacaccctttaagttcattacggaggcataatctccaaacatttttaaggaaagttcacaagcagtaactgcaaagagaatttgatatccagggtagcgcttttttaaagtgtgtaaatgttttgcgatatctataaatgtagggatgatcacagtagtgtatctacgagcattcagccgcatcatggtccctatagaacatgaggcacatgtaggatgtgaaggatcataccgacaagcatcattgaaacgcccttcaggacatgccttaggcttttgacaataagaaaatcctaacaaaaggattctatgaggacgacgcatctcctctaaaatatcctcaatattactacagccataaaaaaataggttgccctcctgtaaggcctccttaggagctatcaaagccttagctaaccgagctaaagaaccaggatctttcagaaaatcataggcaagctgtctagcatcttttaaagaggccagataagcaagcgtcttcatacgcagaccccgtcttgtagctttagtaatataaggaatattaggtttgtgctctggtctagacataaatacggaatcataacaattagcaacggccgcacactgccacgaagcacaggggcagtcacacaaaaaccctagaagcattttccatagctcagggaatggcaatattttagatagtatacagcctgaacgataatctaatctagtagaggttcgtcatcagagaggacttcctctgcgattgccttgattgtagtgagaccttcagggaaacctaaactacataataattcatttacatgttctaactctgtagtcagctggtcgttgataaactccaagcgagcgagttgctgttgcatatgagatgttggatgcataagacccctccgtaacgattcataaagaagaggagcgaaaaacatgccaacatctccgcaagattaaaatttttttaagatttagaaatccaagtttagaaattgaagaactatcctgtcaggcttcgtgctaaacttaagtacatttgatttaaaagctgtagagaagtcgcgactacagtccactcctgctgcatagaagtcaggtgcatctgcaaatctaactggaagttctgtcccatatccgcaaaagattgctggtctgactgtattgtagattgcagtgggaacatacccccattaatcatatttcctactaacccggacactaaagcttcttcaagaatctgcaatcgcgcttgccattgctcttgcccctctttaacttcaaaagttcctgctacagaacctccagctatagacaaaggctgtaagtaattttgcaataacactaaagaacctgagatagaattgatgttgtcctcgtagttccttaaggaatctaaaatcgtggagcgctgctcattcgtgattttatcatctttaagcactctagctctttgttcttcaataactgtaagagctccccgtgtttcttggagatacaaagcagcttgctttcgctcctgatccaactttgcctgagcgctttcttgagatcctgggaaggcattcgctcccccagcacctactgccggctgttgtcccacataactagcaaaattgaaatacgtagctccattgacatattgagaaatcgcatcaataatggaatttccgacagaagatcctaagttgctataatatagcttcttatagatttcatttagataatcgacctctttaggcatataacgatcgatcaacacagaggcgactgccgaaagtagggggagagcccgtaattcactagcctgtgataacaattgcccatcaaacagttctgttttcatattggtgaattgttgcaattgactctgaagatcttcgattttgttctgtacattttctgattctacagcagcaagagccttaaaccgaaaataacttcgtgccgtagattcggcgtttgtttttgctagtttcgtaatttctggcaaaaatcctgtagatccataatttaacaggatttgattaatctcaactttgccgtttttctcagaatatatagtatattgtaaggtacttgagttcaccgttacggaaaaggaaccgcttgaatttacaattgaagtcatcgcggattttatagatgatgctaactgaaaactagagttatctaattctttagcttcttcaaggatagcagctttaacgtggtccatggttgcagtagggtttaaagcaactacagtagatgctgtaaaataagcccagatagcaccaaggtgctcaccacacttaaaggtaaccaaagatttatacactcattaatcagtttctgttgctcagcagttaactcattgaaacgagaatttaaccctcgggctgtttgtagagctccagctaaagccgcactactaatatcaccttgagaggaactcagatcaattggagcaaaagttccaattaaagagccaacaaagctagacaaattggaaaacatcgttccttgatgctggttaacatagatacttgcatcaagtaccgtatcaaaggatcctaaagccgcaacttgatctgagtataagtctgttatatgttgacagaacataattttatcatttctagtcaggtcagaagaattaatgactgcggcgagtttttctccagcatcctcaatccgttgtaatcctgcttcatcaaaattacctacatgatctgctaaagcctgcagctctgtcgcaatctcagcaaagatagtaaactgctctggtgtaaggactccttgtaccgctgtaaggatgtctttgaacccttcgactctaccgtctgcaaacgtttgagttaaagtagcttgatttccatatttgcctgccaactggttcgtaaagtctgttttcattcccccagtaaacgtatctgctcgttggattgcagtgaagatctcctctgggaaattgtagagagtctgaaaattctcttctgttaaattattccccgcagcgactaaagcctgaagttcagtatttaatttatcaaagacatctttatttgcaggattcttactattaactgaggccatgatagtggtcataaccgtattaagctcaacgataagatcttgcgcccacttctgttttactgcgttataataggccccgactccagatcctgtagctgctggcgtacttgctgtaacctgaacagatgcatgtgtagaggaaagaggtttctcatgaatggctgccacaggaatagacttcgctactgtcgcacgctccacttcatatttgtgtagcttctcgacggcagagcggtagcgctcgctcgccctctgatccaaaacttcgatcaaccgttttagtatgtcacgttccgctgtagtcttctcataattagcgatatgttctaaagattccctgtgtctttgtgcaaaagaatgcattgaagacactagagagagttttttataaaatgttgaaatagaagtgctataaatcatatcaatgtctgcttagataagaacagtgttatttttaattaacattaacattaataaattatttttttaattcaaaaaattcgtcaaatgtttaaaaagaaaactatcaatattatagaaaacaaattattttttatttgaaaagcttcatagaaaaaaacaaaacaaagtacgaaaataaaataaaaatattatttattttctatgtctaccttttctatccaaaatcgactaagaaccatttcaggtgaaagtactcgaatcatcaagctggaccataagtactctggttttgatcccagatcagtgcctgcgataaatttagaagagttaaattcagggatttatgctctaaggcatttaatgaacgccctgcaatcagaaaataccaatgttgctgctttattaaacccaaacaatacgatcttccccacaacatcttggacagattacaagcattcgcgtccgcaagctagctctccaagagcaccctcatcacaaactcccacagatatcgtatcagcagcagctcttgctttagttcttgttattgacggaggtctagcggaattagtggcctccgttacagaaattgatctcggagctttatccactatatccacagttcgtcagttaatggcgagctacctcggtttgacaactctaacagctgaacaagaaaaggttgtattttccagctcctatgttccttcagaaaaaaatctccttgaacatgtaaaacaagaaaaagctgctgaaatccaagctaagcaagaagaaataaaagcagtattagaagctaaaggagtctctactgaagagatcgaagcgatacttaaggaatatcctgatatctatgcagcagatttcttcaaagagtttatagaagagcctttacatacatatcgtgcaaaagtcggtgcaccgatccaagagatgaatgagaacgcgattcagctgcttcctacacctcctgcgatcactcctgacaatgtcaatgaagtcaacggaatgaacaccctcagcactattttacaagctatagatgatgctattaaacaagctcctgcacttggtggggatcaggaaatcattactatactacaaactttggttcccctagtcgataagaccacgtttacaaaagctgaattcgatcttatttacacagcaacacaacttcctaatacagcatctttaaaactctaccttacggatagacaaattgctgagtatcgagggaaaatcacgaaagtatatcaaaattctatccaaaatctctctgagacaaaacgtgtagttgaaaacaaccgaagcatgctagaaacacaactctccatgttccaacaagcacaaaattgctttgttacttggattagtcaagccaatgcacttaacatagccatcactaataaatatatttctgctgtacttacgacttctatggagatgtacggaggtctcctttgcctttcttatatgtacgaaaggttagccgatgatgaaaaagcaatttttgacaaaagtgtgaatgagtatttaccgattcacatcgttgttggtggttcatgggtaaatggctggatagcaaaaatggcagcctatcaagaactcgcggaatactctttaggaaccgcagttacaagtcaagatcaaatcaaagcttatttacaaacacgagggaatgagtttaaagctacgcgtcattttttccataatattggggatcaaatgtaccaatttgctaatgagactgtctttggaaattgtcttacaacagcaaatggtgcgatacagcccgatttaggtggttttatcagagaagcaatgacgaatgttggaactgttgaagccgattatgtaagcaatgctcagaggatcctaaatgaatttaatacggctgcaactgcgcatgttttacaattacaattacaaatagctgagttacaaaagaaagcagatgacttagacccaggaaaagcctctttcactgagaaccgtaaatttgctgttgccgctttggatcacatcggagagcttaggagatgctttaatttctatgattttnaactctcagctaccaaagcaagaggcttttttaaaacctttgatcgaagaaattaacttcaataacctcgcagcgaatgccttaaacagcttgctacagattaccaatgaattttctacgacttctgtctactatagcctctcttcctatttagttcagagtaaaactggacaaaacctgtttgctggtgattactatgaaacacttctagctgcagctagagaacgggagtatatttatcgcgacactgcgagatgtaaacaagcgattaatctagtcaatggacttctccaaaaaattaactctcttccaggggctacctcagcacaaaaacaagaaatgcttaacgcaactacctattatcaatacagcttatcagtcactttaaaccaacttactgtattagaatctttactcgcgggtctcaaaatgactcttcagacaactagtaataacaaatacgacaaaagtgtgtttaaaattgaaagttttgatgactggattccaactctagctgctttggaaagttttctaactagtggattccctaatatcagtgcgacaggaggcctaggtcctttatttacccaggtgcaatccgatcagcaaacgtatacttctcaaggccagacacagcagttgaacctacaaaaccaaatgaccactatccaacaggagtggacattagtttccacatccatgcaagtattaaacggtattttatcacagcttgctggtgccatctattccaactaattgcatccttaggagtttttagagctcctaaaggatcttttcttctcctttaccctatactttttctttatccatctgcagcttagaaagaacatctcctaagctgctgatcaattaacaagattggaatcaatcatggaagagaaactctaaaaaagtatagaggaccttgcaaaccattctctaaaatcaaataaaagcttagaaaagaagtttaaaactggtgtcttttatttattgaagatcgttctagtgtgttggtaaggcctcaacaaaggccttaccaaagcacataataatctctccaaacgaacacttaggtgttgttattggagataaccagaatatagagagccgatattgaccagcacctgctgaataaacaaggagttcgtttcaaaggaaagtgcttttatttcagctgctgtcctagatccttcagcaaacaaactttctaatttagctatgaacttctgtgtagagtcattagaaagttgcacataaggatagccaaactgtggaggctttgtcactgccgatgtaagcttttgtctgatctcctcattattcgcttgaggattcgactggatgatctgcattacagattgtagtgccgaaacttgactatagacatctccaagagttctgctattgccagaaatcaccctagcgagggcttgatctgttttttctggtcctcgagcttctgttcgtgctctaggaacggatcgtgtgagagcgggggtacttacattgtttatcacatcacgagtcgcatcatttcgtgccctaccataggcatcattgatggatttgtaagcatcataacctgctgatatctgtgttttataatcagaacctgtagattttgaggtcttgtaaagctggtttacagatgaccctatagaacttgctgcagcgggaggaactcctgcgctcacaaacagcagcagaagcgatctgtcctaaagcattgagtatgccctgttgttgcccagctttacctagagccgcttctaaagctttctgagcatctgccagcgctgcagcagcactgtcatctccagcggctttcgctgctctagcttgtgctgcgagctcctgttgggcagcttgagaatcaggattttccgtattgaacatgtgaatcatctgacgaaacccagacatcaaaatggaagcggtctcattttcagcatcatctaacagcatggaaacacgaatactaccaatactacttccttgttgcttggagcctccaactgtagttcctggatttggaacatcagaaccatctgcaggtttgatatttttaagatctttctcagcctgtattaccatttgttccgcttcttgaagaattggagagtcggggaactttttctgagcttcagctatttgtgtcttagcagtagcgattgctgctttagctgaatctatgttgcttatactgttattagatttagcattttctacagctccactagcgttctgtcctgcaaaatatgcatccctaatcgcatttccatctttctctatctgtgtcgctgtagcatctgtctgatcaactaaagattgagcaattgcaggcgttttccctgggactactgggttatcttgcatctctttaagaagctcagctgctttgttattgtttgctacagattggagaagagcagcctgtaagaggtcgaaggaagtcagtttacctaaagagtcaagaatcgcttggttatccgaagcatatttcgctaattctgtaatttgcgcgccaactttaactgcatcggcattcttagtttcccactccgcagcgattgcggtttcctcatcagtagccgctgtatcctttatattagtgacagcatcctggaggctcaccaaagcagcctgtatgtcagctagtgatgttgaggtaaagatagtatcgtaagctgtttgcgcttgagtcttataatcatcaaacgtgggtggaggaggcgtaggtgcggtcgctgtcgttgagtccacgtctgcagatctgctagtagaagacgagctgttactagaagcaatacccagcttatctgccagactcatgagagcattcactgcagaacgcaagatgctccatcgctctacagaatcggtcttagattctttaggcttagcttccgcacctgctattctttgagcttccgcactcttatttgctgcactcgcctccaatccttgagcagaaagatctgcgggaggtgtgcgttctgtttcgtctataggacctggaccaataggattaaccataaaaactcaaaaaataataaaaatcttttagttttattataaaaaataaaaaaaaagctctcactaataattaatgcgagcctgtttttaaagattttattaaaatttgacttaaaacgctgaaattatacctagatcaaactttcggaaagtaaaatcactgccgagtttatcgtttgctggtttggagtaagccccataagctctgaatgatagagaatctgtgatgccatacatatatagagcggaaaatcctttataatttgtaaaaccattagcctctttaggatcatagttagcagcaattgcttgggcgaaccaaaactttaataaattaccacggccaatccctgaaacatctatttctggaaccgacaaggcttcgacatactcataacgtactgtggcagaccagtctccagcttttctgagtccccctaaagttcctccaataaaccaagctaggttttcttttccatttaacgtagtcttcgtagcctttgctaaagggttcattaagaaagctccataaagatatagaggctttttctgtccattgatccaaggaacctgactatgctttccgacgagccactgccaaacacagtatttgtatttcatagcgtttgtagcagctttttctgtagtggaggtttctgaaggaacgaatgtgttccagtcgacaacactacatttcacaaaaaactgtttaggcaaacgattgagaatcccttctacaacccaagcataatgtttttttgtcatgttcacgacgaaaggacctccatgaacaatcacttgataaggatagtccttagaaagttctcgagtccaatatatatgtagtccgtcaaaattactttggaattggacttctgactcaaagagatctcctaaaccagaacgtccgatttccataaagaaatctgtacgtgtttcgggattcttataaaaacgatatcctagaaatgctctgttgatatcaacaccagctgcagtgttttcccctcctgcaattgctgtccaattcatctttgaagacagccagttcctctcagcgcgataatcaatatagagataaaattcactacgataacgatttactggtaagggattgtatttatctttatctgaggggtttttgatatcttctctgaaatacaaccaccgggctctaacatctcctgctattcttaaaacgccatcttgctttcgcgtttctacaaaaccccgtttacttaagtagtctttgacttcgtctaaagttgtataagtgtgactttttactttttgttccgagagaggaagttcagcgtatcctgaaattgtcagcgctaaaagaaccacactcgctaaccattgatatacctgttttttcatagtatccttagtatcaatattaagtgtagaaacagaagaccaagcaggctatcaaaacttaaagctaaaagaaagcgactgagctacaagaaacaaaacatgattaattttgagtgtcttgcatcacgtgttgtctttgcaaaagaccccgttgcccacgccagtattcaaaagaagccaaattaataagatcttctactcgaagcagttttgcaaaaccaaacaaaaaagccaagaaaatgcagctctcagataaaaaagcaattgcttgagccgttatggaggataagggccaagcaagtggtgtgagggggtttaagaaaattacatatgtagtttgcgtaaggatatttaagcctagagtaatcatacaagcaagcatagtggttcccataacttttatggaacgccggatgctctcccaaagtaacttagagtacatagggagtcttttcgaagaataataccagaggaaatataactgcacccaagcagttatggatgtagcataggaaatgcccgagacgtcttttaaaacccaacgacctagaaccaagcttaaaacaatattggccaaagccgtaccgattcctataaagagcggaacagcatactgccgctgtgcataaaaaagaacagagactaaaggagccaaggccatagggataatactggcaccataacctcgcaatacacgaacaatagcgtagacagcactctgagggaaaagtccgtgttcataaaggacacggactccaggtaaagctaagagcaatagccctgctgtcataatgatcattacggacatggttagggtgagaacgaacttcataagtttcaatcccctctcatgatcttctcgctgtacacaacgagaaattgctgggaggagaacggtaaacacaccaaagccaaagagatgtatggggagctgataaatctttaaggagtacataagatatagagggcctatttcatgtacatagcgagccaagcagatatcagaaagaaggttcagctggaagatgcttgaagttaaaatacccaaagataagggagctaataaagctcaaacactatcgtgttcttgaggtgggctcttcgcttctaatagaaatttccatactccaggaaccgtgattaaccattcgaagaaaaacccgataactagagccacggataaaccgataatacgctctctaggatctgaatgacgagccgctataacaaagaaaatccaaatgatatttacaactacgggagctaatcccaccccgaaaaacttattttcacagtgaagcaaagcgccgtttacattgtacatcattaagaaaatgccacagggcaagagtatcatagtaaggagaatcatatcgtaagtcccctcttcaacgtattgaagaactacccacaatactgcttcaataagcagagtgaatataatagtgctgcctttaatcaatctagaaaagcgtcggaaaaaaaacgccgcacgatcgagactttgagcacggagaaattcaaaatgagggatgaaggcttgttctagaatgagccctcctaaaatttttcttaagaaaaaaacagtacggaaacctaaccagaaagcagctacaattggatcagctccaaaataggttgccattgcaatttctcgaaatatccctgtaatacgactacagaaagttccggataatatattaaaaattgaacgagctaaggaaacctcattgtcttttctgctcattaaaccgttttcccctcctcctttaaaacaagactatctcttcgacatttccccctatacttcttcagaaatcacaattggaggaagctatttcaagctaaataaagcatctttacagagctctacattgcgtttgagaagcataagtatcatttcataatctctatgatatcgacatagaaagaagcctttgtttcataacaccgtaaacgatacctgtcagcagcttttttctatataaaactgatgctttcttcttataaaaagagctttttatggatgattctttaaaatatattttttctgtattattgcgatactgcgcattcggttttgttcaaaactcaagaatatgaaattctgtgggggaagacatacgaaagttattattaaaatttttgaaaaattgaaaaagcctcaagaaatgagcagctcaatcaaaggacctaggtttcctctgaaactgggtagttaagaaaagaccttgaaattttatgaaagtacttcctcctccctccattcccttactaggggctcacacttcaactgctggtggactcaaaaatgcgatttatgaaggccgggatataggggcttctacagttcagatttttacagcaaaccaaaggcagtggcaaagacgggctctaaaagaagaagtgattgaagatttcaaagcagcgctcaaagaaactgacctttcttatattatgagtcatgcaggatatctgattaatccaggagcccctgatccggtaattttagaaaaaagtcggattggcatttatcaagaaattctggactgcatcactttaggcatttcttttgttaattttcaccctggagcagctctcaaaagctctaaagaagactgcatgaataaaattgtcagcagttttagccaatcggcccctttatttgatagttctcctcctcttgttgttttactggaaaccacagcgggtcagggaacgttaattgggagtaactttgaagaattgggttacctcgttcagaatttgaaaaatcaaattcccattggcgtgtgtgtagatacttgtcatatttttgctgcggggtacgacattacctctccacaggggtgggaagatgttcttaatgaatttgacgagtatgtcggtttatcttatctacgagcctttcatctcaatgattctatgtttccattaggagcgaacaaagaccgccatgcgccccttggagagggctatataggtaaggaatcttttaaatttttaatgacagatgaacgaactagaaaaattcctaagtatttagaaacccctggtgggcctgaaaattggcaaaaagaaattggggaacttttgaagttttcaaaaaacagagatagttaggaagttttttaagtgcttttagatcccgaagcaatccagtagatcttctgaaatcaaaaaaaacgccatactgatatacagttggcgttttctagaaaagattctaaatcaactacacttatgttctatgagataggaactcacaaacaacagaaatgttgataggtagaggcaattgagcctcgatttgatcttgctcaggagatacaagtaattcccctttaaagcctgtcttatctaaagaaatgtaagaaggcagagaactttcgtctttgctttctagggcatcttttacagactgaagtcgtttagatttttccttttaagagaaatctgcattccaggacgtaaaaagaaagagcgtctatcgactcttcgcccattaactaagatatgtccgtgagcaacaagctgctgagcagcaaaaattgtttttgcaaagcccatacggtataccatgttatcaagacgacactcaaatctttcaaggaacatttgagcaacatttccctgcttatgtataacttctttgaaagccttaaccagctgcttttccataatcatgccgtagcaagctttaagcttctgtttctcttccagttggagcccatagtcagactttttctttctctgcataccatgttgacctggaggatgaggcttctttaacaaaggatttcggcttctgccaaagatgttcgcaccaaaacgccttgccactctatttttagggccacaatatcgagccatgtatttcagtccttatatttaatccttggaaatcatctatgccccttgattttcatcctagggcaattttggcactattttacaaagctcaaggtgcggagtaaaataaaaataaaacgcacactcataacttgacaaaataccaaagagcattttagttctaatggcaattttctacaatgcaattatttccaagattatgttagagtatttatcatggaaaaaaaatattatgcactagcctattattatattactcgtgtggataatccacatgaagaaatcgctttacacaaaaagttcttagaagacctcgatgtctcttgtcgtatttacatttcagagcagggtatcaatggacaattcagtggttatgagccccatgctgagctctatatgcaatggcttaaagagcgtcctaatttttctaagattaagtttaaaatccatcatattaaggaaaatatctttcctaggatcacagtaaagtatcgaaaagaacttgctgccttaggatgtgaggtagatctttccaaacaggcaaagcacatttctcctcaagaatggcacgaaaaactccaagaaaatcgttgccttattctagatgtccgaaataactatgagtggaaaattggtcactttgataatgcgactctacctgatattcaaactttcagagagtttccagagtatgctgagaagcttgctcaagaatgtgatcccgaaaccactcccgttatgatgtactgtacggggggaattcgttgtgagctttactctccagttttattagaaaaaggctttaaagaagtctatcaacttgatggtggtgtcattgcttatggacaacaagtaggcaccggcaagtggttaggaaagctctttgtttttgatgatcgcctagctattcccattgatgagagtgaccctgatgtggcccctatagcagaatgttgtcattgtcaaactcctagtgacgcttattacaattgtgcgaacacagattgcaatgctctatttctttgctgtgatgaatgtattcatcaacatcaaggatgttgtggtgaagagtgctctcaaagccctagagttcgtaaatttgatagttcacgaggaaataagccttttcgacgtgctcatttgtgtgagatcagcgaaaacagtgaatcagcaagttgttgtttgatttaatacctattctggtttcttcatctgggagttgtaaaacttagaaaagtgaagaaaccagaacacatgtctcttaaaaaaaaattacttagagttgaccatataatacgtctcatcgctttccagggcattctctaaatgatttttaattttctgtgacaaaatatttgttactacgttttgtcggtaatttccatgtacaatgatatcagcatatttccgagtcggctctataaatttctcatgcataggctttaccatagaaagataacgagacatgatgcagtccacgctatctccttgttcttgaacatctcgaaccatacggcgtagtatcctttcatcagcatcggtgtctacaaagatcctaatatccataagatctctaagttcttgattttcaaagaccagaataccttcaacaagaataactttagatggatagatcgtttctatctccgttttagatcgattacctaaaacaaaatcaaaaactggggcttggacaatctcattattttttagacgttttatgtctgaaattaataagtcattatcaaaggcgtccggatgatcccaaattaaattggcacgttcttcaggagtataatgagatctatctttgtaataattatcttggcagataacactcacatcctcaccgaaaatttctttaatgttttgggttagggtggttttcccagctccagaacctcctgtaattccaataatcatcataagcatcatcaacataaatttttctccttagtacttctcttgtaatcagcacacaacaaaatgcgggtcctttgagaatttattgatttaaaaggagacaaaagaaaaagcttcgtgatcagaaattgaaatctttagatatagtcattttctgatcacgaagtttaggatagaattctatccaaaaaaatatttcatcccccaataaacaagggatgttatacaaaaccccaattcacgtatagatagatttaaaaaagcaaaaacactgtcagaatgccttataagaacgatttacggtatcttagatgtttcctaaaggagtacaagactccttatgcatgaggaaacactagagtataaatcactctttttttcccttctttctgaacaagttgtatcggatgcaagtcgataccttgttcttgtagtatggatgtaaatctctctacattcttgggtagtcccaaacatacaacactgacatcaggaaattttttcaaagatgttttcaggtgatttgcttgtagaacagcccaggcatcttgggcctcagaatcgttatctctaacactagagacaactgtgggaacacaccaagacaataaccacgctctccatcctggcactaatttttggtcgagaatgatgactctgcttctcactgttttggttagagcagctaaaacacgtcggatttccctataactttgtacggcaacaaaataacatttcgggctcgaagactggtggatttttaaatagtaacctagctgccgtcttaatatgatacccaacaacaggcgatagacgtgttctctccatatccataatgtccagatagagacagcgagcacaaaccaaccgatatagaaaaaacttgtttcaggagacaagcctaagttacttcccaaaactcggatcactcctgcagcgactaacactccaaagaaatctaaaaagttattggcagccaaaatttgccctctcttatgttccgggcttgcatattgtacataagcatggagaggcacttgatacaccccaccaagaaatcccagtgcgagtaaaaaaaacaacacgaatagtatcgaacaagcaaaggcatacagccccataaatacgagagctaggccgatagcggccaaagggacgtatcctattttgatatcttttcctgagattttcccggtgatgtacgaccccgtgcctacacctaacgccactataggaaacaagtaagcgccataatgcttaggatattttaaaataaattctacaaaagggatgatctctagctgagtataagcacctatcaataagaagaaagatcccaaaaaaatcgatacagtcaaataatgaatcatccgggtatctttcaaaactttccataaatctttgaaactcaccaaggtgattttctgtttcacatttttcacattgctaggtcggatacagaaggaaataagagtactgataatagaaacaataacacacattaaggtaggccagacatagctatttacacctaaacgatgagttacatcgacaagaagaggagcaaggcaagaacctaaaatacttcctgtataggtggctgctgtcataatcccgttggcttgggagagctgttctgagggtagcatttcgggaagaatcccgagctttgctggcccaaagattgtggtgtgacatgccattaaaattaagactacataccccccaactacagattggataaagaaaaagtacgttccgagaattgtacataaaatctctataaatctggttgctaagataatattccgtttctgaaagcgatctgctaaacttccagctagccggagctagtaaaagaaagggaagggcaaaaaagaaacttacacaggagagaatctttgcattctctgttagagttttgccttccaataggaaaaacgctaaaagaaatttatataaattatcgtttataatcgtcaggaaatgtgtagttactagtgccctaaacgatttttttttaaccgaaacagtcatgaatgccaccaaacattgtcgagcaagcttcagtaactcgccccgtcacctcctagctcagcttgcggaggatattacgtccacacatcaaaaaccttttaccaaaaggtggattcttgttgcaaatgctactacagggcactggataaaaaaccaacttgtacatgtcttgtcagaccacatctttatgggatcaactattttcactgcttcggattccattgtcaaacacttattcttgggttcgggttgctcgcagcccaatattccggactaccttacccttcccttgttaataaataatattttagaagaaatctcgaaggcttccaaatttgaaaatggaagggagtttttatctccacccacatacggnacaacaaaaaaacttgctgctgcgtttaagcagttccatacgttttcacaacgcccgaccaaaaacgcctcccattaccaagaattatttcaaatcttggaaagccatttttcttcttatgaagagatgttcaccactattttaaataatcgaacgcaagaggaggactgctcccttcatatttttggttatgctcatcttcccaaacatcttgcggaattttttattaatttaagtacgtatttccctgtatatttctattgtttttctccctgtcgagaatattttggtgatttactttccgatagagctattgatttcttttggaatcaacttcccgactccccaataaaaaatgcctgggaacactatgtattatcagacaggcaagcacttcttgcaaacttagctcataaatctcagtcgtcgcaaaattttttcctagatagggaaatagactatcaagagatgtttctcccttcaaaacacgatagttctttaggggtaatacagaactctattttagacctcaagcccacgtctcctcaagatttctctcaaacaaagcagaccatttgtatttatagagctctaaatattcccagagaagtccaggaggtattttgtaaagttacagaacttctgcatcgcggagtgtcacctgaggagatttttattctctcttctcacatagagagctacaaggtacatctaaacgctattttcaatcctcatgtgcctatatactttactgatgaagtagatccacgggctgaagatctcagaaataaaaatcctcctactttcttctattttacaaacacaaggggatttacattacattcttcaactccttacgcacccacaactacaacaacctatagatcaaaacaaggttccctatctgattaaaaagctttcctcagaatggggaaaaatttcttcaaaagaacgagcttcgggtcaacaaatgaaagctctaggtgatctgatattagaagaatacccattccatcaagagggtgggcgtgtgagccaagtagaagtttgggaaacaacagtacctttaatttatttcattcaagagcgtatcaacctttatctttccagctcccaacatagctatgaagatctatttcaaaacgtgttttcttgtttagaaaagatttttgttttatctcccgaagagacctctttcattacaacgttaaggaactctcttttcccaacctttgctacatcttcctgttctcttctttttttcactgatttctgtttagactttttgcttcatttccataaacccagtcccctgtatgacaagccaggaccttacataggtagtttgagtagcctcagcttaattcctaaaggctatgtctttattttaggagctaataaaacaacatcgtctgacatttttgatcttttaaataggacaacaacacatgaagagcttgcattttcttctacagaagacgaggaaaatttccacttcctacaaattttagtctctacaaaacatgaacttcatattagttatatatcatcggcagcgcaattcaaccttcctagtccctttctaaaccatattaaagacaccttagacctgcctgtagaaacgttacctacacaaccctacctctctgctttcttcaagaataaagcttgtttacacacctctcaagaatacaactactctcttgctcatgctttctattctaaaaaagctctcctcccttccttgtttattccaactgtaaagcaggtaaatcttcctcaacatctctctctcaatgaaattatcaaaggaatcttttctcctttagacctctttttaaaaaccaattacaatctcagaatttcctacccagaacaccttaaaaaacaacagaaactctttccaacaaaacatcaaatcgaagacttttggaatgaatgttttgtagacaaagagcatgacctgatccctagtatctctcctcatgctgaagagctttttacttactatagggaaaagacaatcctattgcgtaatggattggacaaagatccgaaacattcaccttatacagtcacattctcttcctcaattttcgaagagagaccctatcatgaaagttaccttttcccgcctctttctttatctttccaaggaaatccggtccaaatccatggaacaattcatggggtatgcaatgagggactttatttatgttctatagatcctagagattccctaaaaaaaacaaccagaaccctagggagtctcccagaaacctcttctgaacaaaaacagctcttagaaagatatgtagcgttggcggtgttacaaatgtctcagcacctctcttcagattcggctttaataaagcttacatcgttcaatactaaagaaaaccaccatcctcctttttcggatcctgaaggttatctccgtaaagttttagaagtctatcacctgatgtcttcgcaacccattcccctactatctccattatgttggaaaaccttagacgatgaagaaaaatttcatcaggcagtactttctgctataagtgaagaagctaaaaatccttctcttcctattttctggcagtttcacaatcgtaatatcgaggagatcttaaatcacgtgggtgcatccgaacgtttgaaaattttatctcttttcagaggtccctgtgaagccgtttaatatttttgactcaaactcttcgattcagggaaaatttttcctagaagcctctgcaggcacaggaaaaacatttactatagaacagatcgtgttgcgagccttgattgaaggctcgctaacacatgtagaacatgccttagcaattacatttacgaatgcttctaccaatgagcttaaggttcgcatcaaagacaatcttgctcaaactttaagagaattaaaagcggttctaaactctcagccggcttctttacccacatatttagatatcaattgcaatgtaaagcagatttacatgcaagttcgcaatgctcttgctactctagatcagatgtctttgtttacgattcatggcttttgcaactttgttctagaacaatattttcctaagacccgtcttattcacaaaaaccctgctctgacccactctcaattagttcttcatcacatcactaactatttaaaacaagacctctggaaaaatgtactttttcaagaacagtttcatctattagcagttcgctacaatgtaacctcgaagcatacatcttctctggtggataagctacttgccagctatacccaaccaatctcctcctacttttcctcacgtgttgaaagacttgagcaaatttctctttggcatcaacaaatatacaactctcttttagaaattccaaaacaggtttttctagatcagctaactgcccacatctcaggatttaaaaagcagcccttttccattcttgatgatctccatcattttgtggatctcctttacacttcggagacccatagctctttattttcattctttaaaattgcagaaacattcaacttcaaacaccgtcttgcacgttacaagccttgtgctgcctttactgttttagaaaacatgtcttgggtagagcgtactttagagttttgtaacttggatcgaatcttcaatactttgttagtcgatctccaagagtatcttaaacaaaattataccccttggctctctcccgatgaaagcgtctttgccctcgagaaactactctcttcatctgaagctcaacctgtagttcaagctcttagagagcaataccagctcgtattaattgatgaatttcaagatacagacaagcaacaatggagcatcttttcgaatctctttatttctccgaaatttacaggatcgttatttcttatcggagaccccaagcaatctatttatgaatggagaagtgcggatcttcctacctatcttacagccaaatcttcgttttcagaagacaagcaactacagcttgtcaattaattaccgctctacacccaaactcatggaagccatcaaccaaatattcgggaaaatctctccatttttagagatccctggctacctacctatagaataccatgcgctaaatcctcagagtagtgagacatttgaaaatcccccccacgctcctattcatttcttcttttatgaaactattaaagaccaggcattatggatattctcagaagcgctaagactacaaaaagaacaaaagattcccctagggaatatggttgtcctggtctcagactcaaatcaagcttttgagttaatttcctatgcgactattcctgtttccttttctaaaaacaaatctatatttcatcttacagaaactcacatactgactacagctctactagaagccattcttcacccggagaattatgaaaaaatcagcaagatattgttctcatctctttttggactttctttagacgaagtnacaacaaaaaaagaagactttacgatttatttccaatcactacatagctacatctcacatcatggacttctggctacattttaccgagtgatgactacgcaaggaaacgtattgttctcatctcctagaggggatcttatttttcaggaaatggagaaactttgtggttacctagatacaatttcttcttatccctaccaccaacttcttcacctgaaaaacttttctgaaacaggacggtgggaagaagaactcgctatatcttcttattctgaggacttggaaactttaaaaatcactaccattcactcttctaaaggtctcgaatacgatatagtcttttgtccaggaattgagaaaagtaaaaaaaataaaagctcttcagaattactaagagaaatgtacgttgcttgcacgagagcaaaaaaacagctgtacctacctataagcacgcaaccgccttctcttcagagaagctccgcattaacaaattacgtgaaattagaaggtacgcagagttcggcttatgacttagctatccacctacatcaagaacatcctgatttattttcgtattcgctacctaaggaccatggacatgctaccacagtgttgaatctgccacttttagagacgttcgctctaaaagtgacacccccgaaaactattttttccttctcatctacaaaattcctattggacactcacaaagactcgcaatcgatcccatattccaactcccgatttcaaaacaacagcttcctctgggagaaaaaacaggaattcttatacacaaaattttagaatctattcaattttctctattacaagacactgagtacttgatgtctacgatcatgcgtttcataaaacacactcatcttgaaggattcgaggaaacgattcttaaactacttagtaagacgtttttttctcctttaacattttcatcgcagacattttctctatctcaagttctaccgaataagatatttcgagagacttcttttttatttttagagaaccaagagctgtggcaaggggtgattgatcttttttttgagcatgaaggaaagtactacattattgactggaaaacatcgtttttaggagagacaaactccgattactcaaaaagcaacctatctatctacataaaacaagaaaaattagattaccaaggcaggatctacgtcaaagctgtcaggaagtttttaaatcaatttgaaattgatgatgatgtagagcttggagttatctttatccgtggcatagacacccaaggaaatgggtttttcgctttaaatagcagcgaagacattcctaacttcaatcccaaagcaatccaaaaatgtcaggcctatcattaggattaaattctaggggaggtaaaataaagagctgatccagctccataagcttttcttccaaagactgagcttctatcttgaaagtacaggctccatcacgaggagcttttaccttggtgactctagccaccaacagtcctgggggaaataccccatctaatcctgttgtcactaagatatctccaggtagcagagtttttccctcgctaaagtagaatccttctccctctaaacataaagacccttctttccataaagccccacccactccagaaagtattcctcttaggagagcttggttttctccttctccctgtattaaagaatctaactcttgtagctgagagattttttcatacttatccttttcaaggatataggcgtgtgaaatctgctctacttgtctgattagttctctaagactgtgttttatccaccaagactgaatatcaccgcgcatagcaactacagagggcttcattcctacatctgtgattaatcgtatacgggattggtgttctccaacataatcgacaagtcctactagaacatttccagaaagcaccggagaatttttcttgattccatgagtttttcctacattcacccaacaagaactagaccaatgtgtgtaatctcgatagacaacctttccctctaccaacttatgaaaatagggagttaagatctctggaaataaaggaggagtgtgattagagacctcataaagtttgagtttctcttctaaagaagccaccctctccttaagaacgaggttctctaattctaaattagcaagatgagaagaaggagcttgtttaattttagggaaaaatttgacgtgtagagagacaaaactgcttctgatcttatcatagacctcttgagggatgcttcgaaaagagagaatccctaaagcaataataatatagacgcagatttttgtttttttattgcgtaggctatagctcataagcttgaataaaactttgcactacatgatctatatttttttccgtaattccatttaaattcattcttcctcccgctgttgtataaacagcgtgttgttctcttaaaaagagcacctgtttatcggaaaacccagggtatgcaaagaatccatgttgggacaataaaaagtcaaatgtatgaccggcaaccttacgcaaagcttgaacaaatcttgttctcattttacccaaagactctcttataaaattgagttctgattgccattcttctttcaaatatggattactcaaaattgtagaaacaatttctacaccccaacgttgtggtgaagagtattcccctcgaattttttcttctaagaaactgtgaattttaaccaactcatcagtaaaagtactgtgaacagcaaaatatcctacacgctcaccataaagagcaaagtttttgcttgatgaagcagcgacaagaaccgtatttccctctgatataaaaatttctataggttttctatccaactctatgccgtgagcaaaaccttggtatgcggtatcaaaaaatggaattaactctctttctttcattaagatggcgagttctttccacatatcttcagtaaaatctacacctgtagggttgtgacaacaaccatgcaataagataacggaattcttttctacttccttcaaaaatgcgatcaggggttcaaataacagctgtttttgttctttgctataataaggatatcggattacctcaagaccctcttgagagaaaatgcgtatatgattgctccaagtctgctcgggaacataaaccttaccagatccttttgccacggaaagaagccgggctcccaagtgtagcgctcctgtacctcctaaagactgaaacccgactatagcactcggatctacagcaccaaaaaccagctcacgcatctcatctaaaaatatttgcaaccctgaaataggaagataactcttattttgttcttcttccaaaatgacagtttgtgccttacgtatacaagacaagccgccgtaacgcttttgcggatgctcataaacaccaatcacaaggttaaccttttcgggacgcttatctgcaaagaaaacgttctgcaaacctaaaatagcatccggagaaaatgttggtatgtgattaaaaaaactcatatatgactacacctaattataacaaagattgattctaaaccctggaacatgatacttttttgtatcttttggggtattagctcagttggtagagcgcaacaatggcattgttgaggtcagcggttcgaccccgctatgctccatgttcttcccaaatggattgtatccgagaaatcttatactcctttccttgcagtattaccacgtcattcaacttcttccctaacatgttctgcgcaagcttggattgtaaagaaagtatacaactatctggatcggcatcccaaggtcctaaaattgtatactccacaacctctccagcatccccttttaaagtaactttacagccaacaccaactttatctgtaaagacaaggtcttttgtaagaattctcgcccgattaatttcttccgatagcacgcgaatttcttcttgtaagcgagctctcttctctaaagcaaacttgtactcagaattttcccgcaaatcccctaaagaacgagcatcttcaatttccttagcattatcaaccatctccttgccaacaagagattgtagcttggctttcattcttgaaaaactctcagaagtcgaccataaaacattttcttcttctacattagacttgtgcttttttagcgttggctgaacaacttcagcaaggctttgtaaaacgttcaaatcagaagaagaaaactgcgggcatttggtggatagtaatagtaattcttttaaaaagggaagggatgcgccttctatcatctgacgcacagcgagatacctttgccccaccaagtagtggtgtaacttttttcccagttctttatgaggtgtagangctacttgatacataaaattcaaagctgactctaagaacaatcttaagacttccttgtcttcaggatcaaagagaccatcttcatggttcccaagcttcaagaaaaaccaaacaaacagctcagggaacatcattggttgatgggcactatctagaagtcttttctttaaaacctctacgcttgatggatcgtttttaatggttttatatacaaaatccctcatggttggagaggtggtataaagaagaatttgcataaaaacttgttgccagaaggaagagtactttcttaccaaagacaaaaaggacttttgcaaagcaacaataggcatgttttccaaaagacgactggtatcatcttctgataaggatgttatatactctttgtctatgctcgcatccttaattcccaaatactcagaaagaagcagttctctctgcaaaattaaagacttattaccttcctcaacatcaagatcttgcaaagctttaactagactcttgcgaatctctatatttttcaattcactatgcaaatctctaataaaatgatagatcagagagatcttttctgcgctattgagactcaatcccaacttacgctccaactgtcccatatgagaacaccctgcatcagataaaacatagggctctttaggattgtctggggatataattctagttccctttttaatcttagtcttagctgattgccaccaccgattccaatctgcctcaggaatcacaagatcaactaactcgtctttgatttcctttgcggtctttggtccaagatctctaaggagaatctcaacaacttcaatagggttttccttagcaaaagcctcaaacccatcgggatctccaaaccgtcgtgaaaggaagtgatcgccgctcaaaggagttaaacttttaaatgccgtctcgaaagaaatatccttggcactcataattccttcaaactctatcaacaccttctgctgaagaaacgagacccccataacctcgccaacaccccaacccccttgatggaagacaaagtttcccttatgcatatgcatcaaaaaatcaaaacggctgaggctaaactgaaaatcacgaccatcacgaagcccaacaacacgcaaagcctcgttaaagttttcttctccactgtactttttattcacatattcagtggctatatcaaaaaacatctggctgttagatgtttgcaaatctaaaattaattgaagaactcgatctttatcctttccctcgggtattttttcccaaagaggaacgacggtatccacaatctttccaaataaagatgctaaagaggaagactttactttttctaggatctcaacaagctcccgcccccgcactacatcgttaaaacaatactcctcccaaaggcttaaaaagttcgcagattggccttcttctattaagacttgcaacttttctaaatagtccacgatgtctccagtttttaacctaaaaatatactcttacgtatgaaaaagagcaatatcacaatacaaaataatcaaacttattttataataaactaaaatgatggtgattgttatgaatagtaaatctgcgcaaaaaataatagattctataaaacaaatcctaactatttataatatagacttcgatccctcctttggatcctcgttatcttcagattctgatgcagattacgaatatctaatcacaaaaactcaagaaaaaatccaagagctagacaaaagagctcaagagattctaacacagacaggaatgtccaaagaacagatggaagtctttgcaaataatccagataacttctctccagaagagtggctggccttagaaaaagtccgttcttcttgcgatgagtatcgaaaagagacagaaaatttaatcaacgaaattaccctagatttacatcccacaaaagaatcaaaacgcccaaaacaaaaattgtcatctaccaaaaaaaataagaaaaaaaactggattcctctataaaatcacttataatcccgattgaatgaaacacccaaggacagagtccaagggacttcccttttaaatttttatgaaaattacagtcaatcggggtttagatttatccttacaagggtctcccaaagaatctggtttctataacaaaatcgatccagaattcgtatctatagacttaaggccattccaacctttatctcttaaacttaaggtagagcaaggagatgcggtctgttcaggagctcctatagcagaatacaagcactttcctaacacctacattacctctcacgtttcaggagtagttaccgctatacgacgtggaaataaacgttctcttttagatgtcatcattaagaaaactcctggtcctacatctacagaatatacgtatgatctccaaactctctcacgttcagatctttccgaaatctttaaggaaaatgggctctttgcattaatcaaacaacgtccttttgatattcccgcaattccaacacaaactccgagagatgttttcatcaatttagctgacaatcgtccttttactccaagcccagaaaaacatctggctctcttttcctctagagaagaaggattttatgtatttgtggtaggagttcgagctatagctaaactttttggactccgtcctcatatagttttcagagatcgtttaactctacctacgcaagaactaaagacaattgctcaccttcataccgtttcgggaccattcccctctggatctccatcgatacatattcacagcgtagcccctattaccaatgagaaagaagtggtattcacactgtcatttcaagatgtccttactattggccatcttttcttaaagggaagaattctgcacgagcaagtcacagcacttgctggtactgcactaaaaagttctctaagacgctatgtgattactacaaaaggagctagcttctctagtttaatcaatcttaatgacatctcggataacgatacattaattagcggagatcccttaacaggaaggctatgcaaaaaggaagaggaaccctttttaggatttcgagaccattcaatttcagtcttacacaacccaacaaaacgggagttgtttagctttttaagaattgggtttaacaaaccgacatttacaaaaacctatctctcaggatttttcaagaaaaagcgtacctatacgaatccagatactaacctccacggagaaactcggccgattattgatactgacatctatgataaagttatgccgatgagaattcctgtagttcctctgattaaagctgtaattactaaaaattttgatttagctaatgaactagggtttttagaggtttgtggtgaagatttcgccttacccactcttatagatccatctaaaacagaaatgcttaccatagtcaaggaatccttaatagagtatgccaaggaatcagggatcctaactccccatcaagattgattttttgttcttcaaagaacttaaaattcaaatccctgatgcagtaattccaaaataaaaggagcggagtaactaataatcatatctgcgccagtctcttgattgctatcaaagactcatgaaatagtgtttctttatctaaccaaccttgttgaaaggctgataagatcatagcgtattccccactgacctgatacgcagctagaggcaaacaggtattttgtcgaatccgatagatcacatcaagatagagtcctgcaggcttcaccattaagatatctgctccctcctcctcgtctaaagaagattcaagcaatgcctctaatacgtttttagggttcatctgatactgttttttatctcctgaagttacgtgagaactcagcgcatcacgaaaaggagaatacaaacaagaagcgtactttacactataagacattatagaggtctttgagtagccagactggtctaacttagagcgaatgtagccaatccttccatccatcatatcactcggagctacgatatccgctcccatttcagcatgtaaagttgcaatatttccaaaaattctaacactttcatcattaaggacctctccattaaggaaaatcccatcatgaccgtgtgtcgtataaggatctaaagctatatcactaatcagacataggtgaggaaatgcgttttttatttcatgaatgctatgacataagatgtttttaggatttgaggagtaagaaccgtaagcatctttaagatcatcaggaataatgggaaacagcattacagctcgtaacccgtaggtacacaaacgctctatttcctttaatagcaaatccaaactccatcggaacactccaggaagactcgggatctcttcctttatgttatttccatacttcacaaagaatggtgctatgagatcttttgggcttaagtgagtttcggccaacaaatctcttatagctgctgtctttcggtttcttctaggacgtctacttagtgttaaagaactcatttctcagatcctttcaacagtttccacaggtcctaaatatatattgttatatttatacataatattctcttcttctttagggggtgtggaaactgtttaaaactttgtttttcgagggaagtttatgtggttttgttgttcaaaactttgttaaaacattgttcattttgttgataagtgaggattttgcatgtttataaacacaagatcaaccctttttctacatcaatttttcaaagaaaaataggatgagggaatttttgttagttgtgtagaaactgtgatcttttggctttgatttggataaaaaatttctgttttctctctgttttttgtatgcaataggttgtagaattacaaaaatttctcttgtgatttcggaggtttgaggtgaaattttttcaccgatacttggttacaaaaaccataagctaaagtatgcttggggtcataagcgacgttatacgtcgtgctcccctgtagggatgaggcgcgccaatcgtcgaagcaggaatccacttaagcaagtttatattatccgagtatattagtagttttcgggaagatgtccgttcagttttgaggttttcatgttgggcaaagaagaagagtttacgtgtaaacaaaagcagtgtttgtcacattttgttaccaatctgacgtccgatgtatttgctttaaaaaatcttccagaagtcgttaagggagctttattttctaaatactcccgttcagttttaggtttgcgagcacttttgttaaaagaatttctatctaatgaagaggatggagatgtttgtgacgaagcctatgacttcgaaaccgatgtacagaaagctgcggacttttaccaaagggttcttgataattttggggatgattctgtaggagagcttggcggagcacctggctatggaaaatgtctctattttggctgctaaagttttagaggatgctcgaattggcggatccccgctagaaaagtccacaagatacgtctatttcgatcaaaaggtacggggggagtatttatattaccgagaccctattttgatgacttcggcctttaaagacatgtttttgggtacttgtgattttttattcgatacctattctgctttaatccctcaagttcgtgcctattttgaaaaactgtatcctaaagattctaaaacacccgcatctgcctatgccacatcattacgagctaaagttttagattgtatacggggacttcttcctgcggcaactttgacaaatctaggatttttcggtaacggtaggttttggcaaaatctgattcacaagttacaaggtcataaccttgcagagttgcgacgtttaggagatgaatccctaacagagcttatgaaagttattccttcatttgtaagtagagccgagcctcatcatcaccatcatcaagctatgatgcaatatcgaagagctttaaaagagcagctcaagggacttgctgaacaagcaacatttagtgaggagatgtcttcttcaccgagtgttcagttggtatacggagaccctgatggcatttataaagtagctgctggatttctttttccttattcaaatcgttctcttacagatctcatagactattgtaaaaaaatgcctcatgaagatcttgtacagattttagagagcagtgtttctgcaagagaaaaccgccggcataagtctcctcgtggtttagaatgcgtagaatttggctttgatatacttgctgatttcggtgcataccgcgatttgcaacgacatcggacgctgactcaagaacgacagttactctctacacatcatggatacaattttcctgtggagcttctagatactcctatggaaaaatcttatcgagaagctatggagagggcgaatgaaacctataatgagattgttcaggagttccctgaggaagctcagtatatggttcccatggcttacaatatacgttggtttttccatgtaaatgctcgggctttgcaatggatttgtgagttacgctcacagcctcaaggtcatcaaaattaccgcactatagctacaggtttagtgcgagaggttgtcaagttcaatcctatgtacgaattatttttcaaatttgtagattattctgacatagatttaggacggttaaatcaggaaatgcgaaaagaaccaacgacctaagtctctagatctgtaattttagatattgtaaaaacataatctttgcatttacaggaacattctctactggtatttttattcttttttcatgaagagatcataaaatgaaagatcttatatataataacttggttaggtttaaaaacatttctaaaaccaaaacttcaaggtaaagggtgtcaaaggaggagcctcatttacagcttctatagctgtagatatagactctgcggatttatcttccgaggattctatggaggttattatagaaaaatgtgctcagattggcgttgctgaattccaaaaatgcgaattccaatttgagggtattacctgtttgtagaaatctagtttcctgggtgtagcgcacctggtagcgcacttgcatggggtgcaagggggcggaggttcaaatcctctcatccagatctctctcggggatgaagattttatcttcatcccttttttataagaaattttgttagtaaagatagaagccaaggtggctgtaagtttaaaatagcaccttagaatatccttgaagatttaaaaagatcctaaactcgagataatcgtttcgaattcagaactattctttaatccaccagcactgagacgatccaagagctctaagcaattgttttgagatcttgctaatagctctagagcggccttttctccaaatagtaaagcataatttagcccaatttgttgggagtctttttgtaaatctgaaaaatcatcttttatttgaaaaagtaagccaaaattatttgagaaacttgtaattataggtgcaaattgtgggtctccgccaccaaataaccaaccagaaatacatgcaatctcaaatagagaacccgtttttttgatcataatagattgtacgtgttcttgacctcggttagaaaagaacatatcatcatactgccctcctaataccccagaacatccaatatttttgtctgtaatatctccgataatgttgtaagcgatatctatttctctaggatcacagccctgttcttttaacttctttgcgtttaagcgaaggtgggagtaagcagcaggaattagggcgtaagatgcgagtaaggcggttgcttcatcgaaagctttatgtaccgtcgggcgtcccctacgctcatcgtcgttgtccatgcaaggaagatcgtccgcaattagggtggaagtgtggacaaactctacagctaaagctgagtccataacgtcatgatttaagcccaaaccttgagccatcatgcagactaaaccaggtcttaaacgctttccaccgccctgtaaagcgtattctacaggagagcgaatcgggtgacctataggaccaaatccttccaaagccttttctatagcactttctatagaaggtcgatacgtatctaaagcatgtaacacaagagtcccctatttttaaatgacttgaccaggacgaattctagtatgagggagaatatgttggcctggattgatgacaacattgcatcctatagcaaccccttttcctaaaaaggcaccaagtttacgacgccctgtatcgattttttttgatttatctgaggtagaacgaacatagatgttccttccatctagacggaaattagcacaacgtactccagcacctagattgacttctgaacttaacacagaatctccgaggtaagcaaagtgagcggctttcgtatgatgacctaaatagctattcttgatttcagtacagtgacccacaacacagcgactgcctgtgatgacattgcctcgcagataggccccatgacgaacttctgtttgtgagccaagaatgcatggtcctacaatgtaagccccagactctacgtaggcatcttcagcaatctcaatcttttctatattttttaaagttacaccagactctacagtaccatgaatcccagaaaacacgtggttttccagcatctgatccattaaatcaagaatatcccaggtatagtgagctttggagattatctcaggatagagaaagtcctcaggagaaaatatagacgaggctagataagtcatatagcatactcaagctatttgcctcagtattttcatactctgaagatttacttacaagatataaagaacttactttactcttcgattggatgcgctgtattgtcatgattctggagaggaatactgtcagcatctgaaaatagatagcctacaccacgaatcgttacaattttagatccgtagggacctaatttttttcttaaagaagcaatatggacatccacgttgcgagcaatgatttctttagtatttcctttaatctctgctaaaagattctttcggagacataggtgtccacggttgataaggagttttttaagaatacctgcttcagaaggggtaaggtatacgcttccttctggagattctatcacgagattcaagactcggaatgtatgatctccaaaagtcattgtatctggaatgctatgctctagaacttcgtgttggcgtaggaaagctctgatcacggcatctaatactttcgctgtaataggacggagaagataccctgttgctccttgatttaacacctttgtgatcgcctcttcttgaaatgtatcgaatagaacaattaaatcttcttctggaaagatcccaggagagaaaatttgctcaggtagcaataggtattcacaaaatatagcaacagattcaaaagatgtcggaaacaccggagatacgagtatttggtaatcagatctttgtgatgccaagtcttttaattgcgaagataaactgagatcctcagtaacaaacaatatgattttatcaccgatcatatgaaaacaaaatagattatatgaatgaatacgtaatataaaatcagttatttttcaaaggtcacttacacttttttacttttttcttttttgaaaaatagttttgcataaacacaacactatatatataatttaaaattaataatttagaagcgacatagttttttaacttctttgaaggccgttcaggacgtaaatgtttcgttgcatattgtttggtattttcctactcacgtgtttttcttctggcggggtgttatattacttattctgttcccatgatttttctatagggcctaaggaaaaatcacgatccgtgtggattgaggaagaaaaagagttcacggattccgtattacatcatctgccatcgcaacatcagcatttgcatattctttgtttccaagggtttttactacagaagcaacaaaagttttctcaagcagaaaagattttctctaaagtttacgacgaggctcaggacggtccttttctttttaaggaggaaattttaggatcccgactgatcaacagtttttttttagaaaaaacagacgtcatggagaccattctttgtcttctgaatcagcgctgtcccaactccccttactaccacttatttaaggctctagtatgctataagcaaaagctataccgtgaggtcatagagcaactagcctactggcaagaagagaaaactcgagcgcttgctcctttattgaatataagtattgaacagctgctaacagattttctgttagattatatttctgcgcattctctgatagaacagaaaatgttccccgaaggcagagtaattcttaatcgcaatatcaataggttattaaaacacgaatgtgagtggaatgcgaagacatacgatcgtattgcgattcttcttagccggagttattttctagagttggtagaatctaagtctgcagatatttattttgattattatgagatggtgcttttctatctcaaaaagatctatattttagagcagtgtccttatgcagaacttctccccgaggaagagcttgtttccttgattatggaacacgtgtttatccttcctaaagataaattatatcctttaattcagctcctagagatgtggcagaagcattatgttcacccaaatagttctttagtagttcagatattggtagaccgcttttctacacatatggaaggggctattcggttttgtgaggctttagtttctttctctggattggaagaattacatcagcaaattattaccacttttgaagagctgctttcaaataaagtacagcagataaaaactgaagaggctaaacaatgtgttgccctacttcatattttggatccttctatttccattagtgaaaaattagctctttcttcggatacattacaaaatatagtttctggggacgacgagcagcatacaaaactccgcaattacctagatctttgggaagccatacagtcttatgatattgatcgccaacagctcgttcatcacttagtttatggtgcaaaagatctttggaaaaaaggaggatctgatgaaaaggcattgaaccttcttcagctggtcttgaggtttacaagctacgatatagaatgcgaaagtgttgtgtttctttttataaaacaggcgtataagcaagcactgtcttcccatgccattgctcgtcttttaaagttagaaaaatttatatcggaagcgaatattccctctatagtgattagtgaggctgagaaggccaatttcttagcagatgctgaatatctttttgctcatgaagactatgacaaatgctatttgtatagcatgtggttgactaaggtggccccctcccctcaatcctatcgcttagcagggttatgcctgatggaaaataagcgttacgacgaagctttagaatttctctgtatgctctcacccaatgatagtatcaacgactataagacgcagaaggcattagcattttgccaaaaacatcaatctaaggaccgagctgcctcttagcattctccccccatcttttcactcttaaagtaaagagtttttgtgtagtaaattttttatagttttgcttaggaactattctccgagtgtttaggaaaagattttcgaatcttcatgcattcatgttatgttagactctataacggaatcaaagtagggatgggcattgcacacagaatttgctccttttttagaagacttagtacatcagcaggtgatatcccctttagacatcgcttttgcttctaagcacatctcttcggactttgaagagtcttttgtttttctcgcggtctcctcagcgctttggcgttatggtcatccttttctttcccttgaggaaaatcgcattagaccttctctaggagggatctcagaaacagatttgtatcggggatttcataaccttcctaaggaagttcgagataaattatttgtcgttgtttcaggacgtttgtatttacggtctctgtatacgatacgatcgaaactcttagacaagctttcgttgctttgttcagcaaccccgaattattttcctccttctatagattcttcgatcctttcagaagagcaaaactttatttttaataaaataactcaaggatgtttttctatagtttctggaggcccaggaacaggaaaaacttttttagctgcacaactcatcctctctttagtgaagcagcaacctaagttacgtattgctatagtatctcctacaggaaaggccacgtctcatattcgtcagattcttatgaaatataatatatttgacgacatggtgttgatgcagacggtgcaccactttcttcaggagtatgcgtaccgtcgctataactctatagatgtccttttagtagatgaaggctctatggtaacttttgacttgttgtatagtttggtacaaaccctacagggatatgagaaagacaaaaaactttatacctcgagtttaattattctcggagataccaatcaattgcctcctattggcattggggttggaaatccccttcaagatctcataggatatttcccatgaaaatacgtttttcctgaagacatcgcatagggcaaagactggagttgtggatcagctgactcaatctgtattgcgtggcgaaatgatttctttttctcctctcccatcgatatcctcagctatagaagtcttgaaaaatcgttttgtaaagtcgttacgtcaatcagaagcacgtttgtgtgtattgactcctatgcgccatggcccttggggggttctgaacttaaacacaatgatacatcaaagattggcgagaagcgatcctgatttacgtattcctattatggtgacgagtcgttatgaaacttggggactatttaatggagacacaggattactgtgtttaaaaactcagaaattgcatttccctcaacatgaacccatagattctagggctctatcacaatacgtctacaattacgttatgtctgtacacaagagccaggggagtgaatacgatgaggttattgtaattattcccaagggaagcgaagtgtttggggtgtctattctctatactgcaattacccgagctaaatatagagtttcagtttggagagatcccgagacgttacataaaacaattaagaagtctaattactagattcttatcaaaataaaaaaaccctcaaagaatactctaagagggtttttttgctgcgaatgtcgttaaaaactatcctattttagcataatctttaacaaagtttatgacacagctaatcaatccaagaatagccataattagaacagcatggactccaagaatagcaggaaggaatagagaaagagtgccaagagcatcacaaactaaatcaactacatctccaagccatgcaatgaaggcgtttcttatagctttggaacgtgctgcgaattcggcagaaggcttgtttctgttttcggggtcggagattgtttcaggcctggtgcttaaaattctgtaaagtgaaattgaactctcagttaaagagcatcctgtagccactaagtttaggcaggaagtcaccttacatccaattttgtttgcattggctcctaaggaaaccacgtccatttcatgtaagaatgtagctgttccaagagtctttgatgctaaacgagcaacttttcctgtgatagttagggctgatcgtcgttgtagtttttgagtcatacaaccctcagcatctgcttcgttgcaacgtctgagttctcctgtttcctcatcagtttcgaagatcatagaaccattaagtagttggccccacaacatagctcctgccactgcagtgttcactccgtcagcggcacccagaaacccttcagttttctgcaaagcagcatgtgcataatgggagcttcctaaagcatgtctagagattgctgtggaatttttaattgctccgacgatgtcgccggcaaacaaaacgttattgtgtagagacattgattgctgtctgaataaattgcctgaagctctgattgccggagtccaagatcttaaatgcagaagtgcttgtctaccaagatgtgctgttgccataatctacctaattattagattgttttaaggtcacgatgctctcgcgttaacttttaaggttgctttagatttaatgcgtgctgccttattatctttgaagatacctcgctttacagccttatctacaacactgtagacggattgtaagttgctaagagtggcttgagtgtcgtcgagttttaaagatgcttcaaactttttgactattgttttcactttagatttgaagctgtgattgattaactctcttttttgagcagttagaatgcgtttttcagcagaagtcttctttgtataacgttttttttattcggttttttaggtgccataatatctccagacaagacaagaactttaagatttaaaataaactgctattaattgcagatcaattgagagagaaaggaaagctttttcttattttcgatacacatattaagaaaaaagagaatttatgagaaataaaaaaagttttatgccaacataacaataagaatggtcttaaaaaaatacttttctaatcaaatagaacttatggctatgaagagcaatttattcttatttttgttgatataaggatttattttttatgttattggtaaggaaatggttgcatacttgtttcaaatattggatttactttcttccggtggtaacgctacttcttcccctagtgtgttacccttttctgtcgattagtcaaaaaatttatggatactttgtttttactacaatttcttctttaggctggttttttgcattgagacgtagggaaaatcaattaaaaacagcagctgttcagcttcttcaaacaaaaattagaaaattaacagaaaataatgaagggttaagacaaattcgagaatctcttaaagaacatcagcaagagagtgctcaactgcaaattcaaagtcagaagcttaaaaatagcctatttcatcttcagggtttacttgtgaaaactaagggagaggggcaaaaattagaaactttgttacttcatagaacagaagagaatcgatgtttgaaaatgcaagtagattctttaattcaggaatgcggagaaaaaacagaggaagtacaaactttaaatcgagagttggctgagactttagcctaccagcaagctttaaatgacgagtatcaagcgaccttctctgagcaacgcaatatgctggataagcggcagatctacattggaaagctggaaaacaaggttcaggatttaatgtatgagatccgtaacttgcttcagttagagtcagacatagcagagaatattccttctcaagaatcgaatgctgttacgggaaatatttctttacaattgtctagtgagttaaaaaaaattgcttttaaggctgaaaacatagaggcagcctcttctttaacagcatcacgttaccttcatacagatacgagtgtgcataactactctttagagtgtcgccagttatttgatagcttaagagaagaaaatctcgggatgctttttgtctacgctcgtcaatcccaacgtgcggtttttgctaatgcgttatttaaaacgtggacggggtattgtgcagaagattttttaaaatttggtagtgacatagtgatttctgggggcaaacagtggatggaggatcttcattcctctagagaagaatgctctggtagattagtgattaaaacgaaatcacgaggtcatcttcctttccgttattgtttaatggctttgaataaaggccctctttgctatcatgttttgggggttctttatcctctccataaagaagtgcttcagagttgatactatttcttcttctatgaggaaagttgtatcaaattgttggtaagatattgattttcgtcagcgtataagataaaaatccctagatttcctatcttcctttgactaaactgtcctctaaggctagaaatccccttgttttattccaagtaagaaagttgttcatgaatacacagaatagccaagctacagaagtttcatcagaagaagaatctcaaaagaagttagaagagcttgttgctcttgctaaggaacagggtttcatcacatacgaagaaatcaatgaaattcttcctatgtccttcgacactccggagcaaattgaccaagtgttgattttcttaactggaatggacattcaagttttgaatcaaattgatgttgaaaggcagaaagagaagaaaaaagaagctaaagagcttgagggtttagctaggaggactgaagggactcctgacgatcctgttcggatgtatttgaaagaaatgggtacagtacctctccttactagggaagaagaggtagaaatttctaagagaatagaaaaagctcaagtacagattgaaagaatcattttacgcttccgttattctgctaaagaagcgatttctatagcccactatttgattagcggcaaggaacgttttgataagattatttccgagaaagaagtagaggataagactcactttcttaagttacttcccaagctaattaccttgcttaaggaagaagatacgtatttagaaaacttattattgtctttaaaacagcctgatttatccaagcaagaagcagctaaattaaatgacagtttagagaagtgtcgtattcggacgcaagcctacttgcgttgtttccattgtcgtcataatgtcactgaagattttggcgaagttgttttcaaggcttatgattctttcttacacttagaacagcaaattaatgatttgaaagttcgtgcagaaagaaataagtttgctgctgcaaagttggcagcagctaagcgtaagttgtataaaagagaagttgctgctggaaggactttagaagagttcaagaaagatgtacgtatgttacagcggtggatggataagagccaagaagccaaaaaagaaatggtggagtccaatttacgtctagtgatttctatagccaaaaagtataccaaccgtgggctttccttcttagatttaattcaagaagggaatatgggcttgatgaaggctgtcgagaagtttgagtatcgccgtggttataagttctcgacgtatgccacctggtggattcgtcaagctgtgactcgtgctattgcggatcaggcaagaacgatccgtattccagtccatatgattgaaaccatcaataaagttcttcgtggagcgaagaaattaatgatggaaacaggaaaagagcccactcctgaagagttagcagaagagttaggattaactcctgaccgtgttcgggaaatttataagattgctcagcaccccatctctctacaagccgaggttggagagggtagtgaaagttcctttggggatttcttggaggatactgccgtagagtctcccgcagaggctacggggtattctatgcttaaagacaagatgaaagaggtcttaaagacgcttacggatcgtgagcgatttgttttgatccatcgttttggccttcttgatggcaaacctaagactttagaagaagtgggttctgcctttaatgttactcgtgagcgtattcgtcagattgaagccaaagctttaaggaagatgcgtcatcctattcgatcgaaacaattgagagcattcttagacttattagaggaagaaaaaaccggaactagcaaagttaagagtttgaaatccaaatagtctttgagtaaaaggttcgttttttatagccttgtataaaaaatattgctctggtgattgctatagaacgttatcagttaattatatccaagtttcgtatgtggttgtttttagggtgttctgttgaagagcgtcattttaagcagcctgttcttatttcagtgactttttcttataacgaagtcccgtctgcttgtttatccgacaagctttcagatgcttgttgttatctagaggtcacctctcttattgaagagattgcgaatacaaagccttatgctttaatagagcacctggctaacgagctatttgatagcttagtgatatcttttggagataaagcctccaagatagatctagaggtagaaaaagaacggccacctgttcccaacctattaaatcctataaaatttacaattagtaaagagctatgtccgagccccgttttgtctgcttaagtttaggatcaaatttaggaaatcgttttaaaaatctacagattgctcgtactttattaggcgaacaagctgttttaggtctacgtagttcggtaattctagaaacagaagccttgttattaccgggatctcctccagagtgggaccttccttattttaattcggtacttgtaggggaaaccaccctatctttgcgagaactactggttactatcaaacagatagagaaggtggtaggtagagcagaggagtcgcccccatggtctcctcgaaccatagatgtagatattttgctttatggtgacgagtctttttgttgtgatcacaccgagataacgattcctttgtccaatttgttatcacgtccttttttgattgctttaatagcatctctttgtccttatcgtcgattttgcactcaaggttctccttatcacaactttacatttggagagttggcgcatcaccttccctcacctccagggatgattcgtaggagtttatctccagatacgatgttgatgggggtggtaaatgtgactaacgactctatgtctgatgggggcatgtttttagatccagaaaaagcagtggctcaagctgagaagttatttacagagggcgctgcagttatagattttggagctcaagcaacaaaccctaaagtaaagcagtttttatctgtagatcaagaatgggagcgtctggagcctgttttaaggttgttaaaagagacttggtccaatagaaaacaatatccaatcatctctttagatacgttttatcctgaaattattcttagggctatggatatttatccgatccagtggattaatgatgtctctgggggatcacagtctatggctgaggtcgctagggattgtgagctatccttggttatgaatcactcgtcttcgcttcctgtggatcctaaaaatatcttgtcgttttctgtccctattggagagcaactgttgagctggggtgagaagcaacttaagatgttttctgatgttggtctgaacgcaaatcaggtgatttttgatcccggtataggttttgggaaaggggctgcgcaatctttggctactttgtatgagattgcgaaatttaagcgtttgggatgccctatccttattggacattctcgaaaatcgttcttatctttatttggtaatcatgatcccaaggatcgtgattgggaaaccgtaggtctatctatactcttacaacaacaaggtgtggactacttgcgagtgcataatgttgctgctcatcaaaaagctttatcagtagctgcttgtgaagcctgtgcacccatctaattttgaaaatcctctaggtgtcgagatgtgtaaaaatagaggggtccgcgggatcgtggcttgtgatcctagaggggtgataggtttagaaggaaagcttccttggcattaccctgaagatctccaatttttttctgaaaccatacaaaaatttcctattgttatgggaagaaagacttgggaaacacttcctaggaagtattttgttgatagagcagtcgtcgtgttttctcatgaaaaacgacagggagtgcacggggagatctgggtaacttctttagaagaattcctgctcttagatctttcttcgccgacatttttaatcggtggtggtgagctttattctcttttcttagaaaatcaaattgttcgagatttttttatttctcatatcaaaaaagaatatgctggtgatacatttttccctttgtccttgctagagacatggaccaaaactgtgcttagagatacccaaaagatcacaacgtgttactatgaaaatcaccacagtcaaaacaccaaaaatatatccttatgatgacctatattctattctagagtcttcattgcctaagttaaacgaacgctctattgttgtgattacgtctaagatagtctctttatgtgaaggtgctgttgtagaacttgagaaggtttctaaagatgaattaataaagcaagaagcagatgcctatgtttttgtagagaaatacggcatatatctaactaagaagtgggggatactcattccttcagcggggattgacgagtccaatgttgaaggttattttgtgttgtatcctagggatgttttgctttccgtgaatactctaggggattggttaaggaatttctatcatctcgagcattgcggaatcattatatcggatagtcatacgactccgttgcgtcggggaactatgggtttaggcttatgttggaatggttttttccctttatataattatgtaggaaaaccagattgttttggtcgtgctttgaagatgacttatagcaatttattagatggtttatcggcagctgcggttctttgtatgggagagggagacgagcagactcccattgctattatagaggaagctcccaagattaccttccattcttctccaactacattacaagatatgagcactttagcaatcgctgaggatgaagatttatatggtcctctgctacaatctatggcatgggaaactcccgcaccaacctcctgaggtattatgacatcctggatagaattacttgataagcaaattgaagatcaacatatgttaaagcacgaattttatcagcgttggtctgaaggaaagttagaaaaacaacaacttcaagcttatgccaaagattactatttacatattaaagcatttccttgttacctttcagcgctgcatgctcgctgtgatgacttgcagattcgtagacaaattcttgagaatctcatggatgaagaagctggaaatcctaatcacatagatttatggagacagtttgctttatctcttggagtttctgaagaggagcttgccaatcatgaattcagtcaggctgctcaagatatggtagcgacatttcgccgcttatgcgacatgccacaacttgccgtgggtttaggcgctctctatacttatgagattcagattcctcaagtctgtgtagagaaaatccgtggtttgaaagaatattttggagtttctgctcgaggctatgcatactttactgtacatcaagaagctgatattaaacatgccagcgaagagaaagaaatgctacaaactttggtaggcagagagaatcctgatgctgttttgcaaggatcacaagaagttttagatactctatggaactttttgagctcttttattaattcaacggagccttgttcttgtaagtagtatcttggcaggtctagaatttttggatcttattagcttaaaaaataggatcatgcatctgtaaacagaatcccccctcctaaagtattagaaggggggattctttgtctcaaggtaatttgtagaatctctatgttttctatttagaaattacaatttaagcttctactgtttgagcaggaacttcctgaggtgtttcattagcatgaacagagggagttttattcgctgcaattacatcgtagatgcgcttctcaatttcctcaaaaagctttctattacgtttaagttcttcacgaacaaattctcttccctgtcctaacttcttctcttgatagttgaaccaagaaccttttttctcaataatattatattcgacagcaagatctaggatacaacctgcagaagaaatcccttcattgaataggatgtcaaattctgcgattctgaatggaggagcaagtttatttttagctaccttcactttaattcgatttccgatgtcagagttatcactgccttttattgaacctatacggcgaatatctaatcgtattgaagagtagaattttaaggcacgtcctcccgtagtagtttctgggtttccgaagctaacaccgattttctctcggatttggttaatgaacactgcacaggtttggctacgtgatagggtagcggtgagcttgcgtaatgcttgagacatcatacgagcttgtaggcctacgtgtacatcaccgatgtctccttcgagttcgcttttaggaactaaagcggctacagagtcaataacgataacatcgacagctcctgaacgcgcgagcaattctgctatgcttaatgcatcttcaccacagtcgggttgagaaatcataagatcatcgatattgacgccaataagagatgcataactaggatctaaagcatgttcagcatctatataggcagcaacaccgcccattttttgagcattcgcgacaatatgggtagctagtgtcgttttccctgaggattcaggaccaaagatttcgatcacccgtcctttggggaccccatgaattccaagagctaagtctaaagataaagctcctgttttgatggtggagatttcatgtgtggcagagtgtcttcctaaactcatgatggacccagcgccgaattgcttttcaatataagcaacagcagcttctagagccttttttctatcaggtaaattcatgtaaatgctcctcttggtttccatattccccagagaatagttctgtttctctgagaatcgagagaaatagagaagttcttctcatagttagttgagagatttgggggtggaaggttttagatgatgtgtatcattctgtattgttttgctctctatgcatacttgaatttgccatggcagtcaaggcaaaaagtaacttcaagatggcttgttatttctcaataaatttaagaaaagcactagaatacaaggaccttagtttcagatagtatatctaaattatgaaactgaaaaaatagatctattggatgccgagattcctttaacaagggaaactattttcaaaaaatcaaaagaacttcttcttatttctaacataaatagatttgggaaagggggatgtcatgactttcttggggaagtctatcgattttttgttcgcagtagccgatgccgatggttcgtatagagggatagggatgttgtgctaaccagcgatcgtagaaaccgtgaccataaccaagccgatagccctgctgatcaaaggcaaggcccggaacgagcacgtgggtaatcttatcactcgagatcggtgtttgtttcgagaagggatctttgggatgcacaacggaaataagatcgtctatcgaggggataagaacaggatagaggttttcctgatcaatcttgggaagagctagggtacatttctggataagtatgcgatttgcttcttgcatgtctatttcgtgattgaaagagacaaaagagagaacgacgctctctttagaaaagctgcgaacgaaagaggccactgcagaagaggcctcatgcttgcgttcttcagagagatccctgcgtatagagataaatagtttacgtagtgcggatttctctattttaggatcagtcatagggaagttctagttgagcaaaggtttgccgtcctgataggggatttttttagtaatagttcccgccgacgagaaaaatactgcagtcccacaaccacgatctattttagagtagggatgacggtctccagggcggaagtactctcctttaattagaagatcattatcatactcttcggtcgccatgatctgtccttcagggtagtaaatggtcagtaacccggattttttgttatttacgagttctttacaactttctaaggttcctccgggataccaagtttttactatcccatttaaaattccttcatgccaattaagaaagcagcttgggtttccctgtctcaggataaaagaaaattcttctccgtgcttcgcgccttgcaaaangttatacgtttggacaatctgtgttccggagttgtcgaatctggtaacttttccataaggttcccctcggtaaaatgccctagtttctataacggcatacttgccgtagattgcttgaatgccgttcccttcgtgtatagtcgcatagatttcgtgagtttgaggatctaagtactctgcttttaggagtcgtccctcatgatattcttcccaggctaaaacatcttcttcggaatcttcgctgtagcgaatcgaaagaccgtgtcttttgccttgttggtaattctgttctttgagcagtttccccgaagatgtgtatgtcaggaatttaccttgaggaactcccttatgatagggacactctttccaaatattcccattagtatggtaatacaccgaagatccttcgagcagccctttttcatagacgatagcggcttctaagataccttcatcattataggcaaatgtagtttgatcaaatagccagccagactctgctgagggatgaagatccgcaatacctccgataacctcagcttggattttgatattcccgttgacgtgccattcacgatatcttccataagcacgattattgagacactccaggtactgcttaatttgcccgttagtgtgataggctgttaaacaagaaacgttatctccgcgtttgtttttatacatcctcatgaccttttgatagggctggggagcaagaaagtctaccttggtgtatttctttagcttctctttagagcaaatagtttctgacaggccgtttctatcaatgatattgatccctgtaagggtgagtttctcatagtcacctgttttcccataaatgggactcatggcaattagagaagaacatagaaataagcaaaagagtttttttatatccatcgacttatagcctcagcatgtgttaaccagacctcatttcctagaggcgtagtttgttttgtcattttccaacaggtgaagaaaactaggggcgcgacagggttctctgggttgaaaagagaaaacaaggactcgatatcttcattatccatttcagtagcttgctctagacgcacaaaatgcaaagtcattgtgcatttgttcgcagttccagacgagctggtgatttgatttttctagagcacgctttctttcccaaacttctttactttgtgctagcaaagaatttgagtttaatttgtttaaacgttcgcgttctttggatagagggcgtaattgcttgcaagaggcatttaaactttctattgagaggttattgcgatccttagaaatgcgagcattgtgtttgatcacctgatcttcatgatctcttataactttcagtgtgagaatctgagaatttagatcagaccaacgctgagagatcttcacgtgatttatggtaatcgctaggacgggaagtatactcaaaagagaaagaaaactaagaattaaaatagaaatccattttttcataagacgtcctaagagcttaatgtaaattgtagtttaaaagatcgttgatcttctagagactctgaaacatgttgtagcttggggtgactcgatattttttttaagaattgagggatgtcttcaggttgtccttgtcccttgacttcaactaaggcactgtaggggagagaggggttatcttttgagggataacttgtcatggtataggagaaatacgagaactttattgaggggctgcttttcccaagggcaagaagaaattttaatgtttgctcacttgtgggaattgtaggcaagagtgggtagttggaagccgagttcttctttccgattgcctttactgttttttctgcggcctttaaagatcttgggagcacgccctcttcaggacaagcgaaagcaaaatggttcgaagctgaggaagaaagagatttaagttttaacacggatcccagacttacgactaccgtagccatgagggcatacttccctatcaacagagaggagcgtagcagccaatgtttttgggctgctggggaaactgaggtagcgtcatagggaaaagttagaggtcgtcttgaggccccatggtgggcagcagcaatagtatctccataaatttcccaatcctcgtcttccactccataagtcatagattgacagaccacaagcgggagagacagtttttgttctaaaatttnttgtagattcggggatatctgtgcgacgtgaatagcaggaagcacagtttgtgggaatgtttcttgtatatactgcaacgttgcatggatgtcgtcgcagctttttttcgttgagtggttgctaaaagaacgagctacagcaatggcatgattttttacaaaaatgcaggtaacttcttcagaaccgccatagataagaagatatgcgggcaggctctttaaagggctctgttctgctagaaaaaaaatatcggcagcacgacaagagagtttatcagggaaaatctgagcctgggacagaaaagaaagttcttttttgagtgtatttttttgagcaatccatagggtcagaggagtttctcctctatccgtcggtttgcctagttgtggctgtacaatcagagattcccagggtagggcaagacttgcttctagatttgtgagagctacttttaaaatattttttctatttttaagggatgaggaagaacttttgactaagatgtcagagccctgcagagagaaagtcgttggtgctgcaaagtatttttttgggagagaccaggtctttccttcgggaatttgttcacagtgacagacgatccatcctttacatgttttctgtaaaattgctattttaatagtattgttttcagctttggttagtccaatatgataaacaggcagcttgaaattcatagctcaagaattcttaaaatataaaggcagctattttaatggatagagggctctttttcaagaaaaacacatattaattataattaagagagtaaaatataatgctatcttatttgttaagaacgggctattaatgtttatagctttctaattttagcctatatctttgcttcttgggtccctgattgccagtctgcgcgctggtaccagttggtttccaagtgtgttgaccattttttgatttcttcgtcgctttgttcctagaattggatttatagatcccagtccttttgttggtctgctttgccttggaatccttccttttgttatattaagagtcctacgttttattattcttaatatttttcattctccatggctgctccaatatttataaaaaatattttacttcgttcctctatagtctatgctcctctagcgggattttcagattatccctaccgttgcatgtccgcattgtatcaaccagggttgatgttttgtgaaatggtgaaagtagaagggatactctacgctcctgagcgtacttcgaagcttctagattataatgagaacatgcgtcccataggagcgcagttgtgcggtagtaatccagaaactagtggggaggccgctaaaattttagaaggccttggtttcgaccttatagacctaaattgtggatgtcctacagataaaatcaccaaagatggcagtgggtcaggtctttttgaagacgccagagcttattgggaggattttagataaaatcatcaatagcgtttccattcctgtaacagtaaaaattcgctcgggttgggatatggaacatatcaacgtagaggatacggtacgtattatacgtgatgctggagctagcgcagtttttgttcacgggagaactcgtgctcagggataccacggtcctagcaagcaagagtatatttctagagccaaggctgctgcaggaaaagaattcccagtttttggtaacggagatattttttctccagaagctgcgcaagcaatgctaactacaggatgtgatggtgttctggtagctcgaggaaccttgggagccccttggattggaaaacaaatccaagactatctcactacaggaagctatgagaaaattccctttatcaaaaggaaagctgcgtttctggagcatatgcgcctagtagaagactattatcaaagcgaaacgaagttcctttcagaaacacgtaaattatgtggccactacctaatttccgcggctaaggtgcgttttcttcgttcgtctctagcaaaagcgacatcctaccaagaagtctaccagcttgtgaatgattacgaagaagccgacgactcgtcattagagacctttgttaaatgctgacttaggtgtttcgaaagttggaacatatcgataggattcggaccaatgatcgtagctaaattgttatcaggaactaaaagttttttattttctggtgcctgtaattgatgttccttgatgtaatcccagatttttttggttgcttctccccgagatacgggnttcgtttccgatcatttttgctagatctggagagggaaggaataaaggacctgttttcttttctgaagattttttaaccgagctttttgcttttccctttttagaaggtgttttggctgcttttgttgtttttgctgaagattttttcttggtcggagtttttttcttatagggaattttttctgttcctgagtactttgtgattacagcatctatagaatttccaatcacactacattcaggatactctgaacaggaatagaaaatcttgttgtaacgggagcgttttttgaaaattttcccattacagcctattgcagggcaggggataggctcttcctgttcgatttcctctccctttttatggattgatatagtgccacggcattcaggatacttctcacaccctaaaaatgttccatagcggccgtgacgtactttcataacgcctccacaaagaggacaaggactgtcccagggggtgtcttcagcatagtcttctttgttgaaagcgagctcttcttcagaagtgcggtaatcgcattcaggatattctgagcagccatagaaataactgtttttagaccagatttttactagttttcctttatggcacttagaacattctatatttgtgagaattctaggaatgacagcttctttttctgctgtaatcactacaggaaggaatgtagtccagaattcttgaagtaagagtttccaaggttttttattatctgcaatgagttcaagctcgtcttccatgagagctgtgaacccgatatccataattcttggaaagtttgtttctaagaactgtgagataatctttcctaattctgtaggacgtaaccgttgattttctttagtcgtatattcacgactttgaattttgttcattatcgtggcatacgttgaaggacggccgatcccagatttttctaactctttgactagagaagcttctgtgaatctaggaaggggttttgtaaatgcctgttcttgggatacttcctctttgattaaggcatcttgggcatgtaggggggggagaggatggtcttcttcttgatcattttcatcatcttgcttctcttcatagacagcgagaaaccctttaaattttagtaaggatcctgaagctcggaggtctatttctgtatccgtagtaatttgaacagctaaagtatcataaattgcaggggtaatctgtgaggctacgaagcgtttccagattaagttgtatactttaaattgatcatcagaaagcttattctttaatttgtcaggagtcagattaatatcagtgggacgtatggcttcgtgagcatcttgcgtcatcttttttgtagtatatacgtttgctttctcagggagatattctttaccgaaagtctgttggatgtactctctaactgtagttaatgcttcgggatctacacgtacggaatccgtacgcatgtaggtaatcaaacctgtagaatcttcactatctaaatcgacgccctcatagagggtttgcgctatagacatggttctagaagcagaaaaacgaaaatgccggcttgcttcctgctggagagtggatgtaatgaaaggaggaggagcaaaacgtcgttttgccttagcttctacacgagtgattgtatacgaggatttctctaacagctcggcatagtgacgggctttctcttcagagttaataagaaggacatcattttcggttttcccttcagggatttctttctcccacttttttccttgcacagcgtataaatgcgcccaaaacgtttttgtcgttttgggatcttgcattaaaacgcgtaaattccagtattcaacaggaacaaaagcatcaatagccttttctcgatctacgacaagcttcaaagctacagattgcacacgccctgcagatatccctgagcgttgttgtaactttcgacttaggataggagaaattttatatcccacaatgcggtcaagaagtctccgcgcttgttgtgcgttgactaaagccatatcgatggttcgagggtgttttaaggcctctgtaaccgcatttttggtaatggcattaaacgataccctctggatcagaggagagtcaggaagctgattcgcgatgtgccaggcaattgcctctccttctctatcagggtcaggggaaagatagactttttcacacttcgcggctagcttgcggatgtgattgatgacctcttgtttatcgggaagcacttggtattgtggttcgaaatcatgatccacatcaatgccaaattccttagcagggagatctacaatatgtcctatagatgaggcaaaaacaaattcactccctaataatttttgtagcgttttaatttttgcaggtgattctactataattaaggactttttcattaatctaattgcgtgaggaccctggatactttaccgagagaaaacgcgactcccttttattaatttaattttctaattcctaaaactttgttttcatgcaaatatatgttatttatttcaaggtttcgctgaaataataacacgcatgccaatagcaaagctcattaacagttacaataagtcactctagcagcttttcatgagtcggtgctcttagtttctcgatcatggaaaaataatcaactggatcgtccaacctatactgttgcgttttcatacgctaaataacaggaacgctggtctatatgaaggctagcatagagaattcttgatatgtccctatggttattgagtaagaagcaaattcttttcaagggaataatatgatagaaactatttaggtttcatcttgaacctgcaactgtcattcttttctgattagtaaaaagttttaaaataacacaacattaaaagagacgagatttcttattgccaagatgctaaaaccttttcaatttttnttgttaacgattgtaatttcttttaacaatgagaaaaaaggtttgaaaaagagccgagcatagatagaaacctaggacacgaaacgtggaaaaacttgagtttgtcaccagcctttcttctcctgatgatgatttgattactttcaataaacagggattgattgcaggcccagaagaagaaaaggtagcgtttcttgtacgtagcaatgctatgctagatgcaggacccgaaacccccgcgtcgtttcctgaatctttaagggaacaattcgatattttccctgagtatgttgaagtgctctactctaatgaaggattagatgtctgggaagcaggatgtacgtggattctaaataatgaagtgaccatccaactgcgtaaacatcaccggaaagcttcgcgatggctaggaatgtattccagagatgaggtactcgctcacgaagccgtgcatgctgtgagaatgaaatttcatgagcctgtctttgaagaggtgttagcttatcaaacttctcgttggggttggagaaggtttttcggtcctctatttcgctctccaggagagagctacttgctattattcttcaccattttaggtttaggaatctccttatggtatcctgccggtatactgattatgctggttttacctatgtattttttgatgcgattgtgcatggcgcagagctatttgtatcgggccatgaaaaagattcgtaaaatgctcggagtacctcccttatgggtgctgctaaggctgacggataaggaaataaaaatgtttgctaaagagcctattcctgttttggaacactatgctagaaaacgaaagcttgaaaatgtccgttggaagcaaatttatcaatcctactttgtttaactttaactagaactgcctatctctaaaatgactgtttgatgatcttatgtaaaacagcttttttcttttattagcaggcaggatctttagttgtgcacggtattttgctactgtacgtcgggcacaaggaatcccttttgcagtgattctgtcactgatcacactatcagatagaggagtttgttccgttgcgatccattggcggatccattgtagaacattctctttagaatgcgaggaatcttgatggattcctcgggggaagaggtgctttagagggaaaatccctataggagctgcaaccgctttgttttcaatggcacggaagattgttgactcatgaaaagagagatcttcagccaaatctttaatgcctaaaggatagggggctggaatttttcctaataaaaagtcttcttgtttggggagaagtgtctccatcacttgaaggagcgtttgttctcgttttctgagatttttgattagccactttgctgataaaatttgttgagagaggtttttctgctcttctttaggaaggtgttcatagaagtgaaacgtttctttattcagctttatagatggcaagcctcgagtactcacttcaattttccaagatcctgaggaataaaaaagataaatatcgggaagaggagttgataccatgggcttcacagtgcaagctgctgcaggacaccaaggtatagatcctaatgctttttttaaaatatttcgaagttcggataaagagagactgaactttttcataataggcgcaaactcacagttagtcatcaagggatagcaatcacggacgatgctataggcttgttggtgggaggagttgcggaggagcttcatccaatagctttgtagcgaaggagaggcaatgccttcaggacttaggttttgtatagtgtcccaaactttatgaattttttctaagggaagctcaagttcttgagcaaaatcctcaggatttcttagaaagagtccttcatccgagagattcccggcaatttgatgggcaatgaatcgttcttctgcagtagaaaaagcctcctcgatttgaggaaggagacgagtatataaagactcttgaggtccaggagtctgattcaaataggaaaacgtagagtttgtaggtcgataacaaggagaccattcttcctcttctagtgaagagagatcaaaaaaaggattatcaatgatctcttgaactacatacgatgataactcagtaagtggcgattgcagcatctgcaggccttgttgcatccttagtgagggtagatactttagagacaacttctgcttttgctgaaacatgtctaacgcacttgaatcatataatcttttggaatttcctttaaaaatctactgggcttcatcatccgtacggttccccagaggctgcgaacttgtgcggcagtaagatagaggagatcttgagctcgagtaattcctacgtagcataaccgtcgttcttcttcaatattttcataagtgccgcccagagagttcgcatgtggaagcaattgttcttctagacctacaagaaatgatacacggaactccaacccttttccattatgaagggtcatcaaattcacgcgatccgcagttaaatttagatcatcatcagagccttttaaggcaagatcatcaaggaaaagttccaaatgtgtctttggattttgttgttcggattccaaagctttatgatagagttcctctaaattgcttttccgatctttgaaggtatccgcatcttcttttaagatctcaaggtaacccgtgatcctaactacagactctataaaatctctaagggaaagagtattgtaggcatgttcaatttgagggaaaagtgcaagatactcttgaaggccttcttgttgttttttagataatttgacgtctttagtatccaaggcttgttggcatgctttgaggatagggagaccttgagcaattgcatattgcgtgagtgcaaatatcgttgttgaaccgatccctcgtttgggtagatttacagttctatcaaaagcaacgatgtcgcttttggaaataaagatacggagaaaggctaggatatcttggatttccttacgcttgtagaaggagagacccccgataatttcatagggaatgcgcctgcgaagtagagcgtcttcaaatgtccgagattgggagttcgttctatagaaaatacagatgtcacgtagttttatattcccgactctatgtaattgaagaatttctgcagcgacaaagtctgcttcttcgcgatctgtgcttcctaggaaaagacgaatcttttctccaggtcctttgacgctacgcaattctttttctaaccttgatgcgttatttttaatcagagcattagcggcatttagaatattgccataactgcggtagttttcttcgaggcataagactttagcattagggtaatcgttttcaaaatttaagatattgtgaatatttgctcctcgccaggagtagatagactgatcaggatccccaacagcaaagacattgcgatgttgctttgagaggagctgcattaaagtatattgtgcatggttggtatcttgatactcatcgatgagcaatgctttccataattggttatataattcctgtgcttcgggactttctctaagaagtcttacggttaaaaagagaagatcatcgaaatccagagcattcgcttcgataagtttcttttggtattcttggtatatcgagactacaggatcgatatagtcattgggatccaagtcttcgggaaagagtaaacggttctttgcttgtgagacgtgagcttgtattttgctcgcaagattaggtttgaggttgtgttgttgcaaggcatgcttgatgagcttttccgcgtcactttgatcataaatagtaaaattattttcacgatttagcagatttatagaacgtcggagaataaaaactcctaaactatgaaatgtacacaccatcggaacatcaaattcattagtggaagcacactgattgacaatacgttctttaagttctcgcgctgctttattcgtaaaagttacagccagaatttctcgaggcgcgatgccttggttaattaggtgtaagattctataggtaaccacacgagttttacctgctcctgctcctgctagaacgagtacaggattgagaggagctgttacagctttgcgttgtgcttcgttaagttctgagatacatgtcataataagtcctaatttttagctttacacctcgagactgacaatctctgtcgagctaaaataaaaagcgagtatactttcatcacaattatagaaaggtgatttatgcagaatgctactatagatcagctccctgtgtcttggcaagaacagcttcctttatgttggcgtgagcaacttaaggaagagtggtccaaaccctacatgcagcaacttcttatttttttaaaacaggagtataaagagcatactgtttaccctgaggagaattgcgtattttctgctttgagaagcacgccctttgatcaggtgcgtgttgttatcttgggtcaagatccttatccaggaaaggggcaagctcatggattgagctttagtgttcccgaaggtcagcgtttgcccccttctttaattaatattttccgagagttaaaaacagatttggggattgaaaatcataaggggtgtttgcagtcttgggcaaaccaagggatcttattattgaacacagtattgacggtgcgtgcgggagaacccttctctcatgctggtaaaggttgggagctgtttacagatgccattgtgacgaaactgattcaagagagaacccatatcatctttgttttatggggagctgctgcaagaaaaaaatgcgagcttttatttaattcaaaacatcaacatgcggttctatcctctcctcacccctctccgttagctgctcaccgtggtttttttggttgttcacacttttcaaaaattaactatctccttaataagctgaataaaccaatgattaattggaagctcccatgaatgaaggtatccactctgtctgttttcaaaaaacacctcggcttactgcgaagtccgtagtgagtatggagatgctcttaactactcaacagcttccttccgcagaagggatgccctcggttgctaatttggaagcggattttttacgagcagaagctctgttagcagaaatgcgagaaattcgtggttgcttggagcaatctttgcgaacactagtccctagtgagtaggtgtttttcaaataagctttgcaggtgaggggcgagtttttgcaatgcctttgctctgtgagaaacttgatttttcacatcttcactaagctcggcaaatgtttgtttgtaatcatattttacaaagatagggtcgtagccgaaccctgaagaacctttttcttgatggctgatgtagccctcgcatatcccatacgttttaaaaatctcctgattaggggagactaaaactacacaacactcgaagtacgcagaacggtctacgaggctttccaaagacgacataagatcaagcagcttttttcgatgatctttatcatacgcacctacaccagcaaagttcgcagataaaggacccggaagaccatttaaagcggggacgcgtaacatcgtatcatccgcaatgacccagcaacccaaatgattggcagcgtgaatccctttagtaagggcgttcgccgttatagaatcttcctgttcttggggaagtttatagtcaggaaaatcagaaagagaaaaaatatcgaaatcacctaaacgctttaaaaaagtcttggtttctcgtattttataaccatgagaactagcaatcacaattttcatgaatctttcttaatcttttgaaattataaagttttaacaagatagagtcagcaagcgtaatgcgcaattattagccgatgaaaatctttgtagttaaagtacaacatacattgtatctacgcaatcgctagtaaggtagacattctagtttatttttgttctgaagaacttttatgattgcctgttgatgttttttcaatttttgagtttcacaatgaagaaaattttttactcttttgtattgttaagttgtattttcccttacgtagggtgtgctcaagtttttgtaggcttagatcgtattttttctgaaggggagtatacacgttgcattcaaggcaagaaaatcgctctaatttctcatagcgcagctatcaatagtcgtgggcaggatgccctctctgtattctattctcgtaagcatgattgtaccgtggaaatcctctgtacgttggaacacggctattatggagccacacctacagaaacggtggggaatcagccatccagatatccaaatttacgttctgtatccttgtatggagtgaaagaggttcccaaagaggttgccgaacattgtgatgtatttgtttatgatgttcaggatatcggagtgcgttcttatagctttgttaccgtgctgatgcaaatagtaaaggcttctgaacggtacggaaaacagctcattgttttagatcggccgaatcctatgggaggaaggattgttgatggacctcttcctaatcccacaacttcaggttccctagcgattccttattgttatggcatgacacctggggaattagcgttgttttttaaaaagacatacgctcctaacgctaatgttgtcgtgatccctatgaaagggtggaatcgctcgatgacctttgatgaaacaggattgatttggatgcccacaagtcctcaaatgccagatccacaatcaccgtttttctatgctgccacagggattttaggtgccttgtctgtagcaagtatcggtgtaggttataccttacctttcaaagtgctcggagctccttggatggacggggaaaaagttgccgacgagctgaatcgcatgaagcttcccggtgttctgtttcttccttttttctatgagccttttttcggaaaatacaaaatggagatgtgctccggggttcttcttgttcttcaagatcctaagattttctatccagtagaaacacaatgtacaatttggggtgtattaaaagcattatatcctaaacaggttgagcaaacgttaaaatccatagagcgcattcctgcacgtcgatcttccatatgcaatttatttgggggggatgaatttctcagcatatcgcacaaagagcgctatattgtatggccattgcgtaggttatgtaaagagtctcgagagagctttcatcaactgcgtagttcatgtttactctcagagtatgcagaatcctaacaagaacacttaagatcctctacggtttgacaggaatatttcttgtttctaagatgaccttttcatggcagaagcctttcctgcattaagaatagacatcagaggatcgagtggtttgggtatttaaaagtcaatttgagggactttcagcattaaaacgaggagtgcatgctcttactaaagctgtaaccccagcatttggacctcgagggtataacgtagtcatcaaaaaaggaaaagctcctattgtcttaacgaaaaacggaattcggattgctaaagaaatcatacttcaagacgcattcgaatctcttggagtaaagcttgcaaaggaagccttgctaaaagttgtagaacaaactggagatggctcaacaacagcccttgttgttatcgatgctctttttactcagggtctaaaaggcattgctgcaggtctagatcctcaggagatcaaagcaggcattctcttgtcagtggagatggtctaccagcaattacaaaggcaagctatagagttacagtctccaaaagacgttttgcatgtcgctatggttgcggcaaaccatgatgttactttaggtaccgtggtagcaactgtcatatcccaagccgatcttaaaggcgtcttctctagcaaagactctggaatttccaaaacacgtggtttaggaaaaagagtaaaaagtggatacctttctccctattttgttacgcgtccagagacaanggatgttgtgtgggaagaagctttagtgctcatcctatcccatagcctagtgtctttaagtgaagaactgattcggtatttagaactcatctctgaacagaacacccaccccttagtgatcatagcagaagattttgatcagaatgttttaagaactctgattttgaataagcttagaaacggtcttcctgtttgtgctgtgaaggctccaggatctagagaactgcgacaagtcgttttggaagatcttgctattttaacgggagctacccttataggacaagaatcagaaaactgtgaaataccagtttccttagatgttttggggcgtgtgaaacaggtcatgattactaaagaaacgtttaccttccttgagggagggggagatgctgagatcatacaagctaggaaacaggagctctgtttagcgatagctgggagtacctcagagagtgagtgtcaggaattagaagaacggttagcgatctttataggaagtatcccgcaagtgcaaattactgccgatacggatacagaacaaagggaacgacagttccagttagaatctgccttacgtgctacaaaagctgccatgaaaggtgggatagttcctggtgggggagtggctttcttacgagcagcacacgctatcgaggtgcctgcaaacctatcttcgggtatgacttttggttttgagactctcctacaagcggtacgaactcccttgaaggttttagctcagaactgtggtagatcttcagaagaagtcattcataccattctctctcacgagaaccctagatttggctataatggcatgacagatacattcgaggatcttgtagatgcagggatctgcgatcccctcattgtaacaacctcttcattaaaatgcgcagtttcggtatcatgcctcttgctaacgagttctttttttatcagctcaaggacgaaaacataatcagttgagttcttaataaggctgcctaaaacatgcgttgttgattgaggactctcttctaaaacatccttgatttgggatggtataacggaaatttctaagaaataaaaatttttagtaagattagttcattaaaaatttccacagcattttcttatagacagagaaaatgttgatcatttgatctttctgggatacactatgttgagcgaaaataggcaccagtagctcagtcggatagagtacctggctacgaaccaggtggtcagaggttcgagtcctctctggtgcggaacaataaaagagttgaagaagaggtttttatgacactctccctagttggaaaggaagcccctgattttgttgcgcaagctgttgttaatggcgaaacgtgtaccgtatctttaaaagattatttaggaaagtatgttgtgcttttcttctatcctaaagattttacttacgtgtgtcctacggaattgcacgcatttcaagatgctttaggagaattccacacccgaggagctgaagtcataggctgttccgtggatgacattgccacccatcaacagtggttagctactaagaaaaagcaaggtggtatcgaaggtattacctatcctcttctctcagacgaagataaagtcatttcaagaagttatcatgtgttaaaacccgaagaagaattatctttcagaggagttttcctgattgataaaggtgaaatcatccgtcatcttgtagtgaatgatcttcctctaggccgttctatagaagaagaacttagaaccctagatgctttaatcttctttgaaactaatggcttagtctgtcctgcaaaattggcatgaaggagagcgagcgatggctccaaatgaagaaggactgcaaaatnatttcgggactatagactaganaggctgattgaaagtcagcaagtcataaagatcgtgatcaaagaacaataaaaggctattgtgtttttggcataaagaccgagaagcttcaatgatgtgttgatttccaacaccaggaagtccgatagcaatgatgttttttaacgtcgtttgtgtatttaagaaatgcaaaccaaaaaagtaactatctacacagtagccttcttctcgaactctgaagtacactacattataatcacttaataatgttttaatagctaaagtgatgcctggactgctgacatctccaagataattatgtagatctacaagactacgacagaagtacgcagtatcgtaacttcctttttctgcttctccaaataaagcaactgtaaatttcatttgaaatatgagatcgaatctttatttctgatcgtacaggactgtttgtttattatctacagagagaaacttagttttgaaaagatttgcgaatctaagatggttattattgcttatttctttgtaaacaaagtcgttgcccagcatagatagcatcggaatctaatttattaattttctttaattcagttactgaaagtttatattttttagcaattttactaagactatcaccttcacgtactatataaatattctcaggaacaggatccgagaagtcagcataggctccaggagaagagctgtctactaaagcaagtaaagaacgtcgtactagacgcaaatcctgagctaaagctcggtgatctttttgaatttcttgtagtttactttgtaagttcgtctgtaagtctttaacagaagttgttagtacagctaatgttttcgcaagcgccttttgatcggactctagctcgcggattttttgagccagggtttctggttttgctgctgtccatttttggaacttagagtcttgttcatccaagcgctctgacaacatgacaatctccacttcgtgagaggctaattttgccgagatatcttcgatttctgcaaggactccttgtagagaaggagaccttccagcagcatgcaaacgactgcaatctattcctgaaaataacagacttagaagaataaaaaagcttagcttagcgtgcatgaatcttaaactctgtacggcgattttgttgccatgctagttcgttgtgtcccgaatttaaaggatgttcttttccgtaggaaatagtagatagacgatctgcagagattccctgctttcggagatgctctttaatcgcattggctcgtcgtgctcctaaagcaaggttataggatgcagctccacgctcgtcagtatgcccttcaatgtacagtgtagctttcgggtttttcttcatgtagtgaaccaagttcgtgagaatcgcaaggttctcttcacctttaattgtatagctgtctgtagcaaaggtgatattacgaaatgctgcaacttggcttgacttgtattgtttttcttctttggaatcatactcaccgaaggtaaaattagggttaaagtcctcttcggtatagagaggaacaaagccaaaagaagaaggcttttttcgtcttgtatgatggcatgtattacaggaatcctcccagccataattaggggaaaggctacatgctggcaatgcaagtaaagccaataaagtacaaagtttccatagggaatgtatattcatagtgttctctttatcggttgctgagggaaagcaccccaggaggggaaccgtttttctcctactcctatagcaattttgttagtttttttggtgactagactgattaaatataactctgattcttcagcattccccgcactaaagacaagatgacggctgtctatagcccaagaaggactctctttatttgtgggagacgtagtgagttggtaatcctctccagaggagagatcgtaaatacaaatttgtcgcacccctttaattacagagcagaaggctatttttttaccatctggagaccatgcagggcaactgctatttctgtatttttttgtcagcaagcgaggtgcttggggttcaggatcgagggacataatataaagacgcggacggccgtctttgttcgatataaagacaagctgggatccttcagggttgaaggagggattcccttgagtcccgaaattctcattaaggaggcgacgtgggcgacccataggtcctgaagttagtgagaacggttgaataaataaatcaggatttccatacgtatcagcaacgaaagctaaaagcttttttcttggagaaaacgtaggcatgagttggttgccttttaacggaaggacttttttaccttcagtgttctctagggaaccaagaaaaattttaggcacaccatacttatacgaaacatagagatagggaaaatttgatcccacacccacccattttggagttatagagagcgaacattctgtggttaaaggggcgaggtttttcccatcgtaatctgtagtccataattctccttgcttgagcttttgatcttttcctaaagaacttagagcaaaaacaattttcccagcactgattccaggaatccctgtgagggcgtaatgaactgtatcagcagcgtgatggattttttgacgatctacagaaagattttgagaaatagtaaaagaacataaggtttgaggagtttttgaagactgtaaaagcactacagatagctgaggtacatgcaaccgtaaagatattgctaaaggagatgacgattctttagaagccgctgtgggttgtagacaatctcctagggcaatgtccttgcaaaatatctccgttagcgagctgaggtatttctgtatttttggatctttcgtatcggtctggcaagagacctcaatagggagcgtgatatgttcggaacggacaacaacttctaattcttcagcatagactagcgatgcgaagcaaaagaaaaaaacttggaagcatagttgccgtaacatgccgatatctcctcaccctagggatagagcgttaggattcattactgaccagtttaatatgaaaagattatatttttcgagactttgtatttttcgagaaatttttgaaatgggagtgcatgaatcctctgagtgagcagctgtttgtcagcagcactcacctcagagagaaaactgcattcttgaatctctccattcggagaaaggactaatttaatacgcacataccctttagaggggagagctatgtgagtgcgaaataactcacatagctcgtcttcttgagttgctttaagttctgagtgcatggtcaattgggctgtagatggccaggagatatttttgagagaagtttcacttttctcaattttatctacatgtagggaaagggcttgggcaacttcggagagtgtttgtagttgggtttttgataactgtgtattttttttagttgtagagggaggaggtttctcagttgcggtcgttttttttgctacagtaggggctggtgatggtttaggaggttctgtttttataacttttggaatgggtttttgtagagccttctggacgttctcttgaggagggctgcatttagcttgtttttgtggctgcgtagtacagaggggcgtatcgttttagctggatctacaactactgagggagtagggacaggaggtttcggttggatagtgacgagtttttcttgaaaggctttgggttgtaaacgttttttaggaagaggagaagcaaagacaaggagaagaatccccccatgaatacatgccgtgattgctatatagggaagatacttcatcataattcaattctgtagggctacgtgaagttcgtgaaaccccgcagcttctatagcattctttacgttttgatatgtccgaaaggaggtttctccatcttgtagtaataggggggtcttttcaggataggctttatggaggagggtaaggcgaacagtgagctcttgtagtgtgatcggatgctcgttcaaagttaacgaatggtccgcaaatactttaattaccgctatagaatcgttttcgctgctcagcacttcttgctcttgtgtgccaggagcaagagctatagaatccagttttattaagggaacagcaacgataaatgccattaaaatgacaaagacaatatcaatcaacggcgttaagttcaccaggggctcttcttctatttcttccgtgaagcggtatttcataagtttgtattgcggtatttgacttctatagaattcagtagtaaatatgctgtctgctctatctcagaaatcaattccgaagaatgtgctttaagatagttaaaagcgatcagtgagggtatagcaacaaagagtcctataatcgtcgttcccagggctgtggcgagtccttccataatggctgagtttccactgcttcccgagctaatgtgggtaaaagcgactaaaattccccatactgtacctaaaagtcctagaaaaggagctaagctgatcgttgtcgccggaataaagctgtttttatgtaaaagagctttatatttcggcatgatggctcccaggagcgtctccaaagattggatatcttcagaagaaaggatgggacctcgatctggagccgattgccgatttttatctaagagctccaaagttccccgttttatagtaaaatacaagtccgcaaaggggctgagctctggatggatatccagagacagaggtgcgtgacggtttttaattaagaaatctttaagagactttcctgcttttaaaaaatttttttgaatggcaagcttttgatgtagtactgtccaagtacacacagaaagaataagaagacaaaagaatatacttttaccaaaaaaatctgcttccgtgtaggcctgaatgatggggttatgagagaagtgtaccatggaataaaaatctttatttacagagagtgtctcaaagtaaagatgatcctaacaaattttcgttatagagccaagcgggttttgtaaagaagatttataaaatggaatataaaaattaatgtataattagtaacttgatttataaaatcacggtgttattttgaataaattcaaaacatatttacaaaccgcattgatagcacctttcttttctttcccagcgttatctggaagtttttcctctatccaggcggaagaaattncacaacaagtgaatcatccaggtgcagaactcctttctgagggtagctacatccctggactacagacattccgattggggatcaagatttacagcttccaaagggagccatatctactggaagaatcccggagaaattggaagtcctctcaaaatttcttggcagttgccgaaaggtttcgtggttgaagaagagcattggcctacccccaaagtatttgaggaagagggcactacattttttggatatgaagattccgctcttattgtcgcagatgtccgtgctcctgaaggatacactcctggtcaggaggtcgaattacgagctcaggtcgaatggctagcttgtggagatagttgcttgcccgggaacgtcgatctaaaattgacactgccctacgaagagaaggagccttctctttatcctgatacacacgcagaatttactaaaacgctgcatgcgcaacctcgtgttttagaaaatgatcactctgttcaagtggcgcaaggaaaaggaaatgagatcattttaaatatctctaagaagatcaacgctacgaaagcatggtttgtttctgaaaaagccgataagctttttgcttatgcagagacctcttatagcgggggaacaggaactgcatggagattaaaagtaaaaaatctctccggagttcagaagaatgagaagcttcatgggatactgctgttagccgaccacacaggtcgtcccgtagaatcactcaccattcatagtgaagttcttggtcaaacaggatctgctgtagcaggactgtcacaatatatcacaattttgatcatggcctttctcggcggggtcttgttgaatattatgccttgtgtgcttcctttagtgaccctgaaggtctacggtttaataaaatctgctggagagcaccgctcttctgtaattgccaatggcttatggtttactttaggggttgtaggatgtttctggggattggcaggtgttgcctttatacttaaggttttaggtcacaatatcggctggggcttccaactccaagagcctatgtttgttgccacattgatcatagtattcttcttatttgctttaagttctctagggctttttgaaatggggaccatgtttgcaaacctaggagggaagttacaatcttcagagatgaagagctctaataataaagctgtaggggccttttttaatggtattttagctacgctagtcacgactccttgtacaggacccttcttaggttccgtattgggattagtcatgtctttatctttcctgcagcagctcttgatttttactgcgataggcctggggatggcttcaccttacctagtcttttctgtatttccaaaaatgttgtccgtacttcctaagcctgggggatggatgagcaccttcaaacagctaacaggatttatgttgttagtaacggtaacttggttggtatggatttttggttctgaaacaagtacaacttctgttgttgttctccttggaggactgtggcttgcaggattaggagcttggattttaggacgttggggaacccccgtctctcctaaaaaacaacgtgtttgtgcttctttattgttctttgcattcctaggtggagccatctctgtaagtggtttagcttctcattactttgctgaacctcagcagacagtcagtgtgaacgaagatagtttatggcagcctttttccttagagaagcttgcccaattgcgagcccaaggtcgtcctgtttttgtgaacttcacggctaagtggtgcttgacttgtcagatgaacaagcctgttttgtatggtgatgctgtgcaaaagatgttcgaaactcatggaattgtgactttagaggcagattggacccgtaaggatccagggattacagaggagcttgctcggttaggtcgcgcaagtgtcccttcgtatgtctactatcctggagataactctgcacctgtcgtacttccaganaagattacacaaaatcttttagaagacgtcgtaagtcgatttgtaaggtagctgttaagtgtagaaccaacacaagcattcgtaggtggaatcatccacgaggtaccttaaaaattgttagggcagcatatgctgccctttttatttgtaacaagaataccaaagttcacctgcctttaaaagcagagccgcttcaatcttgtgtagaatcttgagtctggggagcttaaattttccttagtaggacagagtctcgggagttcgctgtgttttaaggattcttctttagtgaagatattttcaagagaatgtattctatagggaattcttgccctgaatgttctacgactttgcttaaactaggagacaacccgtggatttggctgatgctcatgttcatctttctgatgatgcttttgaagaagatattaacagcgtattacagcgcgctcaagattctggagtgtcactagttgttaatgtaaccacaacagaaaaggaattaaatcgctcgtttgcgtatgccgaacgttttcctaaaattcgattttgccatgttggagggactccccctcaagatgtagatcaggatatcgaagaagactacaggaattttcatgctgcagcacatagtaagaaactcgccgcaatcggagaggtcggtttagattattgctttgccacggaagagggaatagcaaggcagaaagaggttctccaacgctatttggctttatctttagaatgcgaactcccacttgtagtgcattgtcgaggtgcttttaacgattttttccgtatgctagaccaatactaccataacgatccacgttcacgtccagggatgctgcattgctttacaggaaccttggaagaagctcaggaactgatctctcggggatggtttatttctataagtgggatcgtgacttttaaaaatgctcaagatttgcgagatctggttgtagaacttcctcttgagcatcttttaatagagacggatgcgccttttctggctcctgtaccttatcggggaaagaaaaatgagcctgcacatgtgctccatacgatcaacgccgttgccaatgtaaaagggatgttcccacaagagcttgcagctcttgcttacaagaacgtcttacgctttctgcacggttaatttgatggagttcatagaactccataacctttctattttgtcatataagcttctgtttcttatgaaaaattactttccataattttattctagcctctatcttgagttgaacttaaagtttagtaaaaagtcttagaatgtcacgacatgaaatctgcccagaagtgtcacacaagaaaggcaagtattatagcacctttatcttccgttgtattcactccttagcgggtatagcgtttacttttttcctatgtgaacacctatttacgaacatgctagcttcttcttacttttcccaggggaagggtttcgttgctatggtcaatggttttcataagatcccagggctgaaaattattgaagtggcgggtttagtccttccttttctctgtcatgcgattatcggcatcgtatatctctttcaaggaaaaagtaattgttattctggtgacggaagtcgacctcatttgcgttatgctaaaaattatagctatacgtggcaaaggtggactgcctggattttactctttggaattgctttccacgttgtgcatttgcgttttatccgttatccagtccatgttgatatccatggaactacctattatgctgtagacattcaaccttctcgctatgacgtgattgttagagggactaaaggctttttaactttgaatcttcccaatacagaagcttcgagtatcgaggtgtctcgtcatgatttaggtggtgctgatgctgcgttattgtcggagaggaactcctatttattgactccaagtgcaggtaccgcatttctttatgtagttcgtgatgccttgggatcactattcatagctcttctctatactattttggtcattgctgcagcatttcatgggtttaatgggttgtggaccttttgttgtcgttggggtgtcgttgtttctctgaggatgcaaggggtattgaggatagtatgttacctcgctatgattgttgtgactttcatgggagtgagtgcggtttggaatttgtatagtgtggcatagcaaatggatgagaatcgaaaagtaatcgttgttggtgggggattggcaggattatccgcagctatgcagttagccaaccttgggattattgtagagctcgtatctctgactaaagtcaagcgctcccattctgtatgtgctcaagggggaatcaacgctgccttaaatctgaagcctgaggaagaggattctccctacgtgcatgcctatgatacgattaaaggtggggattttcttgcagatcagcctcctgtcttggaaatgtgtcttgcagcacccagaatcattaaaatgttagataactttggttgtccttttaaccgtggtccttctgggaacttagatgttcgtagatttggaggtacgttataccaccgcacagtattctgtggagcttctacagggcagcagcttatgtatactttagatgagcaagtgcgacggcgagaacatgcgggtagggtgataaaacgagaaaatcatgaatttgtacgtttagttaccgaccattccggacgtgcttgcggcattatattaatgaacttgtttaataaccgtctggagattttacgaggcgatgctgtcattatagctacgggaggccccggagtgatctttaagatgtctacaaactcgactttctgtacgggagccgcgaacggaagactctttttacaaggcatggcctatgcaaacccagagtttatacaaattcaccctacagcaattcctggaagggataagctacgattaatttcagagtctgtgcgtggtgagggcggtcgtgtgtgggtgcctggggattcttcaaagcgcatagtatttccagatggttcggaacgtccttgtggagagacaggagctccttggtatttcttagaagatatgtatcctgcgtatgggaatcttgtcagccgagatgtaggagcgcgtgctattttacgtgtatgtgaagctggattaggaattgatggacgcatggaagcgtacttagatgtcactcatcttcccgagaaaacacgtcataagttagaagtcgttttagatatttataagaaatttactggcgaggaccccaatacggttcctatgaggattttccctgccgtgcactattctatgggaggtgcttgggtagattggcctgctgccgatgatcctgatcgtgatagtcgcttccgtcagatgacgaatattcctggatgttttaattgtggagaatctgatttccaatatcatggagccaatcgcttaggtgctaattctttactttcctgtttgtttgcgggtttggtttctggagatgaagcttctcgttttatagaggcttttggggcatcacaggcaacgtctagtgattttgatcgtgctctacagcaggaaaaagaggagaacgcgcgtcttttatctgcatcaggaaaagagaatatttttgttttgcatgaggaaatcgcaaagattatggtgcgaaatgttacggtaaaacgaaataatcgtgatctccaagaaactatggataaattgaaagaatttcgtgagagattaaaaaatgtctctgtattggactcttcaccatttgcgaataaatccttccattttgtacggcagatgggacccatgttagaactcgcactggcgattactaagggagctcttctacgcaatgagtttcggggttcccattacaaaccagaatttcctgagagagatgacgagcattggctgaagactacagtcgctgtttatgctcctgaagaacctgagatttcctatcttcctgtggatactcgccatgtagccccgactctccgggattacacaaaatcttcaacaggaaaaatagaactcacgaatattcctgataatatccgtctacccatatagaaaaagagagatgatggagaatctagagacttttattttaaaaatttacagaggcgttccagggaagcaatactgggaaagctttgaacttcctttacatcctggggaaaatgttatcagcgctcttatggaaatcgaaaagcgaccggtaaatatcttaggggaaaaggtcaatcctgtagtttgggagcagggttgcttagaagaggtctgcggatcctgttctattcttgtgaatggagttcctcgtcaggcatgtactgctctgatccaagaatatatcgatgcaacgcaatcccgagagattgtccttgctcctcttactaagttcccgttaatccgagatttaattgtagatagatcgattatgtttgataatctcgaaaggattcagggttgggttgctgcggatattgaaggagagacgtttggtcctcaagtcactcaggaacagcaagagcttctctatgcattgtcgcagtgtatgacgtgtggctgctgtacagaagcatgtccccaaattgataataaaagcgatttcataggtcctgcagcaatttcccaagcgcgttattttaatacgtatcctggagataagcagtctaagaaaagatggcgggctcttatgggtaaaggagggattgagggttgtggtcaagcgcataactgtgtccgtgtctgccctaagaaacttccccttacggagagcatctcggccgtgggacgtgaaatttcaaagttctctttaagaagtttattttcagctctttttaaaaagaaaaaataatctagaaaaattctttagggaggcggctgcggtagcctggaggcggtggcatgccataatctataggatttgcatagagggtccagggtcttgacgttgcgaacagctcctggatattgtcaagaggctgtccttgcagccctgcatagttaaatttccaaagatcgatctctgtggttcctggatttaggatgaatccaaaataaatagaaggccagttactgtctgcaaagagcaaaggagcgggataggcaagattatgatgcctcattgccgtggtgaggcggaggtacgtatcttcttcggtgtagatcttttgataactttgcatgaggagacctttatagatatgcctcaggtctgctgaggagagtaaggtcattttagggatggtttcctctatcagggagcggaatttctcataggtaatacgagaggaaatcccgagatatgaagagacgttatctaagacttctggaagctgttgttctgaaacataagggacttcacggaccataaggtagagaagacggcgtatatagataagagctacggtcttatctttggtgaataaggagcttagaaaacgcgatcctttgtcatagagctccggaagagtcaaggagtggtcggagcagaaatcatgaaagtcatgaactacatgttgcaaagcatatttgttacaaaaattctctatgaaagcatagatacttagctgaggtaatatagtatcttgaaggaaatcttggtgttgtttcacccagacatcacgaagccaggtatagctgtaccaatcattatcccaagcttcccgaaataaaggagatcctgcgattatagagaaaacgtgggtgggtgatgagctaagtagagagtgggatccttcttctagataacttttaattcctgtagggagatctttaagggcgtctgcgtagaaagctgcaagctcatgaggattttcaggatgcttttctgtaagtgtcagaggttctgagctttcaaaataatccaaaagaagagtgtccactgttcctccagaaacataaacccagggagtttgtgacagctgatctaagtggtttaagatggagggaggcacaggaagctgataggcttctaaaattcttgtaaggagagcttcttggaaaacatccgtgtgtagcatggcagtgatgttgtggacgagccgagatgtttctttctctaaattgatcacggcatgtttccccagaagttctgactctgtggaggtgaagaattcagaaagaaaacgtataaattcattaatcgaatagatgggggaccatgtgttcggatgggtgcgtccatgcgtgaaaagaatacggaagccagcgggagcattagcatagagatgagcaaattcttgaatgaaggcatcgtaagaactacgaaagtataagggaatttgctttgtatagaaagaaagtaagaattcaggaagatgtagaaatttctttgccttttcttgagcactatcccactcataaagagctttattgagttcttgacggaagcgcatgtgatccatcgtcaaaatctgactgtcttgattatttagtgggttgcgcatccgcccttcaatatattctagttgggagcgtgcttcgtgataggtctgttcacattgttggactaaaattcggatgttttctacttcctcttcaacaaagtgtgtaactagagatacaagactgtgagggtcttcacttttccatcctaaggcaaggcggatatggtttgagatggtaggttggctagcatccgcaagagtcgctaaagtatactcccaggctttcagtaagggattttgagtgtcatggataaaagcagattttgcttcttcataggcatgtaagtagtggtatacccgttgtatttctgagagctctctggggtgttgcgtcgagaatgccacttgttctttgctgaacaacccttctttgaagaaaatagctcgtacagtactttcttggagctgatagtagtgcagaagtgtcgatttgataatgtcgttagcagttaaggtctcatggacattttgtagtttttgcatcaaatattgatgcgagagcaactgttggatttgtgcttcagaatccccaagagtttcaataagattggcagcagaaaaggcttttttgagtcctggagatgaggagagcttaaccagaggatcaggataaagatctagaatccttaaaggcttgaatagctctccaatgcatcccgaaaggtttataggaaccgcaatttccctttggtttacgattctagagagtttgccactgctaatgagatcattgagatctttaaggaatcgttctggatattcttggtgaatgagaatggcaggagccgtagcaaaacaggaacctacatcttgccgaaggtaggtgaagagcgctgtgagtgctgcttgacgcacatgaatcgtagagagaattgtctgtggattcaatgctagtgtatggcgaattaggttttggattgtagagtatgaagggacaaagagagttttgatgctttcttttaatttaggattttcctttagagcttttagcattttaaggaggtgttcacgatcttgagcttcattatggcgatgaggccctaaaggataggtacattgtgagagatggtgaatggcttcgacaagctttactgtatcgatttccccattgtcagctaagatataatttgcgactttacgggcgatatttaggttcttagcagctagaggggattgtagagccgtagtacggtaggctttaaataaaactgtgtcttcagaacagaaaatttcctcaagaagattttgatcctggtttgcgatcagagaatcgaaaacaaaaatatccaaacgtgacataggatgtagaagatagttatgggatattcctttgctgtaacacgaatacatgtttctgtcactgatatcctccactactatttttctagagctccgaaggcaagtttatgaaaatgaaaggatggtcagagttccatctgcagaatgttcggtttcgttgtttaacatcatggttagagaatcaataagattctctgtatttagagggtttaaaggatcttttaagagctcttcaataggaagctgagaaaagtacttgaggatgtcttctcctccagtgaggcagatcaaccgatctccaggctgtagagcttggtgagtctctaaggggagacgtacgaaagattctcctcgttgtagaaacatggtaggagctccctcgcttaacgagaggagctctagagatcgatctttttctacatatttaatgaaagtcatagcaactacagcctcattgccttctgttgtttttgagaagctgtcggcagtatccttgctgattttttgtaacgaaacgtccgaggaagcataggcaagaaaaagactccgtgcggataaagcatagagataggaaggaagaccaatatcgccagcgagccctatgatccctaaaagggtatcgccaccatcttgaactgtccaaccattaaaatgaccggaaagttgccttctccggagatgttgggaactaaaggtaactttagggaacgtagggaaatccggacttagtaacgcactttgtagtgaagataaaatccctaattctttttgtaatttttcgcctgaatggtaatcgatatctgctttctcaatggaattcaataagagtaggagagtgcaattgaaaatatttcctagttcattgaattcataaccgtaaggctggggttcaaacctcacgttatggtttcctcgccaggcagcttccatacagaaggtcagttcttgaagaggcttgttaagtttggtgttgatcttagagaaaatccaccacatgaggaggaaagcaagtacatagaaaaaacaaatattgagaggaactttcaaggcggattggatgagatcagaaactggaactaaagatagagtgtaggtcccttggataggaattttattcagtaccaatcctaggtagcgtttcttgttgatactcactgtgattaggttctccccaccaagaattccagaagctttctcaatttctatggcagaggggcttcttgcttggaattgcggtaaattagggagatctagagaaaatacaaaagaagattcactgtcctgagcacagaagaggacctcgccatacttatttacaaggcagatatttcctttggtgatgtgtaaggattggaataaatctttctgtaaaaaagacatgggatagaaacttacaagcagtcctgaagtcgttgtagaatcccaagatgcgacatcttcaactagaataagataatgtaaaagtggtttacctggaatggtcaataaaaaggctttccctacagctgcggatagctttttcttcatttcaggatgctgttttagatagcgaatgaaagggtctccaggatttttcgtccttacagatccatcaaagggatctataaggcataaggaaaagtctgtattggagagtgccatcatctcattgtatgcctgtgcatagggctctgcagaaggagatgcataggattttaaggctaatgtgttggcaagtctatcgaggaaaagcttgtgtatcgtcagttttttttcgaattctatacttaagttcgtagcacgggtatggaggacctgtactaaatttgctttagcggcagaaaatgagaaaaaacctacgaccataagattgaggagtaggggaatgggaatcactaaaaagaaaaaaaatagaacacgcttggtaaaggtatgtttcatgatgctaatacctttaatattaataaggtgatgtcgtcatgttgatgggagttcccgacaaaggtttttacacttaacatcaacctgtggacggcatcagcagcacttttccctgtcaatccttgaattgcagcttgtaggcgctcttctccaaacatgtcgttattgttattatgggcttctgtaataccatcagaatacaagacaaagagagaccctggcttaggatgaaatagctttgaagtgatgttcgcaacttcgggaaggaagcctaaagccattccaggatggaatagccaagaagtctcgccatcaggatctaggtagcaggcaggaggatgtccacaagaataatattccatggtgttggaagtttgatgataacagtacacacatagagtgacaaacatccctgagttttttgtattgttataaaataagcgtgaggtttcttggattgcctgttgaagagacgaagagcgagaaaggaatgttctgagcatattttttagaaatagcgaatacccacaagcattaacacctttccctgaggcgtcagcaacaatcaggaataggcgagccttcgaaccctctcctacaacaaaaacatcaaagaaatcaccacctacagtaatggcagggatataggcttttgcgagttctatatgaggatagctggggagagtattaggaagaagtcgctgctgagcctgctctcctaaatgtagagcgttctgtgcattttctttcatctcaaagttcgtcttagcgaggtgttgctgtttgtggagattctccaccatagcattaaaaatatggccaagtctgttgatctcaaaccctaaggagtcgtcagtatagaggcagtttttgtttttcctagattctatcatcgcagtggcaagttttctgataggtaacgacaatcgtcttgctacaataaaggctatgaggctccctaagagaatgcaaaagaaataggcagtgtacatgcgagctctgcgccataaaggcgcaaagctctcttcttttttagcataggaaaggactgcaatatctatactgggaacattttcaatacagccccaaatctcagtatctttgattttaaaagaatagaaattttctccaatatccagaggggagagagttaaaggacctaattctgagtctatagggcaaggatcatcattgagaaaaacttggcagaatttttctttcgtcatgtcagggtagacagtatggagatggagagcaggatcagaagcttttaagataacgccgtatttggaaaggatcgcagtttttacagtgagataggattgcttgtttatcaggagatctttgagtaagctctcagcactgaacgtggtgtataagatcccttggagttcttgagtttttgcatcaaaaacattagcttgcattacagaaaagacttcctgatttttaggagattgttttagggctgctaaaaatggagtgttcttagggatgtctattttgtgattatagttttcccctaagtgttcaggaatgctagaagcaacaacaattttatctccatttgggaataccttgattaaagagatttcattatagatcccttggaatactttctgcatttcattgctaaggagaacgttcggagtctctggaataccagcatctaaatctaagacatcagaaaatagagatagaacatcgacattcaaagggacaatctgagtgagagtattggctttgaaagcagcgttttctttcagtgcagtagaaatagcagagactatggtgcggtattgatctaggtttaaccatacgatgttgatccctagaggtgcaatgatagcaacggcgcaacaaaccacaaacggaaccctattgttttagtaaaagggatcatgggtattacggcgctctattcttaaggcttgtcatccttgagaaggaacgtctttcctctagtgttttgtttcttacgcagtataaaaaaatttccttaaggagacacctactatttcttttattcttgctatatcttagtaaatcaattgcttgcaacgaagatcttattttttcatctcgatcttctaatgaatgaaaatattattctctaacttcttttaaatcacatggatgtttgagaatatagacaataaaaattgttaaagcttttgttttttactcacaatacttatgtagaaatcttctaaacacagaagctttctactaaaaaagagcggagggaatcaagtgagtctatatcaaaaatggtggaacagtcagttaaagaagagcctctgctattcgactgttgctgctctaatatttatgattccttctcaagaatcctttgcagatagtcttatagatttaaatttaggtttagatccttcggtcgaatgtctgtcaggagatggtgcattttctgttgggtattttactaaggcgggatcgactcccgtagaatatcagccgtttaaatacgacgtatctaagaagacattcacaatcctttccgtagaaacggcaaatcagagcggctatgcttacggaatctcctacgatggcacgatcactgtaggaacgtgtagcctaggtgcaggaaaatataacggcgcaaaatggagtgcggatggcactttaacacccttaactggaatcacgggggggacgtcacatacggaagcgcgtgcgatttctaaggatactcaggtgatcgagggtttctcatatgatgcttcagggcaacccaaggctgtgcagtgggcaagcggaggnctacagtaacacaattagcagatatttcaggaggctctagaagctcttatgcgtatgctatatctgatgatggcacgattattgttgggtctatggagagcacgataacaaggaaaactacagctgtaaaatgggtaaataatgttcctacgtatctgggaaccttaggaggagatgcttctacaggtctttatatttctggagacggcaccgtgattgtaggtgcggcaaatacagcaactgtaaccaatgggaatcaggaatcccacgcctatatgtataaagataaccaaatgaaagattgaggaactttaggaggggcgaattcttcagcaactggagtttcttcagacggttctgtgattgttggtcaggcgcagacagccgataaatccgtgcatgcttttcaatactataatggtgagatgaaagatttggggactcttgggggtacctcttctacagcaaaaacagtgtccccagatggtaaagtgatcatgggtagatcacaaattgctgatggcagttggcacgcatttatgtgtcatacggatttctcctctaataatgtactctttgatctcgataatacgtataaaactctaagagaaaatggccgtcagctaaattccatattcaacctacaaaatatgatgttacagagagcctcagatcatgagttcacagagtttggaaggagtaacatcgctcttggtgccgggctttatgtgaatgccttgcagaatctccctagcaanttagcagcacaatattttggaatcgcatacaaaatacgtcctaaatatcgtttgggggtgtttttggaccataatttcagctcccacgtttcctaataattttaacgtaagccacaatagactctggatgggagcctttattggatggcaggattctgatgctctaggatctagtgtcaaggtgtctttcggatatggaaaacaaaaagccacgattacaagagagcaattagagaatacagaagccgggagtggggagagccattttgaaggggtcgctgctcagatagaagggcggtatggtaagagcctcggaggacatgtcagggtccagcctttcctaggactgcagtttgtccacattacaaggaaagaatataccgaaaatgcagtgcaatttcctgtacactatgatcctatagactattctacaggtgtagtgtatttaggaattggatctcatattgcacttgtagattctttacatgtaggcacacgcatgggaatggagcaaaactttgcagcccatacggacaggttctcaggatctatagcgtctattggaaactttgtgtttgaaaagcttgatgtgactcacacaagggcatttgcggaaatgcgtgtcaactatgagcttccctatctacagtctctgaatcttattctacgagttaatcaacagcctctacaaggggttatgggattttccagtgatcttaggtatgccttaggattctaaagaagaaaatttaattttcttgcgaacatttctatccatagttgatagagataaacagataaaatatagctcagaatataatctgagctatattcttcttacttgcagccatgtctgaatatgagtatagtcagaaattctgcattgccacttccgtgtttaagcagatccgaaacctttaaaaaagttaggtcgcatatgaaatttatgaaagtccttactccatggatttatcgaaaagatctttgggtaacagcattcttactgacagcaattccaggatcttttgcacatactcttgttgatatagcaggagaacctcggcatgctgctcaagcaacaggagtttctggagatggtaaaattgttataggaatgaaagttccggatgatccttttgctataactgtaggatttcaatatattgatgggcatttgcaacccttagaggcagtacgtcctcaatgctctgtataccctaatggtataaccccggacggaacggttattgtgggtacaaactatgccatcgggatgggtagtgttgctgtgaaatgggtaaatggcaaggtttctgaacttcccatgctccctgacaccctcgattctgtagcatcggcagtttctgcagatggaagagtgattggagggaatagaaatataaatcttggcgcttctgttgctgtgaaatgggaggacgacgtgattacacaacttccttctcttcctgatgctatgaatgcttgtgttaacggaatttcttcagatggttctataattgtaggaaccatggtagacgtgtcatggagaaataccgcagtacaatggatcggggatcagctctctgttattgggactttaggaggaactacttctgttgctagtgcaatctcaacagatggcactgtgattgtaggaggttctgaaaatgcagattctcagactcatgcctatgcttataaaaacggtgttatgagcgatatagggaccctcggaggtttttattctttagcacatgcagtatcttcagatggttctgtgattgtaggagtatccacgaactctgagcatagatatcatgcattccaatatgctgatggacagatggtagatttaggaactttaggagggcctgaatcttatgctcaaggtgtgtctggagatggaaaggtaattgtgggtagagcacaagtaccatctggagattggcatgcgttcctatgtcctttccaagctccgagccctgctcctgtccatgggggaagcactgtcgtaactagccagaatccacgtggaatggtagatatcaatgctacgtactcctctttgaaaaatagccaacaacaactacaaagattgcttatccagcatagtgcaaaagttgaaagtgtatcctcaggagcaccatcttttacaagtgtgaaaggtgcgatctcaaaacagagccctgcagtgcaaaatgatgtacagaaagggacgtttttaagttaccgttcccaagttcatggaaacgtgcagaatcagcaattgctcacaggagcttttatggactggaaactcgcttcagctcctaaatgcggctttaaagtagctctccactatggctctcaagatgctctcgtagaacgtgcagctcttccttacacagaacaaggcttaggaagcagtgtcttgtcaggttttggaggacaagttcaaggacgctatgactttaatttaggagaaactgttgttctgcaaccctttatgggcattcaagttctccacctaagtagagaagggtattctgagaagaatgttcgatttcctgtaagctatgattctgtagcctactcagcagctactagctttatgggtgcgcatgtatttgcctccctaagccctaaaatgagtacagcagcaactttaggtgtggagagagatctgaattcacatatagatgaatttaagggatccgtctctgctatgggaaactttgtcttggaaaattctacagtgagtgttttaagaccttttgcttctcttgctatgtactatgacgtaagacaacagcaactcgtgacgttgtcagtagttatgaatcaacaacccttaacaggcacactaagcttagtaagccaaagtagctataatcttagcttctaagctattgttcaataaataatcagaacatgtgcagtccatagttggaaatgctgattaagtacccaactatggactcttctttttagttttaaaaatacacagatacaacgtgtagtgcctttaaaggttcagagactaataaaaatatttttaatttcttctggcaattcttccgccatatccttataactataagccgtttaactaagtgttgattttaacttggatcaacgtacttacaaagttaggtttaaatatgagtaagaagataaaggttctaggtcatttgacgctctgcactctgtttagaggagtgctgtgtgcagcggccctttccaacataggatatgcgagtacttctcaggaatcaccatatcagaagtctatagaagactggaaagggtatacctttacagatcttgagttactgagtaaggaagggtggtctgaagctcatgcaatttctggaaatggcagtagaattgtaggagcttcgggagctggccaaggtagtgtgactgctgtcatatgggaaagtcacctgataaaacatctcggcactttaggtggcgaggcttcatctgcagagggaatttcaaacgatggagaggtggtcgttgggtggtcagatactagagagggatatactcatgcctttgtcttcgacggtagagatatgaaagatctcggtactctaggagctacctattctgtagcaaggggtgtttctggagatggtagtatcatcgtaggagtctctgcaactgctcgtggagaggattacgggatggcaagttggtgtcaagtgggaaaaagggaaaatcaaacaattgaagttgttgcctcaaggtctctgggtctgaggcgaatgcaatctctgaggatggtacggtgattgtcgggagaggggaaatctctcgcaatcacatcgttgctgtaaaatggaataaaaatgctgtgtatagtttggggactctcggaggtagtgtcgcttcagcagaggctatatcggcaaatgggaaagtaattgtaggatggtccacgactaataatggtgagactcatgcctttatgcacaaagatgagacaatgcacgatctcggcactctaggaggaggtttttctgtcgcaactggagtttctgctgatgggagagccatcgtaggattttcagcagtgaagaccggagaaattcatgctttttactatgcagaaggagaaatggaggatttaacaactttgggaggggaagaagctcgagtgttcgacatatctagcgaaggaaacgatatcattggctctataaaaactgacgctggagctgaacgcgcctatctgttccatatacataaataaaagcatcgtagagaaaagataaacgaagtaaatcgtaagcttggaattcatgaagtgattcataattccaattttcatacttgttgtcttttctctatgtagataaagttaagtggtttttgaaattatttttgttgttagagtccctatgaaaaagacatgttgccaaaattacagatcgataggcgttgtgttctctgtggtacttttcgttcttacaacacagacgctgtttgcaggacattttattgatattggaacttctggattatattcttgggctcgaggtgtatctggagatggccgcgttgtcgtaggttatgaaggtggcaatgcatttaaatatgttgatggtgagaaatttctgttagaaggtttggtcccgagatccgaggccttggtatttaaagcttcttatgatggctctgtaattataggaatctcggatcaagatccgtcttgccgcgctgtgaagtgggtaaacggtgcacttgttgatcttggaatattttctgagggaatgcaatcttttgcagagggtgtttccagtgatggaaagacgattgtagggtgcctatatagtgatgatacagagacaaactttgctgtgaagtgggatgaaacaggaatggttgttctccctaacttaccagaagatcgacattcttgcgcttgggatgcctctgaagatggctctgtgattgtaggggacgccatgggtagcgaggaaattgccaaggcagtgtactggaaggacggtgaacaacatctgctttctaatatcccaggagctaaaagatcgtcagcacatgcagtttctaaagatggatcttttatcgtaggcgagttcatcagtgaagaaaatgaagttcatgcctttgtttatcacaacggtgttatcaaagatatcgggactttaggaggagattactctgtagcaactggagtttctagggatggtaaggtcatcgtgggtcattctacaagaacagatggtgaataccgtgcatttaaatatgtggatggaagaatgatagatttggggactttaggaggttcagcatcttttgcttttggtgtttctgacgatggcaaaacaatcgtaggaaaatttgaaacagagctaggagaatgtcatgcctttatctaccttgatgattagggttcttatggaagtcgtcctatactcagaaaattgctaacacatcaacgtagataaatgtagataactgacgattcttattctgattggactccaacaataatttctccatcaatagaaacagcgtttgcacaggcttctttccagctatactctcctaagtcgatcattcttccaccgacatatttaaaggcatgcaatttcccatttgctgttgtggacataccgacaataacttttccagttgcagagactcccttagctgcagaataagatcctccgagggtgccgaggtctgacatgacgccattcttatgacagaaagcatggacctctccataatatgtttcggatctccctacaatgaccttgccattattggatacagcttttgcaatggcagaatagcctcctaaagttcctagatgtgtaatagtgttcccttcccactttacagcataaagaattccagaggcgtcttgtacagaccctacaattatagatccattggcagatacagaattcgctacagatttgacagcccagcctactggtaacacctgagcctcgtgtcccgtccacttcacagcgaaagttcgcgaccaagcatccttagcactccctacaataacagagccatcagaagaaattccatacgctttagattgcactgcccatgtggaagggagcaaatacatttcattgtttttccatgtgactgcgaaactttgagaaagctcattctcgacaatccccgcgattatagacccatcagaggagattcctgttgcttttgatttttttacccatgagctggtagggagttctttggtcccccaataattccatcttactgcgtatgttcgagaccaagtgtcttttataaagccgacagttgtagcaccagttcctgaaacagcttttgcagaggcttttttatttgataatcttgagagagttgtctttccccaatgatcccattttactgcggatgaagaatggaagtcatcttctggtttgtctgtaattacatagcaataaccagatagagaatataatgaaaataggaccatccataagctactctgagatagcatagaacgtaaaatttgttttatagctgccatattttcctctcgttttcaaggtttgcaaatgaatttttttttaatccaagaaactataccaagatatcaaaagagctacaagcaagatcctaggagcggttttttaatgaaaatagaataagaaaggatttatagacgtgctgatgaagatgtcttgaaagagggaaataaagaacacattgcagatcagaaagataaggcccatagatctgcgatgtattcttgatttggagataagatagaaatagagaaaatccctctattcctcagaatcctcgtaagaaaatacattagaatctgtgaaaattgcttcggatccaagctcttcttcaatttccatgagtctattgtattttgcaacacgctcagaacgtgataaagagcctgttttgatttgaccagcgttgaaggcaacagcaagatctgcaatcgtagtgtccgtagtttctcctgagcgatgagaaataattgtagtatagccagccatttgcgcaacttgatagcatacactgtttcagtaagcgtccctatctgatttggtttaatcaacacagagttcgctaatccattgctaataccctctaatattaattccggatttgtaacaaataggtcatcacccacaatctgtactttttctccaagaacttcagttaacaaggcccacccgtcatagtcttcttcagcaagaccatcttctatggagtctataggatagcgatcacataaattagaaaggattgcgatttgctcttcatagtgcctcccatcatacgtgcctgtttttacgttatagaatgaggatgctgcgcagtctaaggctagcgatatatcttttcctggagtaaagcctgctttttcaatagccagcaataggagctctagagcttcttcattagaagcaagattcggggcgaagcctccttcgtcacccactccagtagataagcctctttcatggagtaattttttcaaagtatgaaaaacgtcagcacccatgttgacagcttctttgatggaagaggctccaataggacggatcataaattcttggaaccccaagccgttatcggcatgcatgcctccattgatcagattcatcataggacagggaagactgcaggcaaaacaccctcctaaataacgatacagaggtctgcgtagtgttgctgctgctgcatgtgctgtagctagagagactcctaaaatagcattggcccctagagtttctttgttcggagagccgtcagaatccatcatcagagaatcaattaaggattgctcataaacactacatcccttgacgaggggaaaaagaatttcttttacgttttttacagcttgcaaaacccctttgccttgataacgaggagaatctgtatcacgaaactctaaggcttcttttttccctgtggatgctcctgaaggaacccgagcttctccaacagaacctgtgctagtggttactttaacatgtaaagtgggatacccgcgagaatccaagatttccctagcctggatatcggcaatgacagcttcaaacataatttttatctcttttctttaagactttgctaagagctcaatagcatgtgaacctactgatcctgctctgcttcttgaactgtagatatgtattctaaaatacgtagctacggattcacatcaaactcataatgacaaaaatagataaatttggggaggaatattcttgaatatcgagatcagaaattctcttagaacaaatagagaagctgttctttgcaagcttgcattgcatcgcggtatttcgcagcttcgttgaatcgaaattctttagcagcacgttgcatgagagcttcgtatttcttaatttgctcttcaagatcttctttagatagggggcgttgagattccttgggagactccgagtctttagaggtttgtagaataggattggcaaaaatagcttttataatgggcttaggaacaatattgtgctctttattgtaatctaactgtatctgacgccggcgttcggtctctcgaagagtctcctctatagaacgggttttttgatcagcatagaaaatgactttaccattgatattcctagcagctcttccacaaaactgaatcagagatgacgtgcttcttaaaaagccctctttgtcagcatctaagatcgcaactaaagagacctcgggaagatcgagtccttcacgtaggagattgactccaatcaatacgtcaataacgcccgagcgtaggtctgtaaggatttgcgtgcgttctgcagtttctattccagaatgcaagtatgccgcagggatctctaattctgaaagaaaacccgccatatcttcggcaagtttctttgttatagaaatcactaggattttttcatgtttctgagacagccgcaaacgaatttcttcaagaagatcatccacttgtcctgtagcaggacggatttcaggcataggatcggggatccccgtcgggcggatgatttgttgtacaatatgacctgagctctcttggacttccgtatcacctggtgttgcagagacatagatgactttacgaaagtacttctgggcttcttcaaaaggttagcgggcggttatcgaaggcctgaggggaaacggaatccatattctactaaagattgcttccgagattggtctccacgatacatagcacgtatttgaggtagtgtttgatgagactcatcgataataaggagaaagtcctcaggaaaataatctaagaggcacgtaggcggtgctcctgggggcgcccctgtaaaatgccgtgaatagttttctatgcccttgcagaatccgatttccttgatcatctcaatgtcatgagtcgtacgatggaaaatgcggtccttttctataggacggtcgtcaaaaaaggccatgcgctcttctaactcctcctgaatggttcggatcgcttgctcgcgaattgcctcaggaatgacgtaatgagatccaggatataaagtagccgaagggacactttccttgggaatcatagtgaggggatcgctgtattctatggaggtaagggtgtcatttagaaattctaatcttagggcaagttcactttcgtatgcagggaaaatatcgattacactcccacgctctcgaaatgcacttctctgtgggatgggagatgcttgatagtgcattttaacaagctgagctgtcaggatattcctagggtactctttccctacctctaagactaacgccatggatgtatagttttcaggagaaccaataccataaatgcaagatactgaggaaacgattaaagtgtctcggcgctctaaaatagaccgtgttgctgataaacgtaacttatcgatttcatcattgataaggaggcttttttctatataggtatcactacgggcaatataggcctcaggttgatagtaatcgtagtaagagatgaaatactcaacggcattattagggaaaaattcacgaaattcttgatacagctgagcagctagcgttttgttatgggctaaaaccagggtagggagatttacgttggcaacaacattcgcaatagtgaatgtcttcccagaacctgtagttccaagaagtacttgtgattttacctgattacgcacacccgcagacagccgagcaatcgcctctggctggtcgccgcaaggagcaaaaggagcatgaagttggaatgtcatagtaaaaattatttaagcaatgagcgccatttatggctaaacccaaatttgtcatgaacttcttccatagtgactttggctacttcacgcattttatgcgtgccatcctctaagacgttttgtaatgccagaggcttggatagaaattctgagcgtctttcttttatgggttttaaaaagtgaatcagctcttcagcaaggcgtgcttttacttcgatgtctttaatgcaaccttgacgatagcgtgctttaaactcttcaacctcatctttatggggattgaagatgtcatgataaataaagaggggatttccttcaactcgacctggtgtggttgctcgaatccggttgggatccgtgtacatcttacggactttctcagtaattgtagcgtcgctatcggaaagatagatcgcgttgttcgcggacttactcattttcccttgcccgtcaattcctacaagagaggtaagctcgccttgtagtacctcgggctctggaaatacctgcccatacagacggttgaaatttctagcgatatcccgggtgagctccacatgcgcttcattgtctttccctacagggacaaactgtgctttcgctagaagaatatccgcactttgtaaaatagggtacccaataagaccataagaaagacttccctcctcgattgaggcatttcgggccatatctttgaggctgggaatgcccatcactctattgattgagatgagcatcgaaaataggagatgtaactcgtagatctcagggatcgcagattgtaggtaaattatagatttcgttggatcaatccctacacttagccaatcagcaagaacttcatagatgtggttatctacatctaaaacctcttccttgcggatttttgtagttagggtgtggagatcggcaataataaaaaagcaatcgtactcagggctattttgaagttctaatcggttttttatagaaccaacccaatgccctaaatggagtttccctgtgggacgatccccggtaagtacgcgcttttttttattcatgacgtccgctattgaagtgctttagttagctcatcaaagtgattttttaatgatgtaatttcttcttgaatttcctgaagatttttctctccaacaggattcttttgtgcttctaaaagtcttgctagtaaatgacgaatcaagtggcaggtattctgcacatcagtcatcaataagaactcttgaccatcgacacgagctaatcgatttaagaaaatacaacgctcttgttgggtaagcatatctgaagtgatgaaattaataaattccccgcgttcatggatgtctttagcgacacgaataggcatcataaattcggcaattaaactatgcgcagcttgcttttgctgaggagcaagttcttgtgttaacttgccattaattaacatctcgaaaaagaaatttgcaatctcttgctgaccattggcacagttgaaaacgacattttgaaattctcgaaaggttgtgtaaccaataggagtagcaaaaattctttttaaatttccttcaagaaggagaaaaacattgtcttcaagctctaatgtttttgtctttgctgccataaatcatacctttgtatcgggaaagaggttacttttaactttttctagtttttttatcaatttttccaaaatgatctgctcatcagaagagagactcgtacacttagttagtatttgagagcctttggtaagcatagcaagagcctgctttactggtgatgtttttctacaatctgtctcaactaaggggaactctttgcgaatgcgatctaaaagctcgctttttctttcccctcggtagtttcggataatctcttcttttttttcttggggcccttgacgagatgctaaagtatagacagcttgtctaggcatcttttccatctctatttttaaaggttcaggaagaagggtaaagagttcgtagtaaactaaaaaattatagggggtttgtctattcccataggttaagagaagccaagaagaaaaagcaccttcacgatagcttttcagtaaatcacggacttttgtgatgcgctccccatgtaaaaggacagattgatgatggatttgcttcacttcagcagaaagagtacagagctgggtaagatcaggttcttcaatctgttctcgaaagttgtagtgctgaagcagatgacggagttgctctttttctttagaggaaagcgtaggattggaaaggcgaacggcaagaggagagggatctccttccatgcgtttacgggcaagcgcttccattttagtgggagtattctttttgaagcgactttctaagagcgtttttagattccccatagagctaaatatctcttaataaaattagcaattctttagtgaggttgaaataatcttcagaggcacgtgcactgggagatgtagcaaagacaggtttgccatgaatcgcagcttctgaaacagtgatgtctctacgtattttcgtattcaataacttcccggggaaagttttgtgaatcagctcagcaaatgcggaattgtttttccctctgcaattccaaaaggataaggcaactcctaaaatcgttaggggatgtcgtgctgaaattccttggatgaaaccagccagacgttctagacctttgacactataaaattctggggtagcgcaaataagcgcataatcagcagcaattagggcagattctgtaagccaacaaagtgaaggaggagtatcaataatcacatagtcgtacttgtcttggacagaaccaagtacatatttcagtctttcatgagaatagcgatccgcagcaagatttcctgacacttcaatacgctctaaccaggtgtcagcaggaattaaatccagctgagtgtcttggatgggtcggatgacttcttgaatttctttttcgccttgtaacacaacagcaaggctgtcatagcaatcaggatctaagcctaatccagaggtgagatttgcttgagcgtcaaaatcaataagcaataccctggcttgatggtactgggcaagagccgcaccaagatgaagggttgttgatgtttttgctgttccacctttaaagctgtttacagcgatggtcttcattcttgatgcgtatcctcaaaaatccttagcaactacaataatgcagttaaacttaaagagttcttttcttcaagtatagtgtttaagaatctctctacagagacatcattaatcactcggttatctcgggtgcgtactgcgagtacattttcattaatttcatgatctccaagagtgatcatgtaattgacctgcatgttttgggcattgcgaatctttttacttacagactcactagaatcgtctaaggtgacgactaagcctaaacgtttccacgcttcctcgagctctttcgctctaggaatatggcgatcagcaactgtgatgatacgcacttgctcaggacttaaccataaggggaatcttcctttgaagttctcaatcagaattcctaaaaagcgttctatagaaccaaaaagagcccgatgtaacatcacaggaacactcttagttccttgagctgtggtgtattctaattcgaaacgctctggaaggaacatgtctaactggatggttccacattgccatgttctttgaatcgcatctttaacatggatatcaattttaggaccgtaaaaagcaccttctcctggacgaacaatgaagggtgtcccggactgaactaatgctcgatttaaggcatctgttgctagctcccatagagaatcatccccaatcgtatctttttctggacgtgtggagagttccaggtgatactctaatccaaatgtaccgtacagtgtagaaactaactgaagaatattcaaagtttcctcttcgacttgctctggagtaagaaatacatgagcatcatcttggtggaacgcacggacacgcattaaccctgaaagggctcccgaagcttcttgacgatggacatgaccaacttctgctacacgtagagggaactccttataactatgcaagcgggttttataatagagcatgcatcctgggcagttcatgggcttaatggcataatcttcatcgtcgatttgcagtgtgtacatgtttgctttataattgtcccagtggcctgaaacttcccataactgacgattcatcaactgtggcgttaggatttccttataacccgcagctgtgtgcagctgcttccaataacgaatcaatgcatcccaaacaatcataccgcgaggatggaagaagggcattccaggagaactttcttgctgagaaaatagatctaacttggcccccaaaacacggtggtcccgtttttttgcttcctcaatttgctctaaatgtgctcgaagttccttagatgtaggaaacgaagttccgtaaatacgtactaaagattctcgagaaggatcccctcgccaataagctgcagatgtgcgtaagactttaaacgcttttacatgagctgtagagggaaggtgaggacctcggcaaagatcaaaaaactccccttggctataggcagaaatttcttcattttcaggaagctcacgaatcaactctgtcttaaatggattctgtgggaattgtgctaaagcttgttgcttatcgccataagtaaagcgagaaatcgcaagcttttcatcaacaatttgttttactgtatcttcaattaacgggaaatcactttcgctaatggaaagattggcaaaatcatagtaaaagccatggtcgatgacagggccgattgtaggaattgcatcaggccataaacgcaatacggcttgggctagaagatgggcagaagtatgaagaaaaatttctcgtcttcgggatcttcggaagtcagaaatactaaggtgtcgccttcgtttaggtgggtggaaagatctctagggcgttcgttaatgagaacaccaatgaattgatgagaattttttaattgtttagcgagttccgctgctgtagtaccttcgagtacttcataatttttttgatcacaagttacttgaatcatcttgttccacgcctccatgttagggggactttcgttgttagcattttagtgttttttttgatcaaagcaagaagcttttttttataaaaaaacttttattttttaatacaagttccaaagcgccaggagatttagattggaactaataaaaacatcttttatactatctgcttaataaacattacaaactggtttgcatatgtcgctttttctagtttttcttacggcatttatttggtcttcttccttcgctcttagcaaactagttatgaatgcttcagctccgatatttgctacaggagctcgcatggtaatcgctggtgcgatcttggctcttgctgcatggtttcgaggcggttttgttggtatatcgaagaaaatattcttatatatcgtcctgttagctttaacaggtttctatcttaccaatatttttgagttcataggattacaaagtctaagttcatctaagacatgctttatttatggactctctcctctaatgtcagcacttttttcctatattcagctgaaagagaaagtgactctcaaaaaggttttaggattatccctaggcttggtgagctatatttgttacttaacctttggtgggggaggagacgattctcagccttggacctggcaaataggtcttcctgagcttctaatcttaggggcagcaagtttagcttcttttggctggactcttcttagacaaatcgaaaagcagtctacgttatcggtcacagcaattaatgcatacgcgatgttaatagccggaatgctatcaatcatgcactctgcagtcgtggaaccctggcgtcctttaccagtgcaagatatatcgcagtttctatacgcgactttggctctagtggtaatttctaatttgatttgctacaacctgtacgccaaattattaagaaagtattcttccactttcctttcattttgtaaccttgtcatgccactttattcaggcttttatggttggatattgcttggggagaagggagtctccttgggcttggtgttagctgtagccttcatggtggcgggctgtcgtctcatctaccatgaagagttccgacagggctacattgtttcttaaagtaaagccgctttacatgaaaaagctcggtatcaaaccgagctttttttgatcagatctctaattgtgattaattaaagatagcagatgttgtttgtgtttgagagtccgcaatattttgtagtgtttgtaaggcagtattaaatgattgcatagcttgctcttgtaattgtcctgcttgtcctgcttgctgaccataaaccgaagacatttgtttcaagacttctgcttgagcctctgcttgtcctgctaaccgctgatgatgggcgacttctattcctgtctgccccgcagaaagaccttcaacagccgctgtgagtccatgcattaattgactcatttgcatagaggaagaaagagcatttcctgcaaatgatgcaacacgcgctccctgagtttcactacgttcatacctctggagactttttcagaccagttaggtttatttaagacttcgccaaagagtcctcctgaagctttcgaagctccatcagaggccatttttgaagctgctgcggccatatcatcggttaggttcgctgcagctttggtggctgctgatcccgcagaactcgctgctgttgttgccgccttggcagtcgaagccatagtctgttgaacagaagaacttgcagaagttaaagctttggaagcagcacctccagcagctgaggcacctgtttctttggcaaaggaagcagattttaaagccgaggtagctccttttgcagcagagaaaatacccgctcctacagaaactgtaaatcctacaatgtttacaataccactaatcaaggactgttttgcctgtgcttctgtagctgatgcttgatggttcgcttgccttttaatagcctctccaatagcaggagcggattcgacttgtgaccggatcgcttggttttgtgattggaatgaagctttccaagactctccggcagcattggccatcaaggtcataactaaaccgaggagtgctaacgtacccatgccttttttaagtacaataccattgatggtctgtgcctcaggagtaggaaggctgggtgagtcataattattttgtcttaatcccttaggaccttgtacggcttgtgccgttgcagttttacttgcgcttgctaccgaagttgaggatttagatttcccagatttttcgcttttttctcccttactacttttagtagttgaagatgtagcttctttttttcctgtactttgcgctgaagcgtcttgaatgagatcctcaaagcctccagcagcgacttctgcttgagccccttgctttgttacattcttagtatcgtgaccgctctgagcatttcctgctttttgagaggattgtgccaattgcgcagccaatgtgggatcctgacttgaacttccactaactcctgatgtcatagcaatacatgctcctttaaaaattattggttttatgctgcgccacgatggctccgctgattgcggcatacgctttaaggatttgagcgcccagcttggtagctttttgagtcatttcattagactcgcctgtttgttttgaggcaattttacttgcctgttgccaaaattgagtgaacatagaaatcatatcagccgcagcctgcagttttccgacttctttctgaaattgagcgacgttttgttgcatctccgagagctgcatttgcataatccctttaccgagagcaggcgccgcaactacaaccccaaccccaaccgtgacccatttactggtaagagacgagatgactttcgagagcttggggaagttcttcgcaatcatttgagttcccttagcgaaaaccttagagattcctttagaaatggctttggcaatcgctttgactaaagttttgataaatgcttttattccagatttgacagccgcttttatagccgcggtgatcgcttgtctgacagctgtgataacagcttgtttcaccgcttggacaacagcttgaactgtaatttgtgttgctaccgtggttgcggcagcagctcctgctgcacctccagctgccgctgcacctacagcagctcccgcagcgagtccagcgagtccagctccgcatgtaaaaatagcagcaacaatagaaataactgtaatggcaacagaaaccgcgatcatcacagtattgacagtatccattgttccttcgagatctttagacttctgttcggcagccttcatctcttggtattcttctcgttctttatcgatttttatcgcttgcttttctagacctagtttatttgtttggtctgcttgtgcttgtgtacttgcatagttagataaggcagattttgtggcttctcccaatgtctgaattgctttagcaagcgcgagtccgatttcgataacctctgatcttggtgtcaccccgggcttggggagctcaggtgtttccaattttgcggaacccgaacttttccctgagagggcagcaacaacaaccgcttcgacttctttcatttgcgcggcactgaggctttgaagtgactctaaggtagactccatacttttgctcgcctcttcaatagaggtctgcatagcaatttttgttgcagtatttgatgctgtagtagcagccgctcctgatactccagtatcagcacctgccttttgactttctgaggattctttcccagcagcaactccctgttgtggagctgtttctgtttttgtagtcgaggaagttttgtcttttccagaagcaccagcaatagtggcatcgctttccatctcagtgtttttaccctgacgtgtttgctgtatttgcttcgtttcgttgccagacagcttatcttgttggggcacgccctggggtgtcgatgtcagaacttgagacatgatatttttttgattgtcaggtcctgaagaagatgaaatagacatgtttgtatcctaaggggtttgattctgcaaagggctttactcagcgcctttaaccatttgtttattaactacagtggttaggttttttaatccgtgtactactgaagataactcctttgcgaagttggcatcttcttgggcagaagggaataatccttgagttaactcttcgagatgtaaagattctagagttccagaaagagccgcgatgatgctattaatctgattcttgtcagtaagactggcaaatgtctgagctaagggaagctctttatatagatcagataccgcaagttctaactgctggatagcagcttcttgagattcttctggtacgcgctttacaggagctgccttagactgaactgccttttttgttttcttgggctttttattcatgatttctccttagaatcttactaacgtttctttccgcttttcttatttgtagttgttttgctttttcccgcaggtttttttgtcggtgctttcttagtttctccagccatctgcttctcaatagactgtttcataatttggcaacgttcttttaagattttgaattctgggttattcccacagatatccatggtgacgtctaagaaattgttagattcttcgggttgctgtagcttcaataagctatcagcaatgtagtaaggaggaattgggttgtcaggttgagcatcgaaagcaaggaaaaatccaaaagccgcttcattatataaatgcaattggtggtagcaggagcttaaccctaacatatacttgtagttctgaggttgtgctgctgccaataactggaagagtcctacagcttcgttgtacttcccttgagaatagaatgtataagctacagtatagatctcctctaagagatagtccgagagacctagaatctgttgtaggtctagtccattgctaagaccttcgaagatattgcctaaagcttttttaatttcttcttccgtaggtacgggatggacttgttctaagtcatcagcctttgctttcttttgagcagccagctctgctagacggttcgcgtttttttattgaaagaggctgaaggtttttgaggttgattggcattacgaggagagggcttgctcatcgatctaattcctaaaataaaattattttgtatttatgaatcaattttaaaattaatctttttctaaaaacaagcctattgataataatatttttattattttaattaatctttttctaacccgttcatttttaaggaaaaatggaaattagacggaagctttcttgacattagctttagggtattttaatttgctggctcggaaatttaacgaaggcacctatgtctacaagaaggcctattcagttacttgatcccctgaccatcaatcaaattgctgctggtgaggtcattgaaaactccgtttctgttgttaaagaactgattgagaattccttagatgctggcgccgatgaaatagaaatcgaaactttaggagggggacaaggcgcaatcattatcagagataatggttgtggcttcagagccgaagacatccccattgccctccaacgtcacgccacttcaaaaataagagaattctctgatattttttctttaaatagctttggctttcgaggcgaggctctaccctccattgcctcgatttctaaaatggaaatacaatcttccattgagggggacgagggtgtacgtaccgtaattcatgggggagacatcgtttcttgtgagccctgtgctcggcaactaggaaccacagtgattgtgaactccctgttttataatgttcctgtgcgtcgtggattccaaaagagcatgcaatcggatcgcttagggattcgcaagctgatagaaaatcggattttatccacagcaaacatagggtggtcctggattagcgagggacatcatgaaattcagattgctaagcagcaaggatttcaagaaagagtcgcctatgtgatgggagaccacttcatgcaggatgccctcaccatagataaagaagcaaatggtgtccgtattgtaggggtgttagggtctcccagcttccaccgtcccacacgtcaaggacagaaaatctttattaacgatcgccctatagagtctttatttatttctaagaaggttggggacgcctatgccttgcttctgcctctacacaggtatcctgtttttgtgctgaagctctatcttccttcgtcatggtgtgattttaatgtccacccacaaaaaatagaggctcgaattcttaaggaagaacttgttggagattgtatcaaagaagctatcgtagagactctagcatgtcctcctggcatcttatgtcgtacgcatcaagaaatagaagaatctgattcggtgcccttacccatgtttcgtatgttggaaacaagcgatgtgcaagaagaagagagtgtagagtttgatcaaaatctttttgcatatagttcagaagatgtttccttagagaaacaagaatatacatctagaggacctaagtcccaaatggattggatatattctagcgacgttcgttttttaacttctttaggtcgtgtggtcctggctgaggatcttgagggtgtgcacattatttttacagctgcagcgcgaaagcacctgttttttctgtctttgatgcaagagaattctcgcatgtatcaatcacaagcattactgattcctctacgccttcaggtgactcctgaggaggcttttttcttctctcatcacggaagaacgttatgcgacttaggaatagaaatatcacaggtaggaccttgtgttttctctattgaaagtacccccactgtcattggtgaagaagagctaaaagaatggttattgctattggcagcaaggggctctactgatataaactcagaggctttaacagcattgatgaaagaaactttgacgcaggcaacgttttctaaacatcagcatgtttttgatgtttcctggctcaaattgctttggagtgtagggaaacctgaaaaaggatttgacggtgcacgaattcgtcggttaattttagactctgattttatggaaggataatcatatgtcacacgatcgtattttacgtgctcaaagagccctctcagaacataatcttgatgctattcttgtggaaaaaagcgaagatcttgcttatttcctgcatgatgaagcgattgcagggatcttattgatagggcagcaagaagtgatgttctttgtctacagaatggataaggacctctattctcatatccaacgtgtgcctttgacttttctcactcaggatgttgttgcagacttatcgctctacgtacaaaaacagaggtatcagaaaataggatttgatagtgcctcaacagtgtatcacaagtttgcacagaggcaagtacttccctgtctttgggagcctttagagtgcttcacagagaaaattcgtagtataaaatctgaagaagaaattagacgcatgcaagaagctgcagctttgggatccgcaggatatgattacgtattgacgttacttcgagagggaatcacagagaaagaggtcgtgagacagctgcgagctttctgggctgaggcaggagccgaaggaccttcttttcctcccattattgcttttggagagcattcagcgtttccacactcgatccctacagaccgtcctttaaagaaaggagatattgttcttattgatattggagttcttctgaacgggtattgttctgatatgacccggatgacggcattaggaactccgcatcctaagcttttggaaagctatcctgtggttgtggaagctcaaaagcgcgccatggctctttgcaaagaaggagtgctttggggagacattgatgcagaagctgtgcgtgtactgcgagagcatcacctggatacttattttatccatggaataggacacggggtggggagacatattcatgagtacccttgttctccgcggggaagtcaggtgaaactggaatctggcatgaccattactgtggagccaggggtctattttcctgggattggtgggattcgcatcgaggacaccctatgtatagataaaaataaaaattttagtttgactgcacgtcctgtaatctcagagttagtttgtttataaattaaattggatttagtttttaaatttaaattgaatttaatttgtttttataaattgattttttttgttttttaagttatcttataactttatttttaacctgcccctcactatgtaccagcttctttcgataggttatagttttgtgagtttcatcgctctgctttggatgctgtgttattcaccgaactatgtaacagatttatataggatttctttgagtgccgaggaaagcttaggggggattcgagcgtttcctcaggcagagagcctcctgggcggagcctgtgctttaaattttccagatctagaagagagattgcctgatttaaggaaagagctgctttttctgggcagtaacgatagaccagacgcttgtggtgggaagttttcgctacaactagcctcttcaaaagagtgctacatcgcggctcttaaggagagagtctatttgaacgtcaccaactcttctcgaggccctgtgtattcattcagccctaaaggggtacccacagagttgtggattgagtgcttttctgtgagcgtggatggtagagtagaagttaaggtgcgcctccaaggtttacataaggagttaatttcgaagccgcgagattgtgaaaccttatttttaaaccctccagctaataaactagattgctgggagattgcgggatttagagtagatgcaagctttcctgtaaaacaaaagatacgtcgtatcggtgtggataagtttctcttgatgcatgggggagctgagtacgcggataaggcgacaaaagaacgtgtcgattttgtttcctctgatgaggagaattatagtcggtaccttgctgttggagatgttctcctttgggatggcaactgctggcagacctgcggagagtttcaaggagcgagctcgcgagcgcctctttttgaggtgaagaggatcgacgataaggtcatgattgcggatctatggaatgtcgggggtacgcaacgtcagacgataagtcttgtgaaaggggtgccttctcctatcgaaattaacgaagtgatacgtgaaatcgagttcactgggatgcgctcatggtcaaagcctatcgttttggtagggggacaaaggctgattctttctcccgacgattggatactaagaactgctaagggttgggagaaactttcaagggcagaccagattcaagattacgttacaggaaaggtaacaggacctcttttggtctttgaaaagttagaaaaggatcttcgagggtttgtcttgcgagggcatatgtttaatgcacagcgaactctcgtagagacaatcagtttaccgttaaaacaaggatttgagcctgctgtggcttctcaagaagtgtcttcaaacacacgtagcgcacagcacatccaggggcgaccaatcgtgggggatcatagatggtttttttccgtaattctttactgcatttagttgccctatccggaatgctctgttgttcttctggagtggctttaacgatagccgagaagatggcttctttagagcactcggggagaggagcagacgattatgaggggatggcttcgtttaatgccaatatgagggagtatagccttcagctgagcaagttgtatgaggaagcacgaaagctacgcgcttctggaactgaggatgaagctctgtggaaggacttaattcgacggattggtgaggtgcgaggctatcttcgagagatcgaggagctttgggctgcagaaattcgtgagaaagggggcaatctcgaggactacgccctctggaatcacccagagactacgatttacaatcttgttaccgattacggaaccgaagactctatttatttgattcctcaagaaatcggagcgattaaaatcgcaaccttatcgaaatttgtagttcctaaagagtctttcgaagactgtctcactcagatcctatctcgcttaggtattggcgtgcgtcaggtcaattcttggattaaggaactttatatgatgcgtaaggagggctgcagtgttgctggagttttttcctccagaaaagatttagaggcgctcccagaaacagcctatattggttttgtattgaattcgaacgtagatgcgcataccaatcaacatgtcttaaaaaagttcattaaccctgaaacaacgcatgtagatgtgattgcaggacgtgtgtggatttttggttctgcgggggaagtcggcgagcttctgaagatttataattttgtgcagtcggagagcatacgtcaagagtatcgggtgattcccttaactaagatcgatccaggggagatgatttccattctcaacgcagcatttcgtgaggatctgactaaagatgttagtgaagaatctttaggccttcgtgtagttcctttacagtatcaagggcgttcgttgtttttaagtggaaccgcggcgttagtgcagcaagcgctgactctcattcgagagcttgaagaagggattgagaaccctacggataaaacagtattttggtataacgtcaagcactccgatccccaagagttggcggcattgctttcccaagtccatgatgtcttctctggcgagaataaggcgagtgtcggagctgcagatggatgtgggtcgcaattaaatgcctcgatccaaattgatactacagtaagttcttctgcgaaagatggctcagtgaagtacggaaacttcatcgcggattctaagacaggaactctgattatggtggttgagaaagaagttcttccacgtattcagatgctacttaagaaactagatgtccctaaaaagatggtccgtatcgaggtgctgttatttgaaagaaaattggcacatgagcagaaatctgggttaaatcttctacgtcttggtgaggaagtttgtaaaaaagggtgcagtccttctgtgtcttgggccgggggtactggcatactagaatttttatttaaaggaagtacgggatcttcgatagttcctggttatgatctcgcctatcaatttttaatggctcaagaggacgttcggattaatgcgagtccttctgtagttactatgaaccaaaccccagcacggattgctgttgttgatgaaatgtcaatagcggtgtcttcagataaagataaagcgcaatacaatcgtgcgcagtacggtatcatgataaaaatgctccccgtaattaatgtgggagaggaagacggaaaaagttacattactttagagacagacatcacctttgatactacgggaaaaaatcatgatgatcgtcctgatgttacaaggcgtaatattactaataaggtgcgcattgctgacggagagactgtgattattggaggtttgcgttgcaaacagatgtcagattctcatgatggcattcctttccttggagacattcctggtatagggaagttatttggaatgagttccacatcagacagtctcacggagatgtttgtatttatcactccgaagatcctagaaaatcctgtagagcaacaagaacgtaaagaagaagctttactctcttcgcgccctggagagagagaagaatactatcaggctttagcagctagtgaggctgcagcacgagcagctcataaaaaattagagatgttcccggcatcaggagtatctttatctcaggtagagaggcaagaatacgatggctgctagtattttatctcaggagcttttggatatccttccttatacttttttaaagaaacactgtcttctccctattgaagagagtagtgaggctattactatagcccatgctaccgcgacttcagtcattgctcaagatgaagtcaaattgttaataaaaaagcctgtgcgtttcgttctaaaagaggaatcggagattctgcagcgcttacagcagctctacagcaatcgggaaggtaatgtttccgatatgttgttaacaatgaaagaggaagatggcactacgatttcggaagaagaagatcttctggagactacggatacgatcccagtcgtacgcttgttgaactggattctgaaagaagcgattgaagagcgcgcttcggacattcattttgagccttgtgaggattctatgagaatccgctaccgcattgatggtgtgcttcacgatcgtcattccccaccttcccacctgcgttcggcattaaccactcggcttaaagtcctcgcaaagatggatattgcggagcaccgtcttcctcaagacgggcgtattaagatccatattggtggtcaggaagtggacatgcgtgtcagcacggttcccgtgatttatggcgagcgtgttgttcttcgtattttagataagcgcaatgtcattttggatatcgcgggcttgcatatgcctaagggtaccgaaatactctttaaagataccataacagctcctgaagggatccttctggttacaggacctacaggcagtgggaaaactacgaccctctacagtgtattacaagagcttaagggacctttaacaaatatcatgacgatcgaagatcctccagagtataaactgcctggaattgctcagattgctgtgaagcctaaaattgggctgactttcgcacgagggttacggcatttactgcgtcaagatcccgatatccttatggtcggagaaatccgagatcaggaaactgcagaaatcgcaatacaagcagcattgactgggcatttggtagtgagcacgctccatacgaatgacgctatttctgcgattccccgtcttctggatatggggatagaatcctatttgttatcggcaacgctcgttggcgtggttgcccagaggctggtgcgaaccatttgtccctattgtaaggtcgcttatactcctgagaatcaggaaaaatcttttctagcttctctagggaaagatacagaaatgcctttatatcgggggcaagggtgcgtgcattgtttcgttccggatataaaggaagacagggaatttacgaatttttacgcccgaatacactatttcgttcagaagtagcctcaaaccgcccctatcatattttacgagaaactgcagaacaaaacggattcttaccgatcttagagcacggcatcgctcttgctgtatctggtgagactaccttagcagaagtcttaagagttaccaagcgctgtgattagggagggcggatgcctcgatatcggtatacatatttagatcccaaagagcgaaggaaacgaggatatttggaagcccttcatatacaagaagctagagaaaagctcgcccaggaaaatatccaagttttggatattcgtgaggtcgccttacgaagaatgagcattaaaagtaccgagctcatcgtgtttacaaaacagctcctcctcctcctacgctctggactgccgctatatgaaagcttggtatctctccgagatcagtatcatgagcagaaaatgggacttttgctcacatcgtttatggaaactctaagatcgggtgggtctttatctcaagctatggcagcacatccgaatatctttgatcacttttattgtagtggtgtcgctgctggagaaagtgtggggaatctcgaagggtgtctgcaaaatattattgttgttctggaagagcgtgcgcagattaccaagaagatggtcggcgcattaagttatccttgtgtgttgttagtattttcttttgccgtgatgcttttctttttgttaggagtgatcccttcattaaaagagacctttgaaaatatggaagtcaaaggactaacaaaaattgtttttggagttagcgactgtctctccgcataccggtatctatttttaggatttgcgagtgctttgattaccgttggaattttgatgcgccatcgcattccctggaaaaagatcctagagaagctcttatttgctttgccaggaaccaagaagtttgttgttaaggtagcggtgaatcggttttgttccgtggcatcggcaatcttgaagggaggggggaccctaatcgaaggtctcgacttggggtgtgacgcaattccctatgacagactgaagaccgatatgagagatattgttcaggctgtaatcggtgggggatctttaagtcaggagcttgctcagcgctcttgggttcccaagctcgctatagggatgattgctttgggagaagagtcgggggatcttgccgacgttttaggatatgtagcccacatttataatgaggatacacaaaaaacgttggcttcgataacgtcgtggtgtcaacccgtgattctgatttttcttggtggcctgatcggtgtgatcatgttggcaatattgatcccactcacaagcaatatccaaacattataaagtgtgtactcagaggagtcggtatgaaaagacaaaagagaaagcagtccatcacattgattgagatgatggttgtaatcaccctcatagggattattggtggtgctttagcattcaatatgcgaggcagtatccataaaggtaaggtatttcaatctgagcaaaattgtgcgaaagtatacgacatcttgatgatggagtatgccacggggggatcttcgttaaaggaaatcattgctcataaggagacagttgtcgaagaggcttcttggtgtaaagagggtaggaaattacttaaagacgcttggggagaagatctgattgtgcaacttaatgataagggtgatgatttagtcatcttctctaagcgtgtacaaagttcaaataagaagtaactcttgagtaacatcatggggtctcgacgtaaacttaaacgtagctttttacttatagaagtcctgatggcgctttctttggtttgtgcagtgctcttgccctgcatcagattttactacgccatccacaggtcttttgaggaagatatttttaatttgcaattgccagccctgatcgaccactgctttctatctgtngaagaaaagatgcgtcagcaaatggcagaaggaactgttctcacntcagggaaagggcagacagtttctttagcatataccagtcaggggataggctatcggatcccttatggttacaatgtagatatccgtcaggaagtccgtggtgataatcttaagatgaaagtttgccttgccgatgttgttgtggaacttttcccagatcagaaacaagcagtatccgtacagagatgcctatgtgtaactctatagctatgaaaaagcaaaagcgtggctttgtgcttatggaattactcatgtcgttcactctaattgctttgttattagggactttaggattttggtatcggaaaatttatactgtacaaaagcaaaaagaacgtatttataacttttatatcgaagaaagccgagcctacaagcagctcagaaccctgtttagcatgtccttgtcttcatcttacgaggagcctggatcattattttctttaatctttgatcggggtgtttatcgagatcctaagctggcaggtgcggtacgagcttctctccatcatgacaccaaggatcagagattggaacttcgtatttgtaatattaaggatcagtcttactttgaaacacagcgactgctctcccacgtgacccatgttgtactttccttccagagaaatcctgatcctgaaaaacttcctgaaacaattgctttaactataacacgggaacctaaagcatatcctccaaggacgttaacataccaatttgcggttgggaaataagcctatgcaaccttttatctttactttactgtgcttgacatctttggtttctttagtcgcctttgatgctgcgaatgctcgtaaacgttgtgcctgtgctcaaactatagaacgtggagagaacttcttttccataaaacgctctgcttgtgctgaaatcgaatatcaagaaaaatctcgccacgcctcagcaattgaaagaatctcaaaagataaaggcaaagtcactccaaagcagattgcgaaagtagctactaagaaaaagcaaagataccgtttattgcaggttcctttttcaaggcctccgaataactcaaggtataacctctatgctttgcttagtgaacctcccgaatgctatagcgatacagcatcatggtatgctatttttattcggttacttcgacgtgcttatgtagacacgggaaatgtacctcctggatctgagtatgccatcgctaatgctttgataagtaacaaacaagagattttagagaggggagcgcagcttggacccgatgttattgaaactctaacattgcctgaggaacaagccgagattttttataaaatgctcaaagggtcgtcaaactctcagtcgctactgaattttctgcattatgaagagaaaagcttaggccactgtaagctaaatctgatcttcatggatcccctactgttagaagctgttctagatcatcccgatgcttatagggaaacgtcgctcctgcgcgatggcatttgggaagcggtgaagcgtcaagaacatgccatccaagaacatggccaggcagctgctttggagctttttaaaacacgcaccgacttccgcctggagctgcgagataagatgcagttacttctaagtcgatacgatttgctccccttattaaataaaaaaatgttcgactacaccttaggaagtgccggagattacttatttttggtagacccagatactaaggcaatttctcgatgtcgctgcccttcaaagagtattaaattataatttaattttaatatttattttaaatagttttttttgataattgtcttaataagtactataaaaaatatttctataggtaggaccatggcagacgagaccccgaaagagaactcctccaaagaatcgtcctcacaatttgactctttgaagcgtaaggtgaaagatttacactccaatcctaaagtagggaaatggaagaagtttctttctcatcgagcttgcgaantatcggtggttgcttggtgctggttggtatcatcgctgattttatttcatgggctggaggactgtttattgcttgtggtgtggtcctaggttttcacgttgaaattcgtaaaatgcttagcaatctccagagctattcgattgctaatggccctattaagaatgcaattctctgtggcttgattttattttttgtattaaacatcccttcctttgcagtctcgtttattgttctctgtgtcattctttcttttattacaacagcaccgtcatgttcgacgtgttcgaaagatcattgtgacaaacatcaagatacttctaataaaccttcttaaaactactttttccctaaaggcaaaatgttgaagccctcctttcctcaactttttgccttgttttcaggcatgttcgtcgagagctcacaggctggaacgtatctcatgttttaagagatgcatccttttctatagtcttgaatttatagattcttagattacaaaagaatatgcgagagattccctaagataatccataaacagtgcgctaagattcgtaagtgagcgcatctccagataagagtcacgataagagcctaggggattagagtacttgagggttggaacctaggagcataatggggacttctttgaaccaagcaagagtgaaataatctatctgcttaattatgaaccaccacgccagggtgagaaagagaagacccatgaaagccttaagggcagagaggaggtagatgacctgaacttgaggtgccatacggttaataatccctaagaataggtcggacattaacatcgccaaagctgcaggagcactcagctgtatggtcatcacgagacagagctggcacatcttgatcatagtaatccaaatcggggcacttaagctcatcatctcggcaggaaagaaactatggatcggaatgacttcaagagtttgcaataacaaagagattacaatacggtgaccacccactaaccaaaaaataatagtcacgaagtaatggtataaaatgccatgcggagaggtctgctcaatggaaatcagggatgtcgcgccctctaaaccctgaatcccttgttggttagtgatgaaagatcctgccgattgtgcagcataaaagggaaatgctaaaacaaagcctatcacaatgcctatgatcatctccttcacaagtaaaacataaaagagattgttatccatgtaatttgtgatctgcgtatccgccaagacttttggaaagatgattgcaagccaagagagactaatcccgattttaataggggagggaaagagctttgctcctaagaagggagctacagcaaaaataggaagcagacgggctaataaaagaagaaaaactgaccaaacataggccggaggatgttgaaagatataatctaagtaagcagaacctaggttggaaaaaagctctggtagagagattcccataagctctttatttccatttatagaagttttggaaaatctgacctgcaaagcgtaaaatcatattgctaagccaccctccagagatcattaaggttccaaaaatcacgactagtttgactgcaaaagcgaaggtctgttcttggatttgtgttgcggcttggaagatcgcaaccataatcccgactatggaagctaagatgatgggaggtgccgaaacaatcaaaataagtaataatgattggtaggagtactcaaaaagaacagatttgaaactagttgcgaaaaatgctaacacggcacgtgtccttatttaaagctgatcataagcccttggagcagtaatgtccatccgtctaccatgacgatcaaaagtaactttaaaggtaacgaaatcgatagaggggataacatcatcatctgcatcgctacaagaacgttagcagtcactaaatcaataacaaagaaaggtagatagatcaagactccaatttcgaaagcattttttatctgacccataataaaagcaggaataatgattacaaagtcggaggcagtgaggtgcgctcgaatttccgaaggaaggttttctgtgagatcttgtaaaagctttgaatttgtgcttttggagtgttgcgaattaagaaagagcgcaaaggttctttagatttgtttaaagcgacaaacactgtttcagcaccttctgcagtgaagaggctttgaggaatggtattggcttcgatttccttgcgagcatctttatacatagccactcccgtggggaacatcacataaatagataggatgagtgcaatcccattgaggacttgactgggaggtgtttgttgtactcctaaggcgttacgtaataagactaaagtaatgataatctttagatacgaagtgagcaacatgaccaggaaaggcgatagggccaagaaaattaagatgatcgcttgcgttgtaatgtctggatacgtatctgagaaacttccatctgacagatggtctctagggagaacatcatcagcattcagtgggggcatgtaggaaggcactgacgatgcagcaacaggctgttgtactacgttcaaaggattagaattcgagggaggaggggtaggttgacaacgcgagggacaggagttttcatatagactggcgtcagaaaacagcatgagacgctcagcgtaaaaaaacaaagggaaaatcgaaaaatggatcgcataatagtgaatacctttattctttcttatcctgatcattagataaagaagaagaatccgtggatgatgaagtctcagatggctcgtctacagggttcttcgcttttagtatagtcgagaaagctttttctaaggcatctaattgtacatcaagctgcgcattgatgatccctgcttcagtctcgataatgcaacccccaggagtaacatcaggttttgctgtaagaattaaggagtcagcatactccacgatgttcttgagttcaggacgacttttctcaacaagaggtaaatctttgggattgacagagagtaatgatatgtttattttgtgtgagctctttcaatgcttgagaaataatagagacaatagtttcaggatgtaattcgagttccttcccaatgattttcctcacactcgcaattgccagaggaaccaaggcctcgcgtactcttatgcgtagatttttagtttcttcttctaagaaagcaatttgcttgctccaggattcagatccctctttaaatccttgatctttagcttcttgacgaatttgtgcacacttttgttctgtctctgcaacataggcttcgctatcggcttttgttttttctaacagctctttggcatcaaggaaagcagacgaaagcttcaggagataaaaccttcttatttggggagacatcatcatctttaaaaattaagctaaaaaacttcatctttactatggcgtagtatctttgaggctgatttacctcagaagagaaaacaccgctccttttattgtcgtgttatttttctatactttgtataaagctaaatctttacttataaagcttttatttcactaagactttcatgcattgttctaggcgggacttaaaataatccacatagggatggtcataccatgtttttaaagtctgctcgacgatatatgctcgaccgacatctaacctacgtagaaaataccatagaaaagaagcgttttcttttgttaatgctttacctaaaaactctaacccttgcttatgaacgaactgtcgtaattctgcatcagtagtccaagaagaaagaaaattcgtagtttctaaatgtttcatcggatgagattggcagtaggtaagaaagagtttctctgtaggggagagagcattcttcactcgttcaatcacaaccttatccagaatgtgcttcaactctttagcaatagaataaagacctaggcagttgattaaagcgatctttacaggacctgtatagtaaagtatagcatttgctgaggatgcaggaagaaagatttcttctgtaattccacaaggacggatctttttacttagcatatctagaagatagaaggctccgaaaggtgcacagcgatgtggggctatagagatgccaggcagtaagggtagaatttcttgaactaaaggctctggcaaccacgctaataattgaccttggatttcaggagggaactctttcatggcaatggtaatccatgaaggatgaattgtaggtagccaactcatcgtaaaagataaagattttaaagggatttcttcgggatgaggagattcaacaagaagatttttaggaagaaacctggagaggtcatcttccttggagtgcttcatcaagatgtctagagttccaaaagtgttggcagtcactaagcaccctcaatttcattgcttccttctggagcatctttatcactagagtctttatcactggtttccgcatttttgctttccccctgtgaatctgcatcttcttttttctctttgtcagcagctgctccctcggctttcttggcttccaaggcattctttgtatatggtgtagggttgaagaacccttttgtacctcccatagtcataatgagagtatgagttttccaaatgacccaaaggagaccacaagaaataacaaataaaatgagaatcaagacataaaaaatgagacggaatttggtgagcgaagacttcgcaagaataataccccaaacagaaacataatcgatttcttctgttaatccccaaggaccattaattgtaatatcactataantgcgcgatcgctcactacagagacgttctctggcacaagtcctggaacagcacttgcaataaggcgcttaattttggaaaccataatgctgttcggattgtccaaaacccctcgatgcttaatatacacagaggctgttaaaggaagattatcttcattttctgtagtgaaggaaatctgtactgaggcatcgacaacgccatccatttttctaatcgtagaggccatctgttctgataagccttcttgataacggattttttcctgaagctcggaaggaacaagaccttgttttgcaaaaagatctaacaggcttgtccctttcatacgtggaagacccgcttgatttagaatggcaagggcctctgtgatttgtgctgacggaaccgcgatatcccacatttgctcagtagctgctccggctgtagccgctgcagcttgaggcaatttttgtgcagccacccctttgcttaccaaaagcaccacaatctcattcgcttctctgccaggaagaccgtgcacaattagagacctgctgttacagcttgtacagcacagcaatgtcattagaaagaacaagcaaaaagaaatagatcgacgaaccataatccacgcatacctttttattcaccataacaaaaggggggattagtgccaatcgcgaacataaaatggtaatccttgtcttctttttcttcaagccacgatattaaaaaatgatttcatacatacctctcggcatggtgttccaattatgaaagggatgtttttttgaaggtaagataaatgctctctacctaatgtgatatttttcagagttttctttcctatcgttttatgaagctctctacctttgttgcaataagagtaattcacaaactcccttacttaagtcttaggcaaactttttggtttgagaatccgtgttcattttaagcatcgttgttgcggtacctacgttacctttcgagttctttgatggtataagagttaggggtaggacgttatattttggatagtcactcggaccattgtggtttcccttgcctctattttgagatagaaatacatatgtttcgtgccaactttggcgaaatccttttatataaatataagagattcaaggttttattcatggctttgctttataatgaaggaaacgtactaccgcgactttcttcatgagaactatttgaaaaacaagaagagcatgtttatgaaaatttataaaactgcaggggagttttttttagcaaatgcaaaatggcccttggtaccggctgggtatcgacgtgttcgaggaaaagattttgttctatccccgctcgtggacttagtgattctatttccttgggtaaccaaagactcccgatattcaccttgcagcatgacattcacttgtatttgtaggagtatagtagagtgtattcctgttgtaagtacattatttggtatcggacgattttgtgctgtgtggtgcgttgaaggtttctcaggctctacgtttgataagatctatcatacaattgtcgccgttctaggaattcttggtttgggaattcttacgttcattttaagaattattttttctgtgcttatgttgcccgtctggttcttatttaagtgttattcttagcgtacaagatggcgggactgcagatcatagccactaggattcttgacagttttctcctcccctgcttcgaggtagaagcccagacatttcctcaagtctttagcaaagttgttgtatataagtacaagagttctagaattttattgatagctttgctttataatataactctcgtcttagggcttatttttattcataagaaatacttaggacaaaaggggagggtaattctgaaaatttatcaaaatgaagaagaattttttcgagcaactgaaaggtttccatcaataggggcggggtatctacgtgttcgaaacaaaaactctgtattatttccatttgaggatttaatgcttgtatgcccctcagtacctaaagactttccactttcagctttcaaagtaacaactaagcttatctattggagtgtattagagagtatccccgtcgtgggagcattttttttcagtataggaagactctttgctatgtggtgcatagaagatttcccaggctctattttttctagaatctatcataccactgttggtgttttaggaattcttggtttaggaatcatcatgttcattttaagaattatctttactttgcttacgctacccttctggctcataagttgtctaaaatcaagtgctgcttgaccaagatcgagtcccggtgattgaagacggtttccgatagccactaggatcactgaggttccttcctctctgagataaaaactcatatttttcgtgtaaagactaacaaatcagttttataggaatgcaaagattgtataaagatcgagcatcttggtcgctctactctacagtgaagcacgtgttttatcttgactgttagaaaagaaaatatttccagaattgactcttttacacgtagttgaacttagttctaggggatctaggttttatttatatttaataaaacaaaaggaaaaataatgtgcttataagaaaatctgaatcagaaggagctttttttgaagcaactcaaaattatcctacaatacagcaaggatatcagctggtacggattcgtgagcacaatctttctgtccgagcacattttgacttatctctatctcttgatgcatcagtccatcccgcggcttaatagatagggtattgaattctagatgcttatttctatttttaaagagtagatttctttcggtgtcttgtctaaatggaggctatcaggcgtatttatcaactcttcttttgagtgggccggctttggatagttatttgtaagcgtatctaaaattgtaattatttatagcgtacggaattgtttgttggaggggctaagactacggagcgcagttttaagaattttcctaacaagtttcttcatcttggtatcatcggttagtgtcttgtctggatgagaagatcgcaaggatgacagtttgaaaaagcgttagaatgtagtttttaagatgtgaatccatgatctttcaatatcaagattcgatgagatggatcgtactatgcttgttaactgacgctttgtcttgtacagaagctaggatcatatcggcattaaaactcgagcgtacaaaaggtcctgcgtaaacaaaaagacccatagcttctccgactcgacgatagtaatcaaaagtctcgggagtcacataacttttgacttggagatgcttacgagaaggacgtaagtattgacctatagtgacaatacgaactcctatggaagccagatcttggagagtttgtttgacttctccttccatctcacctaatcctaccatgatcccggatttgattttaagatcggggaggtagttggcagcttgttctaacatgaacatagatcgggcataggttgctttgtgccgtactagaggcgagagcctcgctacagtttcgacattatgattataaatagtaatgccagaatctaacagggtgtggagagcagaaacattcccttggaaatcagaagctaaaacttctgtagtcgcttgagggagttcttcacgtaacttttgaatgatatcgactaaaccttgtgcaccaccatcctcaaggtcatcgcgagccaccatggtgattaccacatgcttcaaccccagttctttcgctgacaaagcaatgcgctcgggttctgtaggatctagcgcgggtggggttttagaatgcccaatattgcaaaaaccgcaacttcttgtacagacatcgccgagagcaaggtaggtggcagttttacgagaccaacattctgctcgattggggcagagagcttcttcgcataccgttggcattcctgagcgttttattgtagcgtccgtagcatgaaatgcagaaccttgtggtaagggcctctgtaaccacttggggaaacgctcgggaagcttcttccgcactctaggttggtctgtatttaaagttggtctacatttcatgacttaggagggaagtgtaaagggtgatttgtagcaagtaaagcaccttcagcccaaacttcagagagtgtgggatgagcatgcacggtttcatatatgcaaggtagggtcagctcattgcggatcgctaaggtcatctctccaattaatgatgaggcgtgaggtcctatgacataagctccgagtatttgctgggtaatttcatgactcacaatagcagcaaaaccatcagatgctcccaaagcaacagcttttccaatcgctttaaaaggaaatttggtgagctttgcaggaagattttgttgttctgcttcttgtagagatagacctaccatagcaatttctgggtgggtaaagatcacagaaggtatggcagaataatccataacttcgtgatgtcccgaaatatttttcgcggcaataacgccttggtgcgaagccacatgagcaagtagccactttccagtgatgtctccaatcgcatagatatttggaacattagtgcgcatggtttcgtcaacaggaatcacgccacgatcgtcccggatcactccagcattatctagccctatacttgctgtattaaattggcgaccaatagccaccaagacataatcaaactcttccacttgatcgttcacagtaatgcgaacttggttttgggattcttcgattgcagagatcgaggctttggtaagaattcgaattccttgtttcgtaaatttattcgttacggtttgagaaacttctttattgttaaccgcaagaatatgatccaaagcttctataacggtaatctcaacgcctaaagtgtgaaatagagacgcaaattcacagccaataacgccgccaccaataatagcgagctttttagggaggacttcaagttctaagatccctgtggaactcaaaattctagaggagaagggaacccctgggaaaggacgaggctcggatcctgtagctaggataatatgattggctttgattatagtcgtgtcttggccaataactttaacttctgtagaagatactagagatccggttccttttaagacagtaatcttgttgctgcggatcaatccttctaatccttgacggatcccctggacgactgtattttttctttttgccatcgcagggtaatcgattgtataaccatcaacatggatgccgaactctccgcatgcttaatgtgagatacaacattggctccagcaatgagggcttttgaagggatgcatccgcggtttaagcaggtccccccagcctggtcttcttcaataagagcggtccgtaattttgattgcgcagcagtgattgcggcaacatagccactaggtcccgcaccaataacaacacaatcaaattcttgggtcatattctcactcactgtaatcaagatttcaaaaagaaccccccttcataaatgcatgcatctcattaagaagaggaccctgtgcttattttagacctaaagattaattttcagcattgcttttttcttcgctgattctgtattgaacctcgcctatatatcccagaaaaagcaaacgttccctcggtaaatattgttttcttttttaatacccagaagtatacttgcattaatggcattttagcgacctaagaggtcgtgatttcataattgacaagaacgtattcgttataaacaagcatgtttaaatggatgagtttatgggggaaatgccataacttaaccctacagagggcatagttggatagcaattgacgaggaagaatgtatttctcctcatgatcatgaaaaaagtgaaagatacctatgccatttgctaaagagacagaaatgcaaaggacgtgttggaagtgtgaaggcagtgtatctatgcacgtgcctcaatgtccctattgcagcgcctttcttcaagatcctccagtagcctcaggagggttttcttcttgccacatctcgttcccagaaggagcttctaaagaagaagccgaagacctatttgccgtctcttcagaagattgggaagccgtgcttggagatcaaaaccctactcaagaaacgaataaacaagtgatccctgagtggacatggttacaaagttggcctcttgcagccttatttttaggcataggcttgctagcgtttgcctttctgattcttcttttctctacagacagtggattggttttgacttggcctaaaaatcgggcctatttttacggtattataggtgctgcagtcgcctatcgtggataccgtaaacttcctctttaattagcactaaatacaatttcttcgttaggaatcctcagggggaagcacacctgtatcatcttctacgggtgcatctacaggggactcttcactgtctgaagttccatgttcgtctttgtaggatagtatagtgaggagatcttcccgattcaacatgtgtaggatattagaatcttgagaggcaatgaccttatccaataagcgaattttcttctcaattaaataatggatgcgctcttcaagtgtatcttcagtaatcagcttatagataaagactgtatttttctgaccaatccgatgcacacggtctagagcttggttttccttggcaggattccaccaacggtcatacataatcaccacattgcctgcagtcaggttaattcctgttcctgccgcaagtaacgacccaacaaacacctgacaattaggatctgtagtaaatgtttcaatttcttccttccgattcagagattttccttgaaatcgaagcatacttgatcccaatttcctcaagatagagagtaatgatccgaatcatgtggatatattgcgagaatacaacaactttgtatccagcgtttaaagattccttaagtagcttaacgaaagcattccactttccagattcgtaatttttatattgatccgggtctttgaaaaatactgcagggtgatcacaaatctgcttgagatgatttaagagagcaaaaatgtgtaagaaattcgtagcaggttcttcgggagtttcaagcttttgaatatgacttttctctctttgcaaggtcgccatatataacttctcctgatccggagacaacgaacaagcaatgatagattcgaccttatcaggaagctcgggaagtaccagtttttttgtccgtcgcaagataaaaggacgagtcaactttaataaaagatcctgggaggggataatctcttccaattcttcagaagaacatcgtttggtaaacaactttttgaatagagcgtcagagggaagataattgggtaagataatgtctaaaagccctttaaactctaagagattgttctctatgggagttcccgtaagtcccagcttcatctgagcgtctatccgacagaggattttgtgaatttggctactcttgtttttagccatgtggatctcatcgaaaacgacaattgtgaatgctattttgtaaaacttatcgtagttttgtcgtagcgttccataagaagttaacaagatatcagcaggaggtagctcactcggtttgtttggcccatggaaagaaaaaatactcacgccaggaagatgattacttaaaatatgctcccagtgtggtaacacactttgttggacatacaattaaggaatttcgggcgcgctgagggctgtgaagactgaaatacaatatctagttaaggctgtagcttggtgagtctttcctaatcccatttcatcacagagaagccctgagagtctgtgattgtataagaaccacatccaaagtaacccgctgttttgatacgggcggagctggtggtctgaagaaaagagattttgtggaatcggaggtaaacacgctgcttttaactgtgagaaaaattgcaagtcttcgggattggctatagtatcatcagttactgatagtggagctagagcatctaatttaaagacgtcagtaatattcgctatgacagtgttctcagcgatcacacatttctgcgtagataggaactgttttaaaaattgaaacaggttttgtttcaaatctaaaaagccagcctgtgtaaatagaaaagtatgtttacttttcaatccttgtaaagcgattcctatggggacagatccgaggtttgtcttcagctccaattgcaaatggagaggagaggcaggatgaggcctatgaatcgactggatcaccaattcataactttctggagggcgtgtctgcggatttggaaataaaatacgctcatgctgcgcatactgtgtaagaaactgtgggacattttcaggaggaatgactctaggtagaaagcataacccttgtaggggagtgggaatcaaagagaatcctatatcttcgcgatatagaaatacaccaaatagccaacaacggctttcccctaaaccaacaagaataggcttgaggtcaagtccttttccacgagattgcctgtgaacttcaataagaaggtcttttaaattagggggagaggaaaagaaattggggagacgtcgtagtgccgcatcgttctttacaatgaaagcagggatgtcttgaggttctacaatgagcccatcttgaatcggcaaatcgtttttcttctctagaaagaaaccttgatttgtatagtaggtccatgtcccgaaacgtatttctgtagaagagggatctccgacatcatagtggaataataaaacaccttgttctgtgacattataagtaagatgaccttcgggacgttcgtttataaatgtttggaaaccgggctcttgaattagatgccccctctcattgagaaagtcttcaacctgttcggatttaactataaacgcttgttttggagatagcatccccacgacttgcatcagacctttcgtaggactatagcaatagtttgggtaaatgagactgccattgtctaaatccccaggagtgacgaggtaagcagaaaatgagaaggaagcgtcacgtagtagacggatatcatagcgtagtcgatattctagagaatcatagcagagcaaagaaagcagctgatctttgaatttatcagcgagcaaaggaatcgcatagatgggaagggctatggctttagggcctgtgatcatttcatgcgtttttgcaacgtattctacagaacctattctagtcttaggatgattctctctgtcttttttatggataacaggacttaatgtgaaatttaccttagcttcttctgcgcagaccgtaacatttgtaatactgatgtcgtgagatacattctctaaagatgtatgcgcgagttccaacttaggaaatatgtcttctaatgtaggaaaatccaagatttccgctttaaagaccaggccttgccattgaagagaaaaatgagaaggaaagccttgagaattttctcctatcgtaagctcagccccttcttcatttaagaaaaagaatttttttagcagtgcgatagagagcgganttcaagaaagtcttatttgtaaatactgtaggttcttcagaagcatgaatggtgcggagccaatcttggaatacttcctcggacagacactctattgttaacgtgatatgtggggattctagtgtataaaccatctctccttgagcttgtaatggaatcgagtcgaggaaaaagtgagagaagacggcataccaaaaggaatgacggaatttatcgtgtaaagggtgcaatcctaaagcgtcatagacagcaaaatatgcagtcataaggtggagacaacactcaccgtcaggacaactgcaagaagcaaaagttagcctatcaatatcttgaagttttaaagtgcttaaccaatagccctctggagcttcttcatcaggaatgcgtatggtgtaactatcctcacaaaagtctacaacgatctccttgcgatgtttaaggagatgttgcatcgcatcctgtcgaaagatggctaatgcttctaaaaccataatattatgctagcaacccgtatgttattttaattcactaactttaaaacaattgtaagagagagggttaaataaaacaagactggggagtatcggaaattccataacttgtaggcaatgtttccacaagccagtacaatcaaagctggatagctaagttgtagcaaaggcaagagtaggtgacttatagtttcaaaattcaaaatagaaattaaataggtggggataagagtacaaattactgctgaagcatagttcagtttcttaaaggaaactacacgagctagaaaatctgcaacaatacctactaaagcaatttccgtagttagacaggcaatgaaaacgctgactcctgcgagaatgctatttggccctaatgcaatcgcagagatccttcccagaatatgacctttacttacattcacaagtaagcccgcatgacgtgcagcagataaaacaaatccaagataggtcattcctagtaagatcgcagcaagaaagaaacctaaagctaaggaacgcttattttttttgctaataccttgaaaactaagagggatttcttcctctgtaggatgtttctcttcagctacgagctgacgtagagagatcaaaactatggagcagaagaaaaacgctgcaagtaaatccatagtattgaacccttcaatgaatcctgccaaccaagcttgacgtgcgttcggaataaattcttgaaccatggggtgggtaggaatcataaaactgcggatgatgacccaaagtaaggtaaccaacataatcgggaaaaatacagatcctagccattgaattaaacggctgagcttgcatgagaagatatagataagcacacagcaaatcgcactaaaaataggcaaagagggaatgaaagcactcttatgctcggatagtgaaatcaatgtggcatgagatactgcaatggctcgagggattccaccgaaggggcctatcaaaagtataatagccgtaataaaaatcatccctggaattcttcctatcgagaaaaagaacttctggtagtctccagaatagaatagcatactgactagacctaaaagaggaacgcatacagcagtaagcatcatgccgaaataggcagaccagggatgcgcattgtagtggtatcccagagctaagggaaagacaatattgccagctccgaagaacatagcaaaaatagatcctccaatagaccaaatggacaaactttttttatcatttgttttatgagatgcgttttttttcatcttttaaataaagtagagatagtaaagtgctgagtgaatgagtttaaagaatcatgatcttagaaatcaaacgattttcagtagttagtttttattgtactgtgggacaaaaggtagagttacgaattcttaaaaagctaacaactctaaatttatacagttttttttataacaaagcgattttctaagtacgggtactatttgcttcttttgcaagatatgaacatatagggcaattgtcaattttatgatgtaaagcaggacaatactgtcgtgcataatagatgagttgcaagtgcaatttcggtgtgttctcatggccaaaaaagcgagccagatccttttcagcagcggaggggctttttttttcagaaattttccatcgctgcgctaaacgcaaaatatgagtgtctacagggaatgtaggttttccataggctatcccaagaaaaacagaagcggtttttctgccaactcccggaagttgtgtgagaagagccatgtcattagggggttctccatgaaaatcacgcactaaaatttgagataattgataaatataggcggactttctctctccaaggccacaaggggcaatgagctggtatagcttccctggaggcaaatctaaaatagattgggcgtctggggcttttgcaaagagttgtggtgtcacggaatttactgctttgtccgtagaattcccagataagagaatagcaataagtagttgaaagggagaggaccacccttctaaagatggttttggattgggaaatagcgcgttgagtgttctgagaataaattgcttcatggtgagctattttccaatgcaaaatttactaaaaatttcccctaaaatactttcagtaacttctttgccagaaagcatcccaatcgagtgaagtgcctctcttaactccaaagcaatgatttctggaggttgcagatagaggtttttctgcgcttctttcagacagcgagccacctcttgtaagatcatgtgatggcgagaagaaactaaaaacactttagaggtttttccagcctcttgtttttgcatccattggattaaagcttgtttcacttgagtaagtccctcaccagtttttgctgagatcgcaaattgagggagcgaagtgtcaaggaatggaggaggggtgaggtcagctttattccataggaggaatgaaggttttgtaaaaagaattttaggaagatcttctagaggttgcgtcgcatctattacccagaggatcccatccgcttcttccatagcagaaagagctcgttcaatgccctctttttcaatgtcattgtctgttgttctttgtcctgctgtgtctagcagtcggatgcgtttgccttgcaagagccactgctcctctaagatatcacgagtggttccaggaatatgtgttacaatcgcccgatttttctgaagaagcgcattgagtagggaggatttccctacgttaggtttccctgcaaggatcaaacttgttccctgagcaagcctctgcccctcatcaaaactggaaataaaatcttccacgatatgcagagcattttgaattttttcttgagggacgaggaggtctggttgttcttcttcagggaagtcggctaggacttccaaaaacgccaatgcttcgataatcagagtatgtatttcttgaattttcttagaaaaatttccttgaaaatgcgtttgagcaatccgaaaggcgtctatattttccgcaacaatgagattttggattgcctctgcttgaaccaggtcaatttttccatttagaaacgctcgttgagaaaactctccagggagtgcaggacgggcgcctaaagcaatcaaagcgtctaaaatttgggagcaagcgaaaaatcctccatgacactgaaattcgactacatcttctccagtgaaggagcgaggagagcgcattagaagaagaagagcttggtcaattaatgtctcttcaaaaatgacttgtccaagatgtatcgtatgggaggcaaagctagccacagatccagaaaaaatacgatcggcaatgacaatcgcttgtgggccagagagtcgtacaacagcaatacttccttcccctggaggagtggcaatggcagcaatggtatcgtgctttagcataaaaatagaaaagttaaaggaactttcggatagaataccaagttttagattaaagaggtgaaaggagtttggataaatattaagactaattcaattggaatattttcattaatctttttataatttctttttatcgtttctagaggtcttgtgcagaagccccaatatattgatcgaatcactaaaaaaaaagtaatagaacctatattttatgaaaaaacaatgctcttcctatacaactctaagctagggaagaagctctcagtatttctatcaacacaccccatcttttctcgaatttatggctggcttcaaaggtgttcgtggacacgtcggcaaattcgccctttcatgaatcgatataagatttctgaaaaagaattgacaaagcctgttgcagacttcacctcatttaatgatttttttacccggaaattgaaacccgaagcacgccctattgttggtgggaaagaggtattcatcactcctgtggatggacgttaccttgtgtatcctaatgtttcggaattcgataagtttattgttaaatcaaaagcgttttcattacccaagcttttaggagaccatgagttaacaaaattatacgctcatggcagcattgtttttgcccgccttgccccctttgattaccatcgattccattttccctgtgattgccttcctcaaaagacacgttgtgtgaatggagcgctgttctctgtccatcctttagctgttaaagataatttcattttattttgtgaaaataaacggacggttactgtactcgaaacagagcagttcggcaacgtcctctatttagaagttggagctatgaatgtaggctccattgtacaaacattttctccgaaccaaacctatgctaaaggtgacgagaagggcttttttgcttttggcggctctacagttatcttgctctttttgcctaacgctatacggttcgataacgatcttttgaagaactcacgtatgggttttgaaacacgctgcttgatggggcagtcattaggtagatctcagagagaagaaatttaaagactttaaagactttttttggtattgcaaagagagataaaagtcaaaaatggcgaattatgtggttagtcatcttgtgggctctagctgcaagtttagcaatagcgctggtcgctaaaggttattaccgctttgtttattttcgtcgctatgctgtgcaagttatacgagaagtacgcctaagtatggagctcaaagaatgggcgcttgcagaacagcaactcctacctattttaaaaaaacggtcgtatcgacggcagtgtttatttgaatatatgcgcattctacgcaagatgcagcgtttcgaggaatccgagaaactgcttgccgaagcgaagaaattgggattgcgcggtccctattttttcttagaaattgcctataaagcctacaggtttggggcttttaaagaatgtgcacaggcgtttgcttccgttcctcaagatttgtttgaagaagaagacgctgcaaaatatgcttcagctctggtgcggttaggcgatttagatgctgcctgcagtttgattgaaccatggatttctcccctatctcaccaagaaacttttgtgactatggggcacatttatttcacttccaagcgttataaagatgctatagatttttataatcgtgcgaatgctttgggagtctgccctgttgaggtcacctataatttagcacaagcgtatcgcattacctcaagctatgcaaaagcaggcaaattattccgcaaactcttatcaaatcctgtctacaaagaagaagctttatttaatatcgggctttgtgaacaaaagctaggcagaccagggaaagctctacttatttatcagagcagtgatctttggtctcgtggggatgccttgctgatgaaatatgcagctatggcagctatggatcaacgagattatgtattagcagagccctgctgggaattggctttgcgctgttccacatttgctaaagattacaaatgcgggctaggctatggctttagcttgtgtcgattacgcaagtatggagacgcagagcgtgtgtattgtaatctgattcaaaatttccctgaatgtttaacagcgtgcaaggctttggcttggctttgtggagttgggtatgcaacactacttggttcagaagaaggcttgatgtatgcgaaaaaggccgtagaactcgaccatagttgtgaaactttagagttattaagtgcatgcgaagcacgttgtggaaattttgatgctgcttatgaaattcaatcgtttctttcttctcgagatacctctttgcaggagaaacaacgacgttcgcagattttgcgaattttacgtaaaaaactacctctcaacgatcatcatattgtggaagtggatgctctgcttgccgcttaaatctgatttttttaaattttttattctatggactacaaagccctcgtggctcgaagataacaaaaagcagaaatcagcttcttgggaacttttattcgttttattaagtaagatcgagtatggtattgagaaacgttctcgtaaaagatggtattctagtaattacagtgaattaaacgacatatgttaggttttcttaaacgcttctttggttcctctcaagagcgtattctaaaaaaatttcaaaaacttgtagataaagtgaacatttatgatgaaatgctcacgcctttatctgatgatgaattgcggaataagactgcggaattaaagcagagatatcagaacggagagtctcttgatagcatgcttcctgaagcttatggtgtcgtgaaaaacgtttgtcgacgtttagcaggcaccccagtcgaagtctccggataccatcaaagatgggatatggttccttatgatgtgcagattctaggggccattgctatgcacaagggatttattacagagatgcagaccggggaggggaaaacactcactgcagtgatgcctctgtatttaaatgctttaacaggcaagccagtgcatttggttactgttaacgactatcttgcacaacgagattgtgaatgggtaggatcggtactgcgctggttaggacttacaacgggagttttggtttcaggaactcttttagaaaagcgtaagaaaatttatcaatgtgatgttgtctatggtacagcatctgagtttggttttgattatttgagagataattctatagctactcgccttgaagagcaggtaggtagaggatattactttgctatcattgatgaagtcgactcgatcttaatagatgaagctagaacacccttaattatctcaggtcctggagaaaaacataatccagtctattttgagcttaaagaaaaagtcgcaagtctagtgtatttgcaaaaagagctctgcagccgtatcgcattagaagcacgtcgcggcttagatagctttttagatgttgatattcttcctaaagataaaaaagttcttgaaggcatctctgaattttgccgcagcctttggttggtaagcaaaggaatgcctttgaatcgtgtgttacgtcgtgtacgtgagcacccagatcttcgtgctatgatcgataaatgggatgtttattatcatgctgagcagaataaagaagagagcctagagcgtctttcagagctctacattattgttgatgagcacaataatgattttgagcttacagataaaggaatgcagcagtgggttgagtatgctggaggctctaccgaagagttcgtgatgatggatatggggcatgagtatgctcttatagaaaatgatgagaccctatcacctgcagataagatcaataaaaaaattgcaatttctgaagaagacaccttaagaaaggctcgtgctcacggattacgacagttattacgagcccaacttctcatggagcgtgatgtagattatattgtccgcgacgatcagattgtgattatcgatgaacatacaggacgtcctcaacctggacgacgtttttctgaaggcctccatcaagctatcgaagctaaagaacacgtcactatccgtaaggaatctcagacgcttgctacagtcacgttgcaaaatttcttccgtctatatgaaaagcttgcagggatgaccggaacagcaattacggagtctcgagagtttaaagaaatttataatctttatgtcctccaagtacccacgttcaagccttgcttacgcatagatcataatgatgaattttatatgacagagcgtgagaagtaccacgctattgttaatgagattgcgactattcatggcaaggggaaccctattcttgttggtacagaatctgtagaggtctctgagaagctgtctcggattttgagacagaatcggatagagcatactgtattgaatgctaagaatcatgctcaagaagcagaaattatagcaggagcagggaaattaggtgctgtgactgtagctacaaatatggctggtcgaggcacagacatcaaactagataatgaagctgtgatcgtaggcggtctccatgtgatcggtactacacggcatcaatcccgtcgaattgatagacagttgcgtgggcgttgtgctcgtttaggagaccctggcgctgcgaaattctttttatcttttgaagatcggctgatgcgactattcgcctcccctaaattgaatacccttatccgtcattttcgtcctccagaaggagaggcgatgtcggaccctatgtttaatagactcatagaaacagcacagaaacgtgtcgaagggagaaactatactatccgtaagcataccttagagtatgatgatgtcatgaataagcagagacaagcgatatacgctttccgccatgatgtcttacatgcggaatctgttttcgatcttgcaaaagaaattctatgccatgtgtctctgatggtagcatccttagtgatgagtgatcgtcagttcaaagggtggacattgccaaatcttgaagaatggataacctcatctttcccaatagccttaaatatagaagaactcagacagcttaaagatacagattctattgctgaaaagatcgctgctgaattgattcaagagtttcaagtacgctttgatcatatggtagaagggctctccaaagctggaggggaagaattggatgcatctgctatttgtagagatgtcgttcggtctgtcatggtcatgcatattgatgagcagtggcggattcatcttgtagatatggacttactacggagtgaagttggcctacgtactgtagggcaaaaagatcctttgttagaatttaaacacgagtctttcttactgtttgagagcttgattcgtgatattcgtattacgattgcgcggcatcttttccgtcttgagctgaccgtagagcctaatcctcgtgtcaacaacgtgattcctactgtagctacgtcttttcataataatgtgaattacggtccgttagagttgactgtagttacagattctgaagatcaagattaagaaataacctagaaggaggagtccttctaggtatttgtttcacaggctacatagtttttatttttaaataaatggggtccattctgaccaaacttggtcattatagtagcgaatccagaattttctgcgattgccggctatgaggaactgggcatagtggctcagtgtattgtttgctatacagaaaagaatgtgcttttggttcttggagttaggaaaatccttaggggcgttgagcaaagtatcaacgtttgtagtaaggagagactgtgtttttaggagttggttgcagtcgtattcaggttctgaaattgtcttcagtgcaatgttagaccagggagacctacttattgttcttggtgtatagtatttttaaatacagattcaccaagaacaataagtaggtctccctggtctgtattttcttcaacatacaccccagtttcttgatatttgtctagtgaagctgcttcttcagagttgtcaagtaagtcttcgaaaatctgatcgtggtcggtgtcgggcgtatcgtattggtcatagttcatgactttaaatctccaagaaataattaatttatttttatttcatggtaataatattttttattattttttaacaaattaattatgtctttttggtttttctttaaattctaaatcgaaaggtattccatataaattaaacgacgattttaatgtgttttttaaataatattcataatgttttgttaatagagactttgcatttataaataataaaaactgcagaggtgtcgttgtcttttggattgcataatagatcctcaacctgcgtccttgaatcacctgaggatggtttctatgtagagcagaagcaagagttttatttactatcggtgttggaactttattcgatactacgtgatgtagttcatcaattgcagagaagatctttttaagattgcgtttcgtagtagcagagatacaaagcattttagcttgtcctaaataaggatcagtagcgcgtagatctttgcagtaatgctccatgcggacttcttcaagtaaatcccatttgttaattaatatgatgtgaggcttttttcgtttagaaattaaagagaggatgcgcttctcataagaagagagtttttgtgtagcatcaatcacaagaagacagatatcagcacgagaaatagctttttcagttcgagatgaagaaatccattctatggaattcttaacgcttttcatttttctaagacccgcagtatcaatgaaaagatactggcggtccttatgggaatacagaatatcgatattatcacgtgttgtcccaggagtattatcaataatacaacgctcttcattgagaagaccgttaataatagaagatttccctacgttaggacgtccgatgagcgctatttttaatgtcttgggagcttgctgaggagactctgggatagtgcagggttcttcaggggagaagccttccgtgaatacttctgaaaaatcagggaatgtatttgaagggagagccgcctcagattcttcgtgttcatctacagaaagctcctcaaggccttcttcttcttcttcgcgaggttctggtaggttggctaccaacttaattctttgaagaagggtatcaatgtgcttatcgtgagctgttgaggtcactacaatatctcgaattcctaatttataggtctcatgaatttgtaattcctcttggcgactgtctgctttattggcgacaaggatgagaggtttctttaagggaaggaggagtttggctaggtgagcatcttcttcggtaataccacagcggatatcaatgactagcaataggacatcagcttccttagcgccggtgagggcttggttatagatatgcttttggaagtaatcttcagaattgtgatcaacacctccagtatcgatgacctgagcaggaacaccaaacgcatggagctcgccgtagaggcgatctcgagttgtcccctcttgagaatttacaattgctaaagagcgtttacatagacgattgaaaagtgatgactttcctacattgggtcttcctaagatggctatttttagcataatcgtctctattctattttttcagtaattaatgagaaaataataggagttaaaaaattaaagctaaagagataaatttctaagggttgtaaaagtaggattctatttaaattaatctacttccaaaagcctttttcttgtaaaagcaataaaattttttctttgtcgagacattcattttctatagagagaatctcagcttctctgagtagatcgccaagaagtcttccgggagagatgcccttagctatcagatcaggagccgaaacaacgggggaggatgtttttattcttaatatgaattgctctaagcgtgattcgagttcttgcactcgagagataaagtgctgctgtctgctcggatctttttgtagagccgagaagagctccaaaaatagaggtgctgtcggagacgctaggaaatgcgcccaaaatacacgattgccggattggttttggaaatgagggagtgcctcgtaccaagattctattaatttcaattctttattagaaattcgtaatcttccaaacgctactgttgcggcttcctcactgaccccttggaatagaggcagtaaaaaaagaatttcagggaaatgtgttggattaaacttacgggcaaattctatggttgttcttaagagactgtagggaatatcacgtagttcagggaaaataaaaattaagactttaagcttgagcagaagagagagggctccataaggctgtcttttaagcattttttttagctcttgccagattctctccggggatacggaatttactaatgccggggcttctttaataatggcgcgttctgtagttgggtctagggtgaagccgagggaggaagaaaaacgtatggcacgtaggatacgcagtttatcttctgagaatcttaaacgtggatggcctatagctcgaatgactttcttttcaatatcacgagttccttcgacaaagtcgaaaactttgtcttcaaaaggatcgtagtacatcccgtttactgtgaagtctcttcggagggcatcttctcgcatagaagaaaagatgatacgatcgggatgccttccatctttgtattcaccgtcagagcggaaagttgcaacttcaaataggcgtccgtcctgttttactacgatgataccaaaggcaacaccaatactgatgacgtctgggaagatcgtagatacaatcgttggggatgcattggtagctatgtcaatatcctcgagagggcgattcattaacatatctcgaacacaaccaccgacaaaatatgcctgatatcctgcattacgtagtttgataagaactttttttgcagcttctatggcaattgttgtcatgacacccctaaaataggaactaaaaagagctaagcgatagcttctggggtccttctgataattattggcgctttattttctgcgatagtgtcttcttggatatgaatagcttctactgtaggatctgaaggaatttcaaacataaggtctctaaggagattttctaggatcatccctagagcacgagctccagtttttgcttgcttggctttttttgctatagcatatagggcttcttttttgaagactaacttgacgttttcttctgcgaatagctccatatattgtttcacaatcgcatttgtaggttctgtaaggatggctacaagctcatccaaagaaagctcttcacagtttacaatgcagttgaatcttccgacaaattcagggatcattccgaaggcaatcaggtcttcggtttcaactttagcaagtagatggtctctggttttttgagagaggtctgcttgatcatcagaaaaccctatggtagttttccccaatcgctttgcgataatcttatctaggttgacgaaagtccgcctacgataaataagatattttccgtattgactcggatatactcttggttaggatgcttacgtcctcctttaggaggaacgtttgctgtggttccttcaacgatttttaacaatgcttgttgaaccccttcgccagaaacatctctagtaatggagacgtttgctgttgtccttccaattttatcgatttcatcgatatagataatgcctcgttctgcacgggcgacatcgtaatcagcagcttgtaataaacgtaagacaatgttctctacatcttcaccgacataacctgcttccgttagggtcgttgcgtcggctatggtgaagggaacatctaaaatttttgccaatgtttttgcaattaatgtttttccagatcctgtagggcctaggagaagcacgttagatttcccgtagcttacctgtttgttatgtagtagagcacgtatacgtttatagtgattataaacagcaacagcgattgtctttttagctctttcctgaccaatgacatattcatcaatatgctttttgatttccttaggggtaagcaccctgagatcagaaggctgtgaaggtgtttcagaaactggagctgaggatattgtagaggagggtttcttatctaaaattccagagcataatttgatgcagtagtcacaaatgtataccgaaggcccagcaatcagtttctctacatctttttcagaccgaccgcaaaatgaacaaatagttagattttttttattcatatgttctctctaagtgctacttgtatccttattagtttctttcgcagaagttaccaccttatcaataagtccgtaggagatggcttcctcggctcccatgaagaaatctcgttcagaatcttctataattttttctacaggttgtcctgtgcattcagagaggatattggcaaggtgtttttttagtgttagaatttcagctgcttggagttggatgtctgcggatgttccgataatgcctccagaaggttggtggatcatcatacggctatggggaagagcgtgacgctttcctttagttctgcggataataagagggctcccatggatgcagcttgaccgatgcagtaggtatttacatcacaacctaaaaagcgaatggtatcatagattgccagtccagcggtgatgtagccgcctggggaattgatgaaaatttgaatatcctttttaggatcttcggacatgaggaaaaggagctgggcaattactgtgtttgcgaggggctccgtgatttcctgaccgatcattacaatacgatctttcagaagacgggagtaaatatccatggccctttcaccacggcccgtatcctcgacaacatagggtaccagtgtcatttgcgtttcctcatcaaataattttcagttgtgtccatacgttcccgatcacgaaatgaccctaggaacgtagctaagactttttaggctgtctacgtcagcaacaagcttagacattaaaatctcgaattctatgtttaagactttcttgggtcaagtattttcctctaactaaaatttatgcagaaggagttgaagccaacagttctgctttgcgaagaacatgttcgatagctttgctataggtcagccgatcgcgggctgacattacaagttcttgtaaggtgtcattggaaatatctttaggaggttgttgtccgaagcgctctcttgaacatacatccatcatgtattgcagttcttcgcggctaatggtgagtttttcatcagagaaaattttatgagtcaaaaacagtaactttaatgcttttgtagcatcttcttctgcttccttgataagttctgatttcttttttcaagttcttcatcagaacaatattggataagacgtgcattaagaagtttttctcttgtgattaaggaaatacgttcttcaagcagggaggtaggaagttcaaaatctacgagcatggcaagagcatcttcagcttcagaaaagcgtttttgcaattgtttatctttagcttgcttctctagttgtatgcgtaatttcgcttttaaatcgtctagagattctgcttgtagttgacgagctttttcgtcatctatctcggggatcgagacttcgattacagcgtttactgtaaatgttaaagtatctcctcttaagaaggattgaatttcaggggaggtaattgtctcaacaacacgatgtccagtagaaattcctaagaatttttctttaaaggcatcggtcatttcttcttcagaaagcttaaaatatttgttttcaaaaatcgctgcagaggaagcattctcatcattacttttagagacgtgcaaggaaatagaaatgaaatcgccttcttgggaaggacgttctacaggagtttttgttgcaaagaacataccaatgtttgtgagtcccttctcgatatcactatctgaaatctcactagcagcttcttcctgaggtaaagaaaggttttcccaaggaagatcagaaattgcagggaaagcttttcataagagaactctactttggctccttcttgaagatcgaattgagtgattgagttcgaacggacagctttaggcgaaagaggacgacgatctccgactgtagataaggcatgataagcgtcttgagttactagttctcctaactcttttcttacgttagtaggatatcgggatgcaattacatcatcaggggcttttcctttgcggaatcctggaagtgtaatttcttttttaatctttttaagagcttgcttgttgagtttgttaagtacttctggggagacttttactaaagctgagacaatacaaccaggagattcttctaaatcgacggagaactgctcattggagagactacgtggcacaagacaaccctttttattagacttgaaaggaaaagcgggtgatgaggcttgaactcacgaccttcacgttggcaacgtgacgctctaccactgagctacacccgcaaagaaaagaatagtttagatttttgaagagttttnngcaacgactagagtctttagtatcatagaaattcgtgtctcttccccctgagaagggctttgataaaatttttcattgatttagcatgggtaaacaggtacaagtaagcagattatattatccactcttattccagaggagaaatgcttaattttcgcaagttacgccgggatttttcagccaatattttacaagatggtaaaaaactttttgagcagggggctgtgattgatgcgaaaatcctttcgatgaatggagagactgtctgcatcagcgctcaggttcggggcttgtacgacaacatttatgagtgtgagattgaagttgatcgctcggaatccgatactgtggattccaactgtgattgttcgtataactacgactgccagcacatcgtcgcactattattctatttagagcaatattttaatgagatggtagtagcctatgctcgtagtgctgatttagaaacggatcacgagatcaacgaggaagtaaaaaaggagctcaaggaaacttttgtcgctgctgccacaaaggaagaagagcgtaaagatcgtgagcatcaaaaagagattttaagagagtatgttcacgctgcaaatgctttaagtgcgaatccttttttcctacctttagaatatttagaaaaggattctgctgagcttgctgtattatttgtttctgtaaatgaggatacgtttgctcctgccaatcagcctatagagtttcaattagtacttcgtttaccgtgtcgttccaagcctttttatatctctaatatccgtacctttttggaaggggtgttgtatcaggagccaattgtattgaatgggcgtcggtttttctttacgatgcaatcgtttaatgcttccgatcgcaagctaatagatttattgattcgctatgtccgttaccccaatcatacaaccgaagagaagttattaaaatctgcgtatttgatgcctcctgcgttaggtgtgattcttgcaaagatgtttgaacatcaactggcagatcgtggaggaggaagtttaggggaaaaagagagtttttcagggttattctgtggaaatcttgaagagcctctgtgttggtcattaactccggctaagatgaagtttaacttagacttctttgacatgccctacaaagcgttgttaatgactcctgtgattcttgttgatgatgatgaagttcagcctgagcagaccatgttattagagtcggatgctccagggattattcatcattttgtttatcatcggttttctcctcagatcaagcgtgcgcatttacgttcctttagtcgtttgcgagatatagcaattccagaggctttgtttggttcgttccgtgagaatgctcttcctgtatttcaggaatatgctgaaattgcgaatgttcaccttttgaattcctttgtgacacttccttatgtagatgaggtccgggccatttgtgatatgagctatttggacggggaattagaggcaaaattacatttcctttatggttctttacgggttccagcagcatctttggctttgcaatatcaggatgttcgtgcctttattagtgatgagggaatcttagccagaaatctggttgaagagcgtaagatgttggaagaggtcttctcaggctttatttatgatgaacgcgatggagcttttcgtgttaaaagtgagaagaagatcgtggaatttatgacggagacgatccctgcgaatcaacatcgcattacttttaactgtccggaaaatctttcaggtcagtttatttatgatgagacgatctttgaattatcgttccgagaagggagcgacattaattattatgaggcagaccttaaggttcatggtttattgaaaggagtgcctttagatttattgtgggactgcattagtgcgaaaaagcgctttttagagcttcctaaagcgggtcagcaatctaagggaacgcggcgcggtaaggtgaattcgggtaagttgccttgtattttagtcttagacttagaaaaaattgctcctgtggtgcagatttttaatgaaataggatttaaagttttagatgacttagttcagaagtgtcctttatggagtttaacgggaatttcgttagatcagtttgaagcacttcctgtgaacttttccatgtctgaaaggcttatagagattcagaagcaaattcgtggtgagatcgagtttgatttccaagatgttcctcagcagattcaggcaacgttacgtagctatcaaaccgagggcgtacattggttagagcgtttgagaaaaatgcatctcaacgggattttagctgatgatatgggacttggaaagactctccaggcgattattgctgttactcagagtaaactagagaaaggcagcggctgttctttgattgtttgtcctacctctttagtttataactggaaggaagagttccgtaaatttaatcctgaattcaggactttagttattgatggagttccttctcaaagacggaagcagttaacggctttagctgatcgcgacgtcgcgattacttcgtataatttattacagaaagacgtggagttatataagagctttcgttttgactatgttgttttagatgaagcgcaccacattaagaatcgtacgactcggaatgcaaaatcggtgaagatgattcaatcggatcatcggttgatattaactggaacgccgatagagaactcgttagaagagttatggagtctttttgatttcttaatgcctggtttattgagcagctacgatcgctttgttggaaagtacatacgtacgggcaactatatgggcaataaagctgacaatatggttgcgcttaagaaaaaggtctcaccttttattcttcctcgtatgaaagaagatgtattgaaagatcttcctccagtctctgagattttatatcactgtcatcttacagaatctcagaaggagctgtatcagtcctatgcagcttctgcgaaaaaagagctttcacgtttggtcaagcaggaaggttttgagcgtatccatattcatgttttagcaactttgactcggttaaagcaaatttgctgtcatcctgctatttttgctaaggatgctccagagcctggggattcagcaaagtatgatatgttgatggatctactttcttctcttgtggattctggccataagactgtggtctttagtcagtatacaaagatgctgggcattattaagaaagatttagagtctcgaggcattccttttgtctatctagatggttccaccaagaacagactagatttagtgaatcagtttaatgaagatacctagcttgttggttttcttaatttccttaaaagctgggggcacgggcttgaatcttgtcggtgctgatacagtgaattcactacgacatgtggtggaatcctgctgtagagaatcaagcgactgaccgagtccatcgtattgggcagagccgttctgtctcttcctataaattggtaaccttgaacacgattgaagaaaaaatccttactttgcagaacaggaaanagagccttgtaaagaaagtgattaactctgatgatgaggttgtatccaagttaacttgggaagaagtattggaattgctgcagatatgattttatgagtccacatcgcaatctgtttaaacttaagaatttttccaatcgcctttacaacagggctttgggtcgtttcgacaaggtctttaattttttttctggtaatgttggcattgatttaggcactgcaaacactttggtttatgtccgaggtcggggtattgttcttagtgaaccttctgtagttgctgtggatgcacagacgcatgcagtgcttgctgtagggcataaggcgaaagcgatgttgggtaagacgcccagaaagattatggcagtgcgtcctatgaaggatggggtaattgctgattttgagattgctgagggcatgttaaaggctttaattaaacgtgtaactccttctcgtagtgtttttcgcccaagaattttaattgctgttccttctgggattactggagtagaaaaacgtgctgttgaagattctgcattacatgctggggctcaggaagtaatcttaattgaagaacctatggctgctgcgataggtgtggatctgcctgttcatgagcctgcagcgagtatgattattgatattggaggaggcactaccgagattgctattatttctttgggaggaattgttgaatctcgttccttgcgtattgctggggacgaatttgatgagtgtatcattaactacatgcgtcgtacgtacaatttaatgataggtcctcgtactgctgaagaaatcaagattaccattggctcggcctatcctttaggggatcaggagttggagatggaagttcgaggtcgtgatcaggtggcgggcttgccgattaccaagcgtattaattctgtggagattagagagtgtttggctgaacctattcagcagatcatagaatgtgtacgtttgacattagagaagtgtccaccagaactttctgctgatttagtagaacgtggtatggttttagctggagggggcgctttaattaagggattagataaggctttgagtaagaacacaggactttctgtgattacagcaccgcatcctttgctggcagtttgtttaggaaccgggaaagctttggaacatttagatcagtttaagaagcgtaaagggaatttggtatagtcatggtatggagcaccaacatcaagcatgaaggtctgaaatcttggattgatgaggttgctaaattaacgactccgaagacatacgtctttgtgatggttcggataccgagtatgatgagctctgcactcttatggagagtacagggacgatgatccgtttgaatcctgagtttcatcccaattgctttttggtccgttcgtctgctgatgatgtcgctcgggtagagcaatttactttcatttgcacttcgacggaagcagaggcaggccctacgaataattggagagatcctcaagagatgcgtagggagttgcatcaactttttcgtggatgtatgcaggggcgcactctgtatatagttcctttctgtatgggtcctttagactctccattttctattgtaggtgttgagttaacagattctccttatgtcgtttgttctatgaagatcatgactcgtatgggtgatgatgttttacgttctttagggacttcggggaagtttttaaagtgtttacatagtgtgggtaagcctttatctccaggagaggccgatgtttcttggccttgcaatccgaaatcaatgcggattgtacattttcaagatgatagtagtgtgatgtcttttggaagtggttatggaggcaatgctttactgggtaagaagtgtgtggctcttcgcttagcttcttacatggcaaaatctcagggctggcttgctgagcacatgttgattattggaattaccaatcctgaagggaagaaaaaatacttttctgcttcgttcccgagtgcctgtggtaagacaaatttagctatgttgatgcctaaacttccaggttggaagattgagtgtattggggatgatattgcttggatccgtccgggtcgtgacggcaggttgtatgctgtaaatccagaatatggattttttggtgttgctcctgggacttctgagcgtacaaatcccaatgctttggcaacttgcaggtcgaattctatttttacgaatgttgccttgactgccgatggggatgtttggtgggagggattaacggagcaaccaccagagcctttaacagattggcttggaaagccttggaagcctggagggagtcctgctgcccatccgaattctcgatttacagctcctttacgtcagtgtccttctttagatcctgagtggaatagtcctcagggtgttcccttagatgctattatttttggcggacgtcgttccgaaaccattcctttagtttacgaagctttaagttgggaacacggagtgactataggagcggggatgtcatcgacgacaactgcagctattgttggtcagttaggtaaactccgccacgatccttttgccatgcttcctttctgtgggtataacatggcatattacttccagcattggctttcctttgctgagaatagaagtcttaagcttcctaagatttttggagtcaattggttccgtaagaataatcaaggggagtttctctggcctggttttagtgaaaacttacgtgttctagaatggatattccaaaggactgatggtctggaagatattgcagagcgcacgcctattggttatcttcctaacattcaaaaattcaacctcaatggcttgaatcttgacctacaaactgtacaagaactgttctctgtagatgctgagggttggcttgctgaagttgagaacattggggagtatttgaagatctttggttcggattgtccgcagcagattactgatgagttgttgcgaattaaatcagaattaaaagaaaaataaaaatcaaagtcattagttatttataagttagttttaataacaattatttcttattttttataaattattttttaaataaaattaagaataattgattattattatctgataaataccgtgacgctacaaccgagctacattaatttcacccccaatgtgaccactgctttatctggtggtaagattgatacgtcagctatcgaactttcttgcagcgctctatttttccaagagttgcaagataaagctcagggtttaaaacatgctttgggtttagttcaggagttaagtgcagaggcacttcgtcccgcccaagttcaaacctcaatttcctatcttcctacagaagaatcctcacgtccagggatttctgctggaatcatagataggacaatgccgacctttactgatgacgaggtaaaggctatcctccaaaaccctaattttgaaacgtctaaaattttcgttgagggcttggataaggtcttcaagagttatttagattctgttacccctcccgagggtatagatccttcgaatcctgagagtgctattatacttaactatataacgctcttgaataatcttaagcctaaatttgctgctggttcgacaccaacagacgctgattataacgctctctatgcgttgcctggtgattttgtgaaggaaatcgaggctttgaaagcagcggatgctcctcctaaaagtaaggttcatgctttttggcaggagatcatgacaatttacaataacatgcaggtactttcctatcctgttacggattaccttaatgttcagattgcggatctttctcttaatattaccgctgctcaggaggtccaacagtatctaaagaacttttatagcatattaaaggacattttgaatccaggatggacggatccacaggcgacgcactatccagcagatgcagagtataatgctcgcgatgctggggtgattcaaagtttattaaatttgagtgggaactatcgtcagctgactgagaatatgctccccaatacagatacaagtcttccccaggaaattattgctcagattcgtagtttccaaaatggtgtgaatgggacgataattgcatccaacactcttctacctactaccatgagactcgatactctccttggtgttatctatacctatcagtgttgtgccactatttttggaatgagctatggaactagcactccggctaagcaaaattacatagatgctattaatcaagaaaaaagttactggcaagcgcgagcaaatggatttgatgtaactagtgatcaggtttttgaccaatttgctactaatatacagagcggcacttcatatagaggcatagatcttttcaaaaataataaagtaaacgagatcaatcctattttcttaagtcaggctgcatctttcttacggtatccgtataatttgatgtcacgtagtatgtatcaaactatagaggatgctgctaatagatctattacggctttggatgggctaatttccggttggagtacacagatagcaaccttccaaacgcagaaaaattctttggatccttctttgttgaagtattttgatactatgaaagccaacaaagagtcttttgtaaccacagctcctttgcagatggtctactcttcattgatgttggataagtatttgcctacgcagcagaacgtgattgcctccttagggatacagatgacgtattctaataaggctgctaagtatctcaacgaactaatcaaagagatcactacgtttcaatctgccgatatttattattctttatctatatatttgaaacagatgaatttgcaagcggtagcggatcctattggtaaggctgtgggtgttttgaatgatgaaaaaacacgagcgatggcagatattacccgctgcaataagataaaagcggctattgataagatgctcgttgagatcaaggcggatgcagagttatcaaagtcacaaattcgtgagcttgtggatacgttaacaaacttcaagtctcaaagcgacgatctgattcgcaatttatcttgtttactgggtttcttatcagggctcacccttaaagctgtgaatgaccctaatgctacgtatgaggcatttactgcagaaatcttcacagaaccttttaataattggaaacggcagttagctacatttgagagttttgtgattcaaggtgggcaaaatggaattaccccaggtggtcagcaacagctcttacaggctatggagtcttcacaacaagatttttcaacgtttaaccagaaccaacagcttgctctgcaattagaatcatcagcaatgcaacaggaatggactcttgtaagtgctgcccttgctttattaaaccaaatggtttcgaagattgcgagaaggattaaatcttagtacttaggaaatagaatattatgcatccgaaaatagaaaaaagaaatagccttccacttacggcagtcgctcctgtgtttgaagaatcgtatcatccttctgtagctacaactgtagattatgtagatgccacgacactttcccgacatcttacagtcttaaaagatgtgataaaagaagctcgaaacttagatttagggaaggcattcctgacatctatgaaacagggttttataaatacgggtacggaacttgccattatacaagcatctctggcagatcagagtagtcgcgagtcgcgtaagaaggaagagaagatcttccatcagcacttaggaaaggcagccccacaagcggcaacagcaacttcaggagtgcagcctactgcggatcctgttgctgataagatgcctttacaatctgcatttgcctatgttctccttgataagtacattcctgctcaagaggaagccctttatgctcttggaagggagttaaacctatcaggatatgcgcaaaatttatttagtcctcttttagatatgattaagagctttaactctgctcctatcaactacaatttaggatcgtacatatctcagacgagtggcactgcgaatttcgcgtatggttatgagatgattttatcgcgctataacaacgaagtctctcaatgtcgcctggacatagcaagtacagtaaaagctaaagctgcgttagcgaacatgtcggcttctgttaaagcaaatgtgagtctgactgatgcacagaagaaacaaattgaggatatcattgccagctatacgaaatctttagatgtgattcatacacagttaactgatgtgatgacaaatttagcatccataacctttgttcctggtttaaataaatatgatccttcgtatcgcattgttggtggggatttatctatcattgccttgcagaatgacgagaaggtacttgtcgatggtaaggtggatatcacgactgctgtgaatgaaggaggcctacttaatttcttcactacagtccttacggatgtgcagaattatggagacttagctcaaacgcaacagctgatgttggacttagagcttaaggcgatgcaacaacaatggagtttagtatctgcatctttgaaattattgaatgggatgtataccacagtaatttctggatttaaaaactaaaactgcagacctgacgtaatgttgatagcacgctgatatccccaacggccttctacactatagtagaagttatttgagatgcagcaggtagttccgaagcagaagtttactctgtcgaagtttgtgattttacgaattttaaatttaaaattcgtaaattgcttttcgagttctgtgaagctatcagaaggagcttttcttgaagtatttcctatagatacggatgcatagggaagcacatagtcattaagatacgtagagatgccgatgcttgcagaccattctttatagcttaggtttccatcagtagcatcgaaatagatctcggggttggccttgttgtaaacgatgatatagttgatgggactggaaccgtgacggtagtcagcgctcacccctacaaaagacactccatctttccacaatactttttgtaaactcagaccccagacaattccatagtctgactggacttcaatgagaccatctgtaacttcagattctgcatttaaaggatttgaagtgaagtctctgtaagcattgagagggaggcggtagtactgcttaagtcctccgacacgtgcagtgaaggctatatctaaaaggggaatggcagctggggatgtttcctgtagagctatggttgcaaaaacacagctcgagctgatggagctgttgttaagatcaaagtctacgtttttagttgtagaggtaatggttggcgttgttcctgtgcctgaagtcgtaacggaggtaatgacagggacattggtaatatgggcactttctgagaagacataatctccatagaacccaaatttgaggcttcctgcaagagcagcaaaaagatcgtaactattacaaagttggaaggcacaccatcccgtttgctcaggattcacacctgggagtactggagctgcagggtttccagcccctagggcatatactgcgggagaagatacaatcccgaagaacatagagaaggaaagggttgctaaacgtaaatgttttagcatcttgctattcatgtcaaaggggccttatttgcttttaatgattaagtcctctttaccagatggtataaaaaatgtacaaatgaaaagacaagtgacgggtaggatcttagaatgttgtaggtctcgggtctttttttcacctggattctttaattttctgaaagattataggaactcttcttttgtatttctctgtaagaggagagcaatgccctctttgagatcaagattttcatagagaacgcgatagattcccgtagtgatgggcatatcgattttatgatgtttggcgacttggtatgcagaaagtgctgtgtaggctccttcgactaccatcccaatttttgcttttgcttgttcgaaagtaagaccttgagcaagaaggtgcccgaaccgtaaattccgactcgactctgagaagcaggtaacacaaagatctccaagacctgcaaggccatttagagtttctggtttacaatccatgatagcggcgagtttacgcatttcatgcaatccccgggtcacaaggcctgcttttgcattgtttccaaacgataatccctcagcaatcccacaggcaatagcaatcacatttttcaaagctcctccgagagcagcacctttaatatcggtattagggtagactcggaaggtggggagggaaaaagcttcgtggatttgtttgagagtttgtgaatcgtaagcgctgactacgacagaacagggagaaccgtttaggacctctttagcgatggaaggaccactgagataccctaaatatggagtcacggaatctccaagcacttcgagcatgatttcactgaggaggagtcctgtattttgctcgattcccttagaggtaattacaaaggggaccgagaggtcagtgatttgttttaattgctctgctacgggacggattcctgcggaggtcactccttctacaatcatgaaagcattgtggatcgcttctttcatgtctgtagtgaatgaaaggtttggagagatgacaacattgggagctaaaggatgacgtcgttcttcttgtaattgcttgattaggtcagggttccgggaccatgccacaacaggatatcccttattcgcaagtagggaggctagacaaaacccccaaattcccatacctaagtagccgatgtgttgtttcatgaggcctcaaaaaatggttcctcgaaaaatgctttgttttcccaatgtagggaagttgatgttgaaggataataaaaatcagcttctaattcaaatgttgtgttaggagagagcttttttcctgtgactttgtggaagagttggcgctctcggtcagagagagcttgtcttactgtatcggggctatgattgccctccagattttttaggggagcaaagcactcttgtctaggatacacaagagtttgacaatggtcgctataacaaaatagatcaaagataaactcttcaaatttccaagcatttttctcatttaaggaggtatggcctagttgcttggcatgcttgtggactttatacaggggcagctgttggtaggcggcgtggcggataaagtccatggagagacagtaaagaccgatatttgcaaggcagtattttaattttccatcttcattaagagcgaatctctcgttttggggaatttcagagtattcgataacagaagtttttccagaatcatgagattttacaagaatacccacatcttcaatagcagtttgacgtagagccgcttttatggttacctcgttgttagacatcgcatggaatccacagagttctacgtcaaaaggaagcgctaaaggattgtcaatggggatcacacttaccatttctatgccagcatttttccatttctcccatactcctgaagtatagagaagggtagctatacaaccgttgccattcggaccaagagctagagtgtccatatcttcaagaaataggtctccagatagggtgaggaggggccaaagtggttggcagaaaaaatccacctgatttggatctaggtggaagtagtcgttggattcaaaaaaagaacgtgtttgtcgggtattcaaaggagaggtcatgaatgctagaggaagaggttgacctgcaagtttacttgcagcacgtaccttttctgctaccaactgaaacagcggcttctttttaataggagaaacagggaataaccctttagggccatcgcacttcaatcttgagccttgtccccctgccaggactacacaggcaacttttttctctttaagtagcgtagttcctgcatgagctcgttctggatcttctcctgaagaggcaaatgacgttatcggatgaaaatctttaagaattgctgttggtgaggaaagcagttgctgttgcttacgaaaaaaatcaatatctacagaggtgagctgctgaaaaagtctttgttgttgttttggagaaagggagggccagatatctaatatatgttcttgatttatggctttgagcttatctgctagagagtttacatgcatagcagagggcgaatataccgattcagtcattacagttagccttacgttcctatctcttgatccttagaatacttattgttcttgatcttttcgatgatttttctgcggtttattaattcctggagttgttggtgatggatttcaagaaagcgaagagattcgctctgttgtttataaagagatgattgtaatgtttttaagtattctaggagtatatcataatgttttatgttatctcgagaaataaaatgctcataacgttccaggtgtaaatcagcaatccttttatttgtagcttgaatatttcgtgatactgttaaagctaagcgcttctgattatgaagggtatctaaatatttatggatttttacttttaagattaaagataggctcccaagtcgatctctcatgagtctgctaatgcctcgagctgttttaatgtattgtctaagtaacagtaactagacaagggttgcgctaggaaggctttgatgctgggaaggagcttcactgctttatctaactcttcatcttgaccgggagtgtaagctcctagatgaatgatatctaaagcttcattatataccttaagtagtgaacgaagtctttctgcagctgcataatgatggggaagtgctagtgcttgtgctgaccgagaaagacttgataaaatatcgattgggggggaggctaaggctttaccttggcttgttaggaaaaagtgtccatccaacagcgattttaaatagtctgtaaaaatatcaggatgcttcgggtaatataaaatcgcatacagagctgttatggaccccttgtcattgtttccggcacgttctgtaaattcagatacatggtgaaagacagaggcggcatattggtgcgcagagagtgtttctcctcgcgctaaagcgacttcttggagtgcagcgatccatcgggataaagagtccataataaataagacttcatggccttgctctcgaaaatattctgctattgtcatagccgctcgccctgcgattacttttgttggtgcagtctcatgggcaggtgctgcaatgatgatcgtacgctgctgtttcagggcattgctatgcttctctatgtgttctcggacttcgcgtccccgctctccaattaaagcaatcacattgattgtagattttgatcctaaagcgattgctgagagcagtgaagacttcccacttcctggctcagagaaaactccaatacgctgtcctttccctaaggtaagaaatgcatcgattgctttaatccctgtagggaagatctgatcgataggttgtctcatcataggggatggcggtagagacagaagaggttttcgatgtgttttaggaaggtcctctttcttgtcaatagggttgccgaaagcatctaagactctccctaaaagatgatctgagagatgtagagagggggggcggcgtaaaggaaggacttctgttccaagagctacagagtgtaacggagatagggacatgagaagtgtcgtgtgattgtgaaagccaatcacttcagcaagaagattcggatctttggttgaggaaattttgcagagctcccccaggcatgcagagagcccatcgacctcaataagatttccagagaccttagataatagaccacaggcacggtagggctgccagttatgaatatgaagtttttctttatttagatgattcatgctgtcaaaacagaaagtagatggtctagttcttcgctgatttcttgtctcagaattccgttaggggtttctattttgaatcctgatcgtctacaagaagtgtcagggaaaaactcagcatgcttaatcatggggagttcgtgggtggagatccaatctgtaagtgttttgagatcctcgggatggagaaatactttgatgggagtcagagatcttaatgtcgtatgtctttggagcgcggtagagaggagcagggccagttcttgaggattttctagcttcttatagagaaatttttcacagatgagaagagccagttctagtaggtcgggttttagctgttgtactgttttttcgacttcactaagtaggtgaatggatagcttgcgaaagagatgaactaacgaatggagttcttggcttgccttatcattcggancttcgngaagacttgtaggttctgtatcccaaggatcatgtggatgaggaaggtgagattgagaaagcgaaccaggagattgtggtgttgtcacaagaaatacctaattcttaaagtttatatttcagcacttgatgtttgagatcttcgggtaatctgtttaataaggcttctgctttcttagggtccaggtacgaaagaattaaagctattttttctggagattccttttgtataatctctaacagctttgagatatttatgcctcgttttattttcctaggttcgggggagactctctcataagcgtgtcttgcgaggtagaaactagctaaagcaacaatcatcaagcttatgacaagaatcatactcccgattagaacttttgctgagaacgattttttattctgtaaacgagcgaaagggagggtttctatgacaatatcataggagtcgtcanagtttgataagaggtagtgtttagtatgggctacaatcttttcggattcttctttggttaaatgagcaatataattttcatttaaagtgagctgtaatgtgggcttctctgcttttgcgtgataccgcaagagcaaagtgttccttggggaaaattttccccaggtaattttctaatgtatggatgaacagagaatttacagttatagattcaggaatatagaggttccctaagttgtcagatagggatatatgttctcgtttcaacccaggaagactgctgcatagatagtctgtaattgagaagagtagtgaaggagttagggactcttcttttcttaaagtaagaatgacagagagatgcagaggagacatgacgtcatcttctgtagacagagcaatggcaacttttgcagatgcaatgggatggaaggaggtcagnctttttctaactgtctttttttgttagagattctatgagcttggggttccccatttgtgtgagcttcagccaattgccagaagttttttctgttttaacttgagtaggggctaaggatgggttcgaggatcttccaaataaaatagcacaactcaccaccccacctattaataggcatcctaggggagaaatccccaaagcggtaagtttttttgccaaattttgaaaaaacacaagagtccttcataaaaataaacgaaacctatggcattgttgccatcgtattcttctctatcaaaaagtaggaattattgacaattgcatctcctcttaggatttaggacttggaaaattttgaatgaaaattttagagcctacattccaaagaatggttagagaaggattttaagttgctagaggttgaatttgttggaatcaagaacacgtgaaatgaaagcctctacaatgatagagactcgtatttaggaatgtagggatttctactaaaagaagttggggggatggctacgggtgagaaagatttaatgatgattcatctaccttcacttgaagttcagggtagatataggctcttaggagctgccctatggaatttaaagtagatcctaatgacgaaggacatccagaacaattcccagaataggcaattgtgacaataaagttttctagggattctacagttacttcacctccgtccatagcaatgtaagggccgattttttctgctattgtagcgcgaagagcatagagcttttgttcgtgagtgagagcttcccaatcactctggctatagggattcgcgtcttcgaaatcaaggttcatgggagaattttgcaaaggaagcgagccatcctctaaggggatttcaagacattgctcaacagctgtatctaaggcatcaataacaaaatggtatagcgagatgctatcttcaggaagagcgggttggtgtgcgtgtacgcgtaaggatttatcaatatcatcaagagtcatcttgtaagcttcgctatagcttttcccacaaacaagattgcagacagcctccgctagtgggattagataagggtgaccaaagtattggaattttgcatccaggattacgccatttttcttatccacaagccaataaaaagtgacgcagttgcccatcagtctgtgcccctgttttccagtgaccagatgtgcttctttagcttcagcatcctcttcagaaaacgtgcccgcacaatgtggtgtaaggaattttttcataacttttgctgatagcgaggaccaaaaaatcattggttctagaggtagggtcatgaggaacttccaagtaaaggggtaagatgcttaatggcatcatgcatggcacgagcaagtttggaaaactcgaggtctttacttctttctgtaagagagaaatgtaaggcactgtgacataagaacggggagatcccacaattttgtaacacttgagctaggggctggaatctctcgtatcctaaggatggatagatgccttgctggtggagatggaaggcaagactctctgctgggatgtcaggaattgcagcaacaacgatattaggtaatcggttctggacctcggaaaatgccaattggattgaggggaggacgctttgtaactcttgaattagctttttacacaaattggaggtgtggaatgtgaaaagcggaagagcggaaatacgttcttcacacgcagtttgcattgctgccaccgcactgaaacataaagatgctgaagtgtgaggtggaaaccaggaagaaaagaccctctctaaagatttacgaatgaagatccccccgatagagcccatacctccaagagctgctgaagagaaagtaatgatgtcagcgttgaggatctcaggagttagaggagctcttcctaaaatgtcagaaatatccaagtgaaggaggattctgcggtctttgcataaggagagcagaggatctaagggttggattacccctgtcaatccatgagctgcagatagtgagaataacaaactacgtggactcaaggtttctataagctgttcttcaacaatcctaccttcgtgatttactgttacccagtcataggtagttccgagtccttgatggcgacataggctattaattaaaagctgttgatcatgagcaggaagaatgatgtgatttcttccttgaaacatggacagattttctacaagggctgccaggactatatgaaccacatgagggaaatgagggacaaaacgaaaaatatgagagtctttcaatccgaccaactgtcggatactctcctctgttttctcagctaattttaacgcggagccggggggtagagaaaatatgtccgagtgtagggcataactttctttaacccgctcagaaggaggaatagcgacttggttgtttaaccaaaaaattctgggtgcttttcgattttgtggtttttccattgatatacaactggttttcccgtcggtaattctaaagatagtacctcttcctcacttaatttttctagatccataatcaaagagcgtaaggaatttccgtgcgcagaaacaaaaacgttttttccattttgcagttgaggcaaaatatttttttcaaagtaaggcaaggtcctttgtttcgtatcatagaggctttctccctgaggaggagctgttttgtagctgcgcctccacagcttgacccgctcttctccgaactgttcggctgtttgttttttattttttccttgaagttcgccgtacattctttcgttgagggcactagattgatagagaggaatcatattgttttcttcttccgcactgtagatcctcgacatctcttttgctttgggatcttcatgaacaatataggggatcttcttagagtgatgatttgtcatggcgagtaaggcggtcatcagactacgtactaaggtagaggtaaagatgcagtctataggcaaattttgaatagctcttcctgcggaaaaagcctcttcaattccctgttggcttaaaggaatgtctacccatccagaaaataaatttttttcattccatacagattgtccatgacgtaataaaataagaagagccatatgttcctactagaatttagggtgagaagctaagcataagcagaaatcaacttttgtctagtagaaaatatagaagtaaaaaaagtttttaagcaaagaaaagtagaccagtattgccttgcttaggcacaataggtgcttgatatggggtaaacgtgacaaaagttcgtcttaataaatttttagcttctgcgggagttgcttctcgaaggaagtgtgatgaaattattttttctggatccgtgactgtgaatggtcgtgttgctgagggtccctttgttcttgtagatccagaagataaagtacaggtgggaggaacctctgttcatctcactaagaaagtatatttcatggtgcataaagctatcgggtatctgtgttcttctgagaagaagtttcctggaactaagttggtgatcgatcttttcgcacatcttccctaccgtgtgtttactgtgggacgtttggataaagagacctccggattaatcttagtgactaatgatggggaatttgcaaataaaatcattcacccctcctcaggaattaccaaagagtatcttctaaaagttagccgcgatgtctctgcaaaagatttgggaaaattaatggaggggactttcatagacggcaaacatgtgcgtcctgtctctgtgactaaaattcgtcgtggtacagtaaagatcgtcgtgagtgaagggaaaaaacacgagatccggttgtttgcagatgctgcaggacttcctattttagagctaaagcgtatccgtatagggagtttggttttaggaggcttgcgttatggcgaatatcgcgagcttacagatgcggaactcgggacctacatgaaattgtctgactaacttgtttttttatatactaacctgcaatagatagagccctatgggatatgttttctatgtgatcgctggcagtatatttcttggcatcagtttgggtgcctattgtcaactctactattcagtaaaaagcgtactattttcttggtacttgttaacagtatatgctttggaaaagcgtcatgcgttgctcgctctctctcaacttgtaggcgaagaagacgcccagtcccaaaaggaaatcgactttctctcgcagtgtgacaagctctcttggcgtgcgttcctcaaaaatagctacgagatcatcccaacatttcaaagagatggaagaccttctttctgaaagagtgcagggattcctagagtctatagaaacgattgcagagcacgatcgagcgatcttgtgtatcgaaaacttttgggcaagtaaaaatctatttgattttgagattgcagcttacgaagaagctgtggagaagtatcttaagttgcgacagcgagcccctttgagacttgcctcaaagttgttccgctttttagatgttccctcgattcgatttagtagctaagctatcgggaagattctcctgcaacactcctaggagatggtgtataagaagctccctggtagtctcaaggtctatgggatggccaagaatctcttgaagggatgttgcaggttgtccgacatcttttaaagcttgtttcgtagtattgccattgaggccgatcccaagaacgactccaagaagtccttctacagggagagtctctggaagaactccacagagcttttctccatgaaccaggacatcgttaggccattttatttttgcttctgtaattcctaaatccttacataaggcaacaacagcttctgtgcctaagcgaaagagacgtgatacatcgatgtggaggtctgtaataaaaaaacagaaggtattaagaagatccccctttgaagatttccagcttttaccaaattttcctgtgcccgcagtttgacattttgtggagattacagttaatgcataaggatcccacaaatgcatataggattttgccattgtgttcgtggagggaatttcttctatttcgtaataaataactttcatattctagaaatttacagtctgctcaatagtaatacgattatgagatatcataaatattttcggtatgtgaattcttgggtttttcttgtcgtacttaccttaatgctattaagtgttgtggtcatttcttcaatggatcctacagcgatgctggtgacctcctccaaaggcctcttgaccaataaaagtatcatgcagctcaggcatttcgctctaggatgggtcgttttttttatctgtgcctacttcgattatcacttatttaaacgatgggcatgggtactctactttttcatgatttgtgctctcgtgggccttttttttgttccgtcagtccaaaatgtccatagatggtaccgtattcctttcatccatatgagcgtacagccctcagaatatggaaagcttgtgatcgtgataatgctcagttatatcttggaatcccgaaaagcagatattacatcgaaaacaacagcattccttgcttgcttagttgtcgcacttccgttctttctaattttaaaagagcctgatttaggaaccgcattagtcttatgtcctgtgacattgacgattttctatttaagtaatgtccattctttactagtaaaattttgtacagtggtcgctaccatcggaattataggctcgttattgattttttcaggaatcgtctcacatcagaaagtgaaaccctatgctctgaaagtcatcaaggaatatcaatacgagcgactcagcccgtcaaatcatcaccaacgcgcgtctctcatttctatagggctgggaggaattcgaggtcgtggatggaaaactggggagtttgcaggtcgtggatggctaccctacggctacacagactctgtattctcggcattaggagaggaattcgggttgctggggctactctttactctagggctattttattgtcttatctgttttggttgtcgaactgttgcagtcgccactgatgactttggaaaactcctcgctgctggcattaccgtatacctagcgatgcacgtcttaatcaatattagcatgatgtgcgggctgctacctatcacaggagtccctctgattctaatttcctatgggggctcttcggtaatctctacaatggcatcccttggtgtattgcaaagtatctatagccatcgctttgctaagtactaacttttcagcaaacggagagcatttaaccccacaatcaccgtacttccctcatgaagaattaccgcgagccatagaggaatgatccctaacgatgcaggccaggagactaaaagaataatagcaagcgctagtgcaaggttctgcgaaacaacttttttcgtttgttttgctttttgaatgatccaagggagggacgacaaggagtcgtgcaggagaacaatatcagcagcttctattgctgtagcgcttccagcttctcccatagcaatgcctacagtagcttgtgctaaagcaggagcatcattaattccatcgccgaccatcataatttgacgttgtgttgcaagctcgcgtattttcgctaacttatcctcaggggtgagatcgaaaaatacctcagaaattcctaaaatttccgctgtattttcagcactgactttatgatctcccgtgagcatgctcacgggatagccgagatctttgagatcttgaatgatttctttagcttgaggacgaggaatatctcgaaaataaaatagagcaaaactattcccaacatacgctagagaacaaatctccccatgttgcttcgcctgataaattttttgttctatatcttcaagatactcagaaggcaccttccctagtcctgtttctacccgacctacaaaagcttcttgttcattgaaatagccacgaaccccctctccaggaactgtaagataccgatctgcaggaagcgaggataccttctgctccataaggtaagaaacaatagcctcagcaatcggatgagatgaagactgctctaaagctaatactgaagggaaaaaggtctcatttttagaaccgaagtagtcgcaacctatacaggtaagctcgccagtcgttaacgttcccgttttatccatcactacagaattacaaganactaaacgatctaaaacacaccgcctttcangagaaccccatgtttcgcacaggcattgatagcacttaaataggcaataggaatcgcaatgatcaaagcacacggagacgctgcaataagaaacgctagggcacggtaaaatgcactctgaggtcctaacaatggaatggaagtaaataaaggaaccaaaagggcaattccacaggcaattgcaaaaatagagagagcatatactgaagaatatttatctaagcgttgctgtaacctaggtttagagttctgtgcctgaatgactaaattgataatatgagcgatggtagaatccgatcccgtacgtaagacacgaagatcgaaactcccttccatattatgggctcccgcaggaacaatcgaccctggatgacaggatttaggaactttttctccagtaagatgcatgaggttgatagaagaagaaccatgaaggatttctccgtccaaaggcacaacctcgccacttttaatgcgtaggatatttccaacctcaatcttgttgattgcgactttttgtaagttgccatcttctaagacaagccaacccgtagtaggagcgagctgcttcaaagagactaaagtgctctttgctttccccgataccatctgtcccaacgcttctgaaatcgcaaacaagacaagaagcaaggctccttctaaagctcctccaataaaaatagagccgaagggtgctgatgtcatcaaaatatcaatgttcactaccttttgacatatgttaactaacgacttaatcagagcaggagtgccagcaagaaaaaatgtaaatactacaaataagttagagagattttttgcatggagccagaaacttagaagagcaatcaagtaggtccctaaagataaatacgccgattttaaaggaagattgtgactcaatttgcgattttgtttagatagaaggggactcgtatcttcagacatccctgattcaaaaaatgtattcactacttctgcagaaaatgaagtgaaaaacaaacgggagaacacgtagcgacctgttataataatttcattaatgatgagataatactcgcggaagtgatgaagatccctaacacccaaaccatttcggaaattttatcgttttttagaattttagcttttaggaaggaaagaaccagaaccataagagcagaaaagacccctgcaagagtgtagctgatgcataggactagtgggaggaaaatggcaagcccacatagacctcctaatattctagatcctccttgaatcaggggatgaggaagatcttcttttcgaatgtaaagctcttctcgaatcatcgtatctagtagtagggtagaatcggaacagacatattctaccatctcttggaggagagggtctttaaacccttgattctcaaacaaaatccggagttctattttttcttgttcaaaattctcttcaatctcgtttttctcttccagcatagaacgatgcgagagttccatataggcccaagcttttcttgcttttaagcatccgtggtaaaatgtccagccaacgcctaaagatattaaggattttacttgaagcgcacgattcgtaggaattaagaaaaacaacgtccgaatgaaaaaaataaaaacgccagtagataaagcattattagctaagtgatagaaaaaccctttaaaggttgtatggggctcccctttacagactctgtgcttgtctctaacatgctttatgtggtcctctggagtgcgtgatttaaagtggtcatgtggatcctgagtcataattttccttagaatttgatgctgtctacagtctgatgtgttctcactggtctttgggaagaagaatctccaaccctcctaaataaggacgaaggacttcaggaataaccacagagccatcagcttgttggttattttctaaaatagctaccaagagacgtggtgttgccagacctgaaccgttaagagtatgaacaaactgtagtttcccttggctatctttatagcgtgtcccagagcgccgcgattggaaatccgtacactgagaaatagaagacacttcataaaaagctttttgtcctggcaaccagacctcagcatctatagtcttggatnctgtaaaagacatatcccccgtagaaagcaaagaaagacgataaggcaacttgagctctgtcagcatttcttcaacaatactaagcattttttcataagcaatatcatcttgattgggtgttgtaaaggcaaacatttctaccttatggaattgatgcacccgcacaagtcctctctcttgagctcctgcagcacctgcttctcttcggaagcacggagtgcacgcagcatagtaaagaggaagttctttttctgttaaaatgtcttgggaacgaaacccattaagaacgacttccgcagtggggatcagatagagatactgctctccgtcctcaacacgatagtattgtccatcaaatttcggaatctgcccagagccaaataaaatttctttcttcactaataaggggggaagccagagctgaaatccatgagctgcttgcttctgtaacatatacgtaagaagagcccattccagaagaacaccacgatttttataagcaggccatcctgatcctgtcgtttttgctgctgcttggaaatctaagatgtctaactcctgatttagctctaagtgatgcttcggaggaaaggaaaatataggaaggtccccaacacttttaatgacttgatttcccgctttgtcctcggatacaggaatgtcgtcagcagggtaattaggaagatggctcagcaattcatgtagttgagcgtttttttgatcgaggtgctgctcaattttttcaagatccgcagcaagagtctctacctcttgaattaagtttgtcgcgtctaccccttgcgttttagctttatgtatatcttgagataagaggcgtctttgtgcttgtaaagtttctgaatccgtcttgagttgacggacctctttatccaaggagagtacaggttctaaagaaatttttggatcttttttacgaagtcgagtttcacattcttcgggagtcttgcgtataatttttatatccaacatgcttgtctcattgttaagtagaagtgtgcaaaagtgagagtatatggaagatttctctgagcaacaactcttttttatgcggcgtgctatagaaatcggagaaaagggtagaatcacagcccccccaaatccttgggtagggtgtgtggtcgttcaagaaaatcgcatcataggggagggatttcatgcgtatgctggaggaccccacgctgaagagctcgccatacaaaacgcctctatgcctatatcaggatccgatgtctatgtttctctagagccttgctctcattttgggtcatgccccccatgtgcgaacttactaatcaaacataaggtctctagagtttttgttgctcttgttgatcctgatcccaaagtcgcaggtcaaggaatcgccatgctacgtcaggcagggattcaggtctatgtcggtattggagagagcgaagcacaggcgtctctacagccgtatctataccaaaggacccacaacttcccttggacaatattgaaaagtgccgcaagtgttgatggtcaagttgccgattctcaagggaagtctcaatggattacttgtccagaggctcgtcatgatgtgggaaaattgcgagcagagtcccaagccattcttgtcggttctcgtacggttcttagtgacgatccgtggctcacagcaagacaacctcagggaatgctctatcccaaacagcctctacgtgtcgtcttagacagtcgtgggagcgtccctcctacatcaaaagtctttgataagaccagtccgactctgtatgtaaccacagaacgatgtcctgaaaattatataaaagttttagattccttagacgtccccgttttactcacagaatctaccccatcaggagtggatcttcacaaggtctatgagtatcttgctcaaaaaaagatactacaggttcttgtagaaggaggcaccacactacatacgtctttgctaaaagaaagatttgttaattctttggttctttactctgggcctatgattcttggggaccaaaagagacctctagtcggagtattaggaaatttgttggaatctgcctctcctctaactctgaaaagttcccaaattttaggaaattctttgaaggtcgtatgggagatttcccctcaggttttcgagcccataaggaattgaaaggaaaggatttttagagtagcatgcttagcatcggaatccgttaatgcgagggagtcaatgatagaaactcgagaagaggtaggctctgcaaattttgtttctttagaacgagctattgaggatttaagagcaggaaaatttgttattgttgttgatgaagcttcgagagaagatgaaggcgacctgattatcgcgggagaaaaaattacagttgaaaagatgacgtttcttctccagcacaccacaggagtggtttgcgctgctttaagccaagaacgtctcttaagcttggatcttcctcccatggttaaggataaccgttgccgttttaaaactcccttcactgtatccgtagatgctgctcacggggtgactacaggagtttctgccgcagatagaaccaaagtcgttcagttattagcagatcctaagagcaaacccgaagattttattagcccaggacactttttccccctagcaagttctccaggaggagtgttaaaacgagcaggtcatacagaatctactgttgacctaatggagttggcaggactgcagccttgtggtgtactcgcagaattagtgaacgaagactactctatgatgcgattgcctcaaattttagagttcgcaaggaaacataatattgcagtgattcccgtgacatcgatcattgctcatcgcatgctctccgatcgtttggtttctaaaatctcttcagcacgcctccctacaatttacggagactttacgattcatgtctatgaatccttattggaaggaatgcaacatcttgctttggtaaaaggcaatgttgctggaaaaagtaatgtcctcgtacgtgtccactcagagtgtgtcacaggagatattttaggatctaagcgctgtgattgtggagaacaattgagttcagcaatgtcctacattgctgagaagggaactggtgttcttgtttacttgcgagggcaggaaggccgagggatcggtttgggccataaagtacgtgcttatgctttgcaagataacggttatgatactgtagatgcaaacttagctatgggatttcccgtagactcaagggaatatggcataggagcacaaattcanattgatctcangttgacaaccataaaattaatcactcataatcctcaaaaatattttgggcttcaaggtttcggacttagcatcacagaaagagttcctcttcctgttcgcatttctgaagacaatgagcagtatttaagaacaaaacaggaacgtatgggacattggctagatctcccatgctgtaacaatcgggtacaataattttgaggagtatatgaaaacattgaaaggacatttgtctgcaaagaatctacgtattgctattgtcggctcctgctttaatcaagctatggctgatgccctagtttctggtactcaggaaacttttttgaagtttggagggagcgaggacggcttgatgactatccgtgttcccggagcttttgagattccctgtacgatcaaaaaacttttatcttctgaaagaaagttcgatgctattgttgcatgcggcgtcctaattcaaggagaaacagaccattataaccaaattgtaaatcaagtagcggcaggtattggtgctctctctttggaattttgtcttcccataaccttgtccatagttgcagctccttctgcagaaatcgcttggcaaagatcaggtattaaaggacgtcatttgggagtttctgggatgacgacagctatagaaatggcaacgttattcactcaaatctagttcttgtaagaacgtatacgtcccacaaaatttgtgggactcttccttctacagattgatgctgacagctccatttaaatggatgcgaactgcgatactctcagcaaagacatccaagcctcccgaagacaatgtcgtctcagaaaaatctaacacagtcccttgcgggagaagttgtttatttagcatttctctatgagaacgtaagctttttaccaataaggatagcattgtcgagtataattgacgtagacgattttctggacttaccgtagatccatgagtcgcgaccgaaagtcccgcaactaaactgggaagaccacgaaatgttaaaggaatatgctctccttgtactgtatagaaactgttaacaagattctcagcttcatcagaaggtaaatttttaaaactccacgccaaagtactcgcttccgacggagagagattcattaatgttgctaagcgaaccaaagtcatgtccgttcgagaggttccctcaaaacctaaacgattcgctcgataagtaaaataacgagagaatgcctcttctatagtcgcatgctgctgtaacatggaaagtagaggagcaaagtttatatagaactcttgagaacagttcttgtctccacaggtatctaagcaatacaggtacaaatctaagatcgcaagagaccgacgtgttctccaagcagaaagcagctgcgcactaggaacctctgttaagttcagtagagaatcgtagttgcccaaacgtcttagagataacaagacttcttgctgttctggagaaagcctcgcataagaaggacaaagttcagggaaagtacgcaacacatgtaacgcctttgcgtaaaagctctgtgggcacgagtctgtgaaataaggcttaaacgtggtgacagcttttgcagagcagcctacatgtctgagcacgatcgctgtttctaaaattctcaaggtattatcgaaactcttaggagaatttaaaaagaacaataattgtttgtgcgccgtctggaattgcttaaatgtcatacctccttcttcagaagggaggatctgagagagctgcatgtaagattgacgagacccctgtatcaaaagatgtaggtgaatcatactgcgaatcgcaatgtctaaagcggggacttttttattaaagagcttttcagaataggccatatcgataggagtcgatgtgagaagaggagcccctccagattccgtaagccaaagaagctcaggatactgacgtagtttttgttctatccaaacctcagaaccaattttaacctttgtctgcgagttcgtctgtagagatccttgggggccagcatagccgatagaattgcatcccataagtaaagctaatgggaaaaccaagactttgattttaagaatttttaacatggaagcctcttctctatcacgttgctttgttaatatctttaaatttaaagagattaactaaaaaccccattttgataacaaaatgcccaataacaaatcaacttgagaaacgcaaggacgttttcctcggaagaattaaagattccaacataaggatttagttatgttaataacttaataatttatttttgtaataaataggcctttttaaaaggaaaatgtgttataatctttaaaattaaatttttattttaactaaaaataatgaaaagagtcatttataaaaccatattttgcgggttaactttacttacaagtttgagtagttgttccctggatcctaaaggatataacctagagacaaaaaactcgagggacttaaatcaagagtctgttatactgaaggaaaaccgtgaaacaccttctcttgttaagagactctctcgtcgttctcgaagactcttcgctcgacgtgatcaaactcagaaggatacgctgcaagtgcaagctaactttaagacctacgcagaaaagatttcagagcaggacgaaagagacctttctttcgttgtctcgtctgctgcagaaaagtcttcaatttcgttagctttgtctcagggtgaaattaaggatgctttgtaccgtatccgagaagtccaccctctagctttaatagaagctcttgctgaaaaccctgccttgatagaagggatgaaaaagatgcaaggccgtgattggatttggaatcttttcttaacacaattaagtgaagtattttctcaagcttggtctcaaggggttatctctgaagaagatattgccgcatttgcctccaccttaggtttggactccgggaccgttgcgtccattgtccaaggggaaaggtggcccgagcttgtggatatagtgataacttaaccttctaaagctctctacaactaagcttcctttccccaaaacaatagggaagggaagcccagaagtttttctctttggccttcctgaattttcataatcaatcgcaacaggagagacaatgttatattttatagaacagctaaataaactgagtacgtcgttttgtgtattccctatgatcttattgttaggggggttcttgacatggaaattacgcggtttacagttccacgggttaaagctcggctttaacttgatgcttcaaaataaattggatgatagttcatcaaaagctaacgaagtttcttcgtacgaagctgtagccggaatcctagcaggaaattttggcacgggaaatatcgccggaatgctgtcgccttagcttgtggaggtccaggcgccctggtctgggtctgcttgcagccctcctcggagctatcgtccaatatgctggctcctatttaggttcaaaatataggaaacctgaaggaaatacaggagaatttataggaggacccatagcctgcctcgcttttggcatgcgtaaaaaaatactcgcaggattctttgctttattcactatcatgacagccttctgtgcaggaaactgtgttcaggtaagttgtatcgttcctctctgtgcagaaggaactccaggaaaactcctcgttggaattctactagctctcgtagtgatccccgtgttagcaggaggaaataaccgtatattaagattctctgctcgtgtgattcccttcatagcaggattttactgtatttcttgcgggatcattctcttccaacatgcctcggctattcttcccgcaatcaaactgatatgctcttcagcattcggcattaaagccggactcgctggaatcggaggctatactctttcgcaagtcatctctacagggattaaccgtgctgtcatggctacagattgcggcagcggaatggtatctattttgcaagcaaatacaaaaagcaaaaatcctgttgtagacggactcgttactctagtccccccagtcattgtgatggttgtttgctctattacaatgctcgttctaattgtctcaggagcttacagctcaggagcccaaggaactctaatggtcatgagtgcctttaaaaatagcctcggctctctaggtagtgtgattgttattctcgctatggccctattcggatatacaacaatattgacatggtttgcttgcgcagaaaaaagtttacaatatatgatcccaggaagacgagcaaatctatggttgaaggctatatacgtcttgatcattcctctagggggtgttatcgatatgcgtatgatttgggccttatctgacacaggtttttctggtatggtcattctgaactgcatagctctaatcgccttactgaaagatgtactatccacaaaccgcgatgttgctttgcttaaagaacgcgagtgctctgttgcagatcctgtgcgtaatctagatgcttaaaggagaagaatcatgcaattattgtccccagcgtttgcttatggcgccccaattcctaagaagtatacatgccaaggcgcagggatttcccctcccttgacttttgtagacgtccccggtgcagcgcaaagtcttgctttgattgtcgaagaccctgatgttcctaaagaaattcgtagcgatggcctgtggatccactggatagtctataacctatccaccacaattactaatcttgccgaaggagctgaaatcttcgctgtgcaaggattaaatacttctggaaagcctgtctatgaaggtccctgtcctccagataaacagcaccgctaactttctttactctatttgctcttgacgtagttcttccagaagaagaaaacgtcacccgtgatcagctatatgaagcaatggaattccatattatagaacaagcagagttaatgggaacttacgagaaaagttagaatttattcctcttcaggaataaattcctctcgcttcttcctgtgtttccaatatagcgggccatagtgatagcaaatttcttggcccgcatatatcggtgctattgtcctgataatcacgtgaaacaatccctcactgaaaaccccgatagcttccgcattaggttgttcgctgtgattgataaaacgtgtgacgtttccctgcttcccactatcaatagtaaaatatcttaaagtgaataaaggcatcggataacgaaaacaataatcgttctcatccatccaaattgcctgccggtgacgcaaaattcccgtgtattctccgatatatgtccaaggagcaatttcatcacgagcaaaaactccataccctacgtgcgcattaatccaacagacagaaaccggtggagctggaggacataatagatcttgcttgtgtagttttcctaaccacttggctagaggagaaatcaaacgacgtttttccgatttgtgacaaagagtctcaatttgctgttctaccttccagttagaaaaaactaaagaaggaagaaaccgaaaatgaagaagttcactcgctcggtctaaagaatacggctggctatctcgccaatcattgttcaaagaaatgtgtatagaagaacaaggttccgtagttaccgtggacatgcaacctcaagacgagaaaagtatattggagatgtaatgccctgcgctaatgcaatttctggtgctatagaagtgatagaagctatcgattcagatactgtagaaagtgctagctccgcagtgttacactcggtagacaggtgagcaagatataacttctttaacttcggagtgataatcttttgtaaaagctgaccacactcttggttagaaatatgacctaatttactcaatacacgctttttgtaaacatcaggacgttgagattgacgtaccaattcaggggaatgattggactcaattaataagtaatcacaatcatagagttcatgtgtgatccaagaggtgacccaacctaaatctgtgcaaaaacccagtttctcttcgcgataatgaaaaataaaagccacaggatctacagcatcatgaggtacattgaacgtctgtacttcgagatcttgaaaacaaaatgaagaccctgtggaaaatattttgaattctggatggctatctagtagatggcataaagcacgagccgtctccaagttgcaaacaatgggagtgttatacgccttaacaaaacttttaatcccggagatatgatcagaatgttcgtgcgtaacaaaaattgcctgaatatcttcaggatcgatattcatagagagtaattcccgagtgacgacttgcttgctcactcctaaatcaataagaatcttacaagaatccgtgcctagataagcagaattccctttggatccagaagctaaagggaaaaaaccttgcatgctaaccttccagaggattctgtatcaggatttgacgaggcttagctccttccgaaggcccaataattctagcttcttcaagttgatcaattaaactagctgctcgggcataaccaatttttaattttctttgaaggaaggtggttgaagcattccccgtctgtaaaattaaggttttcgcctgagcaaataaaggatctttttctccagagttatcagaatcagaatcatcaaaagcatggaaagaaggaatcacatattgtgtagggaatctagaacatagatcttgaatgactttgtttatgtcctcatcacaaatgtaggcaccctgagctcgtatagttccaaaaacagaaggaagaagtacaagcatatcaccatttcccatcagattctctgcaccaggttcatcaatgataatctgactattcactttattggagaccttaaaagaaattcgagaggggaaatttgctttaattaaacctgtaattacctctcttgaagggcgttgcgttgctaaaatcagatgaatccctacagctctagccatctgagctaagcgaatgataggagtttcaatatcttgggatgacgagagaagcaaatcagataactcatcaatgatccctaccataaagggcatagtttcacgaatctccctgtcgtaagaagcctcaatcgttttattgcgagtgcgggagttaaacgcttgtatattgcgcaaacccaaatatctcaaaatctcataacgagattccatttccttaactaaccaaactaaagcattgtacacttctcttgattcggtaatcacaggagataacatatgaggtaattgcgaatacccagtgagctctacttttttaggatcaataatgacgagtttaatttcagaaggtaaggtcgtcataatcatagacatgacaatcgtgttaatacatacagatttcccagatcctgtagtaccagcaataatgagatgaggcatcgtagctaaatcagcccaaagattgtcaccatttgctttcttccctaacaacaagggaatctgcaatttacgatttgtcttctgatagtcttctaataaatcacgaaaattcacagcttgaggaaaaggtgtgggaatttcaatacccacagcagctttccccggaatcggagcaataatccgtatgctcgaagcttggagttttaaagctatatcattttctaaagatttgattttctgaaccttaactccagaatgaggtaacacttcaaaagctgctaatgtcggtcctgaacagatgttgccaaggtccgcatcaattccaaaactcgtaagagtctgttttaaaatcagagcttttctctctagctcagcttgtaaggactcgggacgagcttctctgtttttactaagtaaatgatattgcggaagatcattttcagggactgctaaactttttaatttaggaagagccgctctttccttgcctttggattccctcactacagtgggagtcgaagatagcgcaattgttttcccttctttcgctttattctcttgaggctcaacaaattttgtcaggaaacgcttgcaaggatgaggagttaggaaaaaggactctttcttagaaccggggatctcttcctgaggtaagggagaaatagacccatcttaaatgatagtctcagaaactcgacgtggcgaaggttgcgatttcgtacaagaaaaaggattcttggaaacaaaaggaaccgaaggcttaggaagatagtttcgcctatttattaatttttttaaatttttgaaacaagtttggaaaaaagagcaaaaagcctttttgaccccgtcttgaaaggtntttttttttaataaagcaatgcctgccgcaaagataaaggacggagaatagcatcacgaatccaaaaattagagcagttcctacagacccaattaaatgttttagacaaaaagattggccttcgtaaaacagatagaaagggattccacccacataagagacaggaggaatattccctaaaataaactttggaagacgtgtatctaataaagcaggaagcgttcctactggagataacatggataagagaatcgcagaacaaaaggggagagaaagaaatgccgcagctttatagaagaaaagcggtcgaggagtccttctgaagtacaaaaaagataaccaaagaaaatatanagggataaaaaatgccgcggcaccaaagaaataaagtagaaaagaactaaatgaccaacctaatagacctatccaattctgtgtgcacggctgatctctatgaaaactccatagactgagaccagaaaaacacgcgaaaaataaatataaactggctttagctgctaaaggcaaagtcggaagacgagggtgcctgctcttttttctttctcttatcatgggctacataagattctaagtattgtcgagcttcgttatagatttcgttatatcaagaaaaacaaaagaaacaaagaagataaagagggcgaacgacggggcttgaacccgcgaccttcggaaccacaatccgacgctctaaccagctgagctacgttcgccaaaccatataaaattaaggaaaatattagcttcagtctgaaatttagccaagataaaaaggtcagaataggaaatctcaatgttctcactaagataagtagtatgaatttcttgaaaaacagcaaacataacgttctttgaattcaaatagaaaaccaggacagggaaaaccggagctcattgcgaatagaaatagggtttatgaataaaaatgcattatttttttcgcgaaattttagcccttacagccccttctggagcagaaaatggttttttgcaaaaaaagaaaaaaataaaaagcaaacgaaatgcgttgcgaaaaaaatgccattttttataggatgttgctttcttcttaagtgaaacaaacaaagaagaagagtccacacttcgatgtggatacgcaacgaaagtttgagtatctgtagtttataggtttttaaatttttcttcttaacaatgcaaatgagatagaatgcaggccagtataaaatgcttgtgaggatcttttgaaggatctgttaattttttttattttttctgagaatttgatcttagttcagattgaacgctggcggcgtggatgaggcatgcaagtcgaacggaataatgacttcggttgttatttagtggcggaagggttagtagtacatagataatctgccctcaacttggggataacggttggaaacgatcgctaataccgaatgtagtgtaattaggcatctaatatatattaaagaaggggatcttcggacctttcggttgaggaagagtttatgcgatatcagcttgttggtggggtaaaagcccaccaaggcgatgacgtctaggcggattgagagattgaccgccaacactgggactgagacactgcccagactcctacgggaggctgcagtcgagaatctttcgcaatggacgaaagtctgacgaagcgacgccgcgtgtgtgatgaaggccttagggttgtaaagcactttcgcctgggaataagagagattggctaatatccaatcgatttgagcgtaccaggtaaagaagcaccggctaactccgtgccagcagctgcggtaatacggagggtgctagcgttaatcggatttattgggcgtaaagggcgtgtaggcggaaaggaaagttagatgttaaattttggggctcaaccccaagtcagcatttaaaactatctttctagaggatagatggggaaaagggaattccacgtgtagcggtgaaatgcgtagatatgtggaagaacaccagtggcgaaggcgcttttctaatttatacctgacgctaaggcgcgaaagcaaggggagcaaacaggattagataccctggtagtccttgccgtaaacgatgcatacttgatgtggatggtctcaaccccatccgtgtcggagctaacgtgttaagtatgccgcctgaggagtacactcgcaagggtgaaactcaaaagaattgacgggggcccgcacaagcagtggagcatgtggtttaattcgatgcaacgcgaaggaccttacctggacttgacatgtatttgacaactgtagaaatacagctttccgcaaggacagatacacaggtgctgcatggctgtcgtcagctcgtgccgtgaggtgttgggttaagtcccgcaacgagcgcaacccttatcgttagttgccagcacttagggtgggaactctaacgagactgcctgggttaaccaggaggaaggcgaggatgacgtcaagtcagcatggcccttatgtccagggcgacacacgtgctacaatggttagtacagaaggtagcaagatcgtgagatggagcaaatcctaaaagctagccccagttcggattgtagtctgcaactcgactacatgaagtcggaattgctagtaatggcgtgtcagccataacgccgtgaatacgttctcgggccttgtacacaccgcccgtcacatcatgggagttggttttaccttaagtcgttgactcaacctatttataggagagaggcgcccaaggtgaggctgatgactgggatgaagtcgtaacaaggtagccctaccggaaggtggggctggatcacctcctttttaaggacaaggaaggttgtttttaacaacccgactaggttgggcaagtattttatattccgcattctatttcttttgcattgttaaggttgttttcaaaacattcagtatatgatcaagtatgttatgtaaataatcatggtaacaagtatttttcacatataataatagacgtttaagaatatctgtctttaggtgaagttaacttgcatggatcaaaaatttacagaccaagttgttaagagctattggcggatgccttggcattgacaggcgatgaaggatgcgtttacctgcagtaatcttcggtgagctggtatagagctatgacccggaggtatccgaatggggcaacccgatagactaatagtctatcattatatgttgaatacataggcatataaggcgacacccgctgaactgaaacatcttagtaagcggaggaaaagaaatcaaagagattccctgtgtagcggcgagcgaaaggggaacagcctaaaccatatttttaatatggggttgtagggtcgataacatgggatcttaagttttagttgaatacttctggaaagttgaacgatacagggtgatagtcccgtaaacgaaaaaacaaaagacgctaatcgatacctgagtagggctagacacgtgaaacctagtctgaatctggggagaccactctccaaggctaaatactagtcaatgacctatagtgaaccagtactgtgaaggaaaggtgaaaagaacccttgttaagggagtgaaatagaacctgaaaccagtagcttataagcggtcggagacctataactcttcggagtaatggttgacggcgtgccttttgcatgatgagccagggagttaagttaaacggcgagattaagggatttacattccggagtcgaagcgaaagcgagttttaaaagagcgttttagtcgtttgatttagacacgaaaccaagtgagctatttatgaccaggttgaagcattggtaagactttgtggaggaccgaaccagtacatgttgaaaaatgtttggatgagttgtgaataggggtgaaaggccaattcaaacttggagatatcttgttctctcngaaataactttaggntagcctcggntattaagttttttgggggtagagcactgaatttctaggcggggcctaccggcttaccaacggaaatcaaactccgaataccaaaagcgagtccgggagatagacagcgggggctaagcttcgttgtcgagaggggaacagcccagaccgccgattaaggtccctaattttatgctaagtgagtaaggaagtgataattctaagacagttggaatgttggcttagaggcagcaatcatttaaagagtgcgtaacagctcaccaatcgagaatcatcgcgccaataatgatcggggctcaagcataaaaccgacatcgcgggtgtatattatgtatacgcggtaggagagtgtagtattcagcagtgaaggtataccgaaaggagtgctggagcggatactagtaaagatccatggcataagtaacgataaaggaagtgaaaatcttcctcgccgtaagcccaaggtttccagggtcaagctcgtcttccctgggttagtcggcccctaagtcgaggcacaaatgcgtagacgatggagcaacaggttaaatattcctgtaccacctaaaactttagcaatggaatgacggagtacgttaagcacgcggacgattggaaatgtccgtatcacaatgagactggttagtaggcaaatccgctaacacaaggtcgggttgtggttaagggaaatcttcggaggaactgatagtgtggcgcaaggctttcaagaaataatttctagctgttgatggtgaccgtaccaaaaccgacacaggtgggcgagatgagtattctaaggcgcgcgagataactttcgttaaggaactcggcaaattatccccgtaacttcggaataaggggagcctcttaaggtgattacccagcggtatgagcctcggggggccgcagagaaatggcccaggcgactgtttaacaaaaacacagcactatgcaaacctctaaggggaagtatatggtgtgacgcctgcccaatgccaaaaggttaaagggatatgtcagccgcaaggaaagcattgaacccaagccctggtgaatggccgccgtaactataacggtgctaaggtagcgaaattccttgtcgggtaagttccgacctgcacgaatggtgtaacgatctgggcactgtctcaacgaaagactcggtgaaattgtagtagcagtgaagatgctgtttacccgcaaaaggacgaaaagaccccgtgaacctttactgtactttggtattgatttttgatttgttatgtgtaggatagccaggagactatgaacactcttcgttaggagggtgggagtcattgttgaaatactggtcttaacaagttgggagtctaacattactccatgaatctggagaatggacattgccagacgggcagttttactggggcggtatcctcctaaaaagtaacggaggagcccaaagcttatttcatcgtggttggcaatcacgagtagagcgtaaaggtataaaataggttgactgcaagacttacaagtcgagcagagacgaaagtcgggcttagtgatccggcggtggaaagtggaatcgccgtcgcttaacggataaaaggtactccggggataacaggctgatcgccaccaagagttcatatcgacgtggcggtttggcacctcgatgtcggctcatcgcatcctggggctggagaaggtcccaagggtttggctgttcgccaattaaagcggtacgcgagctgggttcaaaacgtcgtgagacagtttggtctctatcctttgtgggcgcaggatacttgaaaggagctgttcctagtacgagaggaccggaatggacgaaccaatggtgtgtcggttgttttgccaaaagcatagccgagtagctacgttcggaaaggataagcattgaaagcatctaaatgccaagcctcccttaagataaggtatccctatgagactccatgtagactacgtggttgataggttgggtgtgtacgcacagtaatgtgtttagctaaccaatactaataagtccatagacttggtttttatcatataaaaagctgaataagcttttttgttgaattagtcgatttatgcaagtttactaaagactcttcttaagcgtctattagtatacgtgaaaatacgttacaagatttagcttggcgatactggagaaagggatacacctgataccattccgaactcagaagttaagccttttatcgctgatggtactatacacaagagtatgggagagtaagtcgttgccaagctttctattatatgtttcttaatacataattaagaatttcaaaagaggataatttttttatcctctttttttttgctgttttttgataaacctatttacccagcttgtttcatatttaaaagtgatttcattgtttttaaaataaaaaattcgctgtacacatgcccgttcctatagataattcctctcgcaacctacaagaagttccagaaagcctagaagacctcgaacaacacgcagaagaatctcttactcatcaaaagtgcagaaagcagttctttgcaactgtctctagcctcctcagcaatttctagtagagtagaacaactatcttccctcgtcttaggaatggaaaattcagatttctcctctttaagagacgttcctatcttctcagctatctacgaatcttcaacacacacacctgtccccactcctctagttggcgtgggatatatcaacggaagtcaatcaggatactacgatacacaaagagaatctcttcacctcagccaattgttaggaagccgaagagttgaagttgtctataaccaaggaaacttcatggaggcctctttgctaaatctgtgccccagaagacctcgaagagatccctctccaatttctttagctctattagagctctgggaagcattttttttagaacaccccccaggtagcacttttaatccaatatttttttggtaacggagctttctatgttcgcgaagctctccgcctaactccgcatgcacagaatatagtgctcgttggtatctgtccttctctatatccagaacatcctcgctccttttattatcgtgtttctggagatataggctcccgattcgacgatagaggatttgtaaactctggagtcgaaaccctgccatactcttcaggcagctttgggattttttggatctcgtttacggatcccacatttaattttgctatcgtaaatacctttatgcgaactgcagggatcaatgaagtctctagacccatgacacaagatacagaaacttcattgatagaaatgagagacctaagtgaacaacaagaagcgaataacacagattctttagagcaagaagagagcttaatgggtattgtaggacatactgtgggaggagtttccatgaccgtgacctccagtccaaatatcttttatcgtatacaaacacttctgggactgccagagactcttgcagaagctgaagaaaatcctaccttcccaaattctactatagatagccttgcagaaataatgatgaacctcgtaaggatctctgatgctgtctctattttctggatttttcctatcgtagatactacatataatggagttttattagccgtctgtatcggcttcttcggaatcaatgggatttgttccacgttccttatgcttacgaatccacgctctcgtcgagatagatggaggaatttacgcatcatggttctttgctatcgttctttgggaagcggaatgaatctctttgatcttagcaataatgtgcgcatggcagcacgtaggcatgtgacatcatgtacagtagctctctatgctatggtcactctatttggatggacagtagcaatacaagatgctttgcaatatggtttccctagcgttcgggatgccttctatagatattgcttacgccacagatattgcttaactcaaagaaacgaagactctctgcaaactacaggaacgcgctttcaggttacccgtacacatctagaagatcaacagatggtggcttctattttgaatttgagtgtttttgggctcttttttggattcgtagggctaatgaccacgtttggaggattagaaatctcaccatcttgtcggtgggatgcagcaaataaccgaacggtaggtattttttagactccaatgttaccttttctcaagctttaagtagtggtcgtgtctatgcagtcagccaatcggtgcatatgatcttttgcttcttctctattatcttatatacgatgtctctactttctcttctaagaagacgtcgtcgtcaataaagaaaaaccagatccactagcttccaaaatcatcaagaataatcgaactgcgctcgaccccatagtcaccaagaagtttaagaatactgctattgtgtagcggtggaccacatacgtagtaaagatagtcttcaggattatctaacctactcaattgacctagattaaatgcccgaaataggaagtttgtctttgtagggtcatctttatcccaacctgcagcaatatcttcaggaagaggctcagaaaggactaggtgataatggaaattgggaaactgtcgttctaaattttcatattcttcttggtaaatgttctcttttaatgagcgcgccccataccaaagatcaatttctctcttggaatgcttgtttaaaagtaaatctaggatgtggctcctaccaaaagatgaacctgctcctccaattaggaagattaaagggcggtcgtcatctttcataaaagattctccataaggcccagaaactgtaattttgtctccaggttttaaggagaacacataggaggaacagactccccaagggatctctgaattaggctttccattaatgaaaggaggcgtagcaatacgtatattaaacttaattgtaggaagctcggcaggataggaagctaaagaatacgctttgttggcagaatccgcaggaagttgactgttgtctataacttgatcaaatagatgaaagtgttcccagtcgctgtaatactcaggagccatagtttgcttccaatcggaagagttcgttttatagctcggtactgtaatttgtaagtagcccccaggcttaaagggaataggtttatttgggtctacagcaacaacaagttctttaataaaggtagccacattgtcattagagataacagtgccctcccaagaagaagcatttaaatatctctcttcaatttctaaactcatgtcgtgctgaactttgcactggcaggaaaggcgccagccttcctcgagttgtctttttgaaaatgtagaacggtccgtttctaaaggctcatcagcatttttaacaacgcgaactttacattgcttacaggtggcttttcctccacaaggggagggaataggaattcctgaacttaataatgaaactaagagagtctgaccactttcgacagtttttgtcagttcttcattgtcgttaatctttaatttacaagggtgtaccttaatgaaaagcttgcgagatagaaggatcacacctgcaagaatcacgccaatggcgcaaaagataagactagcaatacaaatgaaatagaggcctgaaagccaagtcataacgataaaaatcccagactttatgaaaagctcatagagtcaaattataacttagcgcataaaaaagcaataaaccttaagacaataaataagaaatcccacgatnttaatcgtgggatgaaagtctcaaaagaaattccttatgatttgttatcgttaggcttgaggatttcagaaatagctccttttaaaacttctacttttccagaagcaatatttaaaattaccgtgtgctcacggatatcgtcaacagtgccgatgattcccatggcagtgactttatctcctttagcgagatcattcttacgcttttccatggcctttctgcgtttttgttcgggacgccataagataaaatagaaaaatagaatagcaattgccaacatcacggcaggttgcacaaaagtattttttgattgagctgcttcttcttctgcaaacaggggcaaagagctcagtaaacaatagaaaacatgtcactatacgagaaagcatgcaatcaccttaacttgggttaattcgaagtaagattatcataataggaagcgagcattcaatgcttttcctagagatcgatctctctttctagtaaaataatattttctaggtgcgtcgaatagggaaattggtcaataggctgcatcttttttatgcgatatcccccagagattaggtccgcgcactcttgaaactgtgttttagggttgcaagagatatagacaatttttggagatcctatacgtaaaatatatttaagtactttactttgcataccacaacgtgggggatcaataataatgacatcaggagctttacaattttcattccttttgcagaacgctttcgcatcttctaaatagacttctacgcaatcttctttgttattcgctttgatgttctcctgagccgaagctacagcatcaggaataatctcaacgccaatcacatttttgacatagggagagagcataatccctatagttcctgctccacaatagagatcaagaagcgtttccgaaccctcggggtttataaactctttcgcagtttctataattttcgctgcctgagtaatctgaggttggaagaaacttctgggacgcaaactaaaagaggcagagttaccgtcactaggtaaggacagtttttgctgtatcgagggggctccgtatagcagtttagtttcataatatgtagaaatcccacgtgcagctaccttttcttcccaatagatcgatgctatgtttagagaagacgataggagaatctctttccattcatctatacaggcttcgtttaccctatattctggagttcctgatgttgttaggatcaccataaagttttgctgcgggctccccgtacggacggtgagtgtgcataacgagcctttgtttttaggggggaagtacgccataagctctgggtgcttatcccaccattcgcgagtgagttttaaaatatccatagtctgctcatggataagcagacatgtagtcactggaattcctttctttggttttgtagagctgatgaatcctaaacttttttctccttcataagtttgaaaaaaggagaattccattttatttcttcctcttaaagagggagaacatgggatgataggagcaatcatatccgagggaactaaaggagcgaataactgatgaaggagttcttcctttttctttaaggagtcagaataattggactgaggaaacgagcatcctccacatacaccaaaatgtggacaattttgcatggtagacatagttaagatagaagcttagtttttgttagagaggtaatctgagaactagacaacaattcacaaggaccttcatttcgaatccctagatgagatacttgaaaggttgtttgagaatatcaaaagcaaaatggaaattttatcacgaaggaaaattatatctctacctttttaaggaagaacncctaggtagcacagagaaaaatttgggcataaaaaagaggatgagtagaaaattacccaccctctaaacgaaatcaagctaaggcgaattattttctaaatccgcgtgctttggaaggttttttaactttttttgcggctgtctttttagatgcaggtttagaagctttgactgctttgctagttttagctgcagcagcagagctttttttaggggcttttttttccgcagttttttttactttggcaggagccttagttgatggcttacgttttaataacccagatttctctgcttttatagattcttttctgtaaagtttcgcaactttttctaattttatagagtctgtgcgtactctttgagctgctgccttgtttcctttctctgctttagctaagtcgtgttggatgctatccagcaggtctttcattttttttgccgtatcttttagcgccatgaaaagcgtcctctagtcgctgttttaaactatttttacttgttttaatttttaattagtttgtttgttcaaattcatgcaaccattttttagagaaaataagacttttgtaagttattgttattttgttatgagaacacacttctttgtttatcaatgtgttaatttataaaatgtttggaaaatccattggaaaaagcaaaaaactttaagagaggatttgggtttttttttcgtgttttgagtaaaatggagaacgtatttgtatcaatttttgtagcatgtagagaaaaacatattttctttgatcattgggaacgtagtttctatagatcgaatgtagttcaaagaatgctaccccccaaatcctttactttcgagaaatgtctgctataaaaggaatagaagtatttagatgaagaagctatatcaccctaccttatttctgagacctttgattcggctgagcctcatttttgcgttaagtttgacactgatttcaggaaatttcccacagcagaaatcctttggtcattgctgtgcagatatgcactcagcattaatatcagggaaaaattgtgaagaactctttgcagattttattgagcgggttcttgccgacagagagactttgactgcccgtgattggggaactgttgttgtcttagtccgcgagtatctcttgaagtgtattcgtaaaggggattgtgactatggagtgaaaattcttcagaaactcctagccttacgcttgccgaaggatgctaggaaagacttgcagatcttatggcaccggttgaatccagagcaggctcctttgcgagatgttgttgatcagcttttcactataggctgtcacgaatctttgcaagatcacttgctttttgagctctacaccgtgacattgcatagcggttatgaaaaccgtaaacaggatatgcttttagctaaagaacaaggggattacaaaaaagctatagaattggcaaaagagctggttgcagcattggaaaagggatcgtgtagccctcacccagagatagtgcaaatagaaaaaacttttttgcaaaaaacactgcttgctttgcaaataaaagtagcacaagaagctcaagaatcttgcgatgctttactcacaccctactgtttgtctgaaattgcctatactgaagctatggatgctttggtactgcgtatagctagaggtgaagtctctcgtactaatgaggtggatagtgtcttactgagccatgccttacaacacctccctttcgcacgggaaaaagcgattcctgaacttgaagttcttattgatcacggagcctatctagaatccacattactatactatgcatacttctctttattagaactttatcatcaaaataaagactttgcatcgctagagcgtttgctagagaagggtgatgctgtctttgtccctgagcatccctatttcccagaatatgggttttttctaggtgcatatttctatgctaaagggaaatacgagagcgctgagaaagttttcttacagattatagatcccgctgtaaaactaggagctacttttgctagagcatatgaatatctagggtgtattgcttatgttcagaatcattacgagaaggcggaagaatactttctccgtgcttataagagttggggacgcgaagagtcaggtataggattatttttagcatacgctgtgcaaaagaaaaagactgcatgtgaggatatgctctaccatcctaagttttcttttacctaccgtcatttgctagattctctctgttctttatcgtatccacatggggaaaataagggcagctctgcgatccaaagagtccatagggctgtacccgagctttcagagatttatagccgctgtatctatgatatgattaaatataggaatgttacctatacgcaccctattatagagcttgcttacaaccaagtccgcaatttagaaaaacgtaatttagaagaaatttgtagggatgcgcaagatccagaatatgataaagctttagccttttggggagcccttcaatcgggggcctctgtgccaaggtctctcattgaaagttcagatgtggatgaagccggaatcacaatacgttgctatgaggctttatattttcacaatccagatgctatagctatgcttcctcaagcgttttctgaagaatgtaattcttggcaaacggcactgcgactcgtttggacgttagtacgacctaaaggagctcctaatcacgctaagtattgggatcaccttgtgctccgtccccatggggatagcctatatttttttggttatgaccttcaagaatatctcattggcaaagaagatgccttgaagcatctgtctgtatttgcggaactcttccctaaatcttcgctgctttcgcttgtatactatttacaaggctatagcgaatcctcggctttgaggaaagtcggatggtttgtaaaagctcttgaagagttcactgagatttcttggtcgggagagcatatgaagacatgggcgtatatctattatatggtgaagttagatcttgctgatacctacatctctttaggcaacttttctcaggcagttcatattcttgaggaggttaaggaagattggcaagtcgccagtcatcccaaactacatttccttaagggagaggactgttacttagctatggaactgcgatgggtagagggattggcctatgcgtactttcagttacatgagaccgcacacttgtccaatcatcttcttgagcatgtagaaaagaatttaatttccccacgttcttacagagactattatggcgagtctctacagagaactctggggttgtgccagcgtttcctcggtgtgtaaatcacagatagcatgatatgcagaagctatacatcgattcagtcctgggcctgcaatattttgacctacaatttttaaatttcctggtaagtgaggtaggatacgctctttcctttctagaaagccaacagcatgttgtggcatgccatcctgagatgaaaataaagcaaaagcatctggtttttgattgatattcaggtattctgagagagctgctatcgcaaaggcatgagcttctgattcccgccatttgccttcaatgagaagggagagcactgttttccctggcgtacttgcgggaagatttgagaattccaaacgattcccaagaggggaagctcgtctgcaaatagcatgccataacctttgggaagcgaaaagttggcgtgatgccaacctaagctgatgctagataaattccaagggagaactcttttagataaattttcaattccatagttaggaagcaatacaggaagctgctggagaggtcctgtataaattaccatatcggcaaaaaacgtctctgaaggtgtggttacacaagcttcttttggtgaacaatcgatgtgagtcacactagtagaaaacttccatgttgcggggagtttttcttggatagtagtaatcaaagtccccatggaaggagatagagatgcaagatatctgtcggtcttagactttttgggggatctatttttaagataactgcgtaatagagacccgctggaagcttctctctttgctagttcaggaaatgccatgtgtgtggagagaatgctgctatggcctgcgcgtatggctgtgattagtggatctaatatatagcttgtaaaattttgtgaactatgtcgctttaagaaatcctgaacggaactatcttgagtatagcaaggtgcacggaagtccttaattaaagaaggaagcaggccctttcttaggagagtccaggtggatattttacgggccttccctctgtagtagacaaagcggttttttgctgcacgatcactgaagatcaaggaattttggagaccaagttcatggataagttttagagtatactctccgtctccccgggtgaggaatcctttaggtccgaggtcaaaagaaaacccttgaggggattccgtgcggacgaagcctcctgcgtaggcttctttatctaaaacaaggatttccgcttgggggaatttcttatgaagccaccaacctgcagcaagaccagaaattcctgcgcctataatgattgctctcttcacacaaaacctcctctctgctcagtttctcaacatttttatatagaagctgagaaacattcttttttagataccttattgagaaaatagtgatcgaaagctgtggcaatgactctgacaaacaattctccaagaggagttactttcaaagagccaggactgttatggatgagacctgtagtttccatacttatcaagcgatcacgactttctataaaataagtatcaaactcatatccaaaaaggttgaaaaactcttccttattgatcgtaaacgtgcacatcagcttatggattgcccattttctaatccgatcatcctcggtaagaattttacttttcacagtggcaaatgttcctcgaagcaccgtattgtgatattcctcaagggtttttgcattttgtagataaattccacgaatgaagcttgtagaagtcattcctaacccgagcagatcttcttctgggggtagagaatacccctgaaagttgcggattagagttttgtttttgaaagcgagggtaagaggatcatggggaagagagaaatgatccataccgatggcctgatatcctgcttttgtaagtaaatgccgggattgagaataaatcgcgaatttctcttccatagaaggcatatccgaagctttcatggctttttggtgcggcttgatccatggaactgaggcaaaagaaaataaagcaagacgatctggatacatcgctaagatatcttgaattgttttagaaaaggactccttggtttgtttgggaagaccataaattaagtctatattgatactttggaaggcgagttccttaaatttttcgtatgcctttaaagattcctcatgcgattggcgtcgtcgtacagcttcttgaacatcagcttgggtatcttgaacgcctaagctaaccctattaaaacctacgttctgaaagaaatctgctttttccatgtcgtttcttaaagaacgaggatccacttcaatagcaatttcttcagcatgtgaaagatcaaaaagcttatggatgtggtcaaaaagcagggtaaacaactccctggagagtctgctaggggtgcctcctccaaaatgaatcctggatacctgaggccggaatcctatggtctcaacgacaagtttcatctcttggattagggtgttgatataagcttctacaatatcttcacgacgattcaaaacaacagaacaaccgcaatacaaacacatggattggcagaaggggatatgaaaataaagagagagaggctgagnattntctctaantctttggaacgctagaagagctggagccgcatcggaaggttcccattctaaagctgtagggtagcttgtgtatctgggcgcgggttgatgaagtccttctaagaatttaaagttgacgttgaacataagaaactaccaattggacgttttctaaaggtgtttcaggaagaatcccatgtccagaattaaaaatgaagttaggatatgttcttaaaggaacaaggaaggcttctacatagtgtaataatttctcttggggcaataaaaatattgccggatccaagtttccttgtagggagagcataagatttttttgtatgcgatgaaggtccacatgataatcaggatggagtgtatcggcttgcgtggcttgcagagtataaaaattttcttcaaaacaacgacaaaataaactcacaggaatggcctgctctttaagttttgctatcagacgacggtttggttcagtcacatagcgtgtaaagagtgctgaagggagacgtagactcgaagattcaaaaagctgcacagcagcagctcctgcatccatttgtgtttttagataaatagcagtcccttcgataattgtagagatgagctgatcaaatttttcaggatacacatagagaaaagacatggtcttagaaaaatctttggaagcacctccatcaattaagtagcaggcgagtgtgaagggagatgctgcaaaaacaatcagcggaacaggaagtttttgcttaagagttcgaatcgcgtccaaaagatagctaaagatggtttgtggatcggaagtgaaagtgaaaggttgctctggagaaaattgtatgcgcggaccaggagcaaagtcataggtcacagcaaaaccatccaagatggataggatatcagcaaagagaatagcagcatctacatgtagcaacgagggccctaaaagcgtagctctacaatagcttcagtattatggaaaaaggttttaaagattgggatcctttcagctcttggtatggaggcatgtaccttcctacctgtcgtaatagccatatgggaggatgagaggcagtttgagattttaaaagatcaaaaaaagcagacatagagtcccaattatgaagcgttgattaagaagcccctttctatggactcaatgacttctttgactagaagttcaggagttggagatagagcatagggcaaggttttctttgtctgttcagatttgctaaggcatttttgcacatataaagcattcgcagttcccttaatgctagaaatgccatgctgcaaagcaaataggcgtatttcagcaagggcaaaaagccagcagatctcttgaggtaatgggccaaagcgatctcgcatttcttcttgtattgcggtaagctcttcagagctttcagcattaccaatcttttggtaaaactcaatgcgcatcgatccagtttcgatgtaagtatcaggaatacgcgaattgtaaggaaattctattttcacatcgtcgttgaaaagtaggggggacgtgtgtttttttaaagctgaaacagctttttttagtaatttgcaatacaaattaaaccctatagttccgatatgtcccgactgatcggttcctagaatattccctgcaccgcggatttctaaatcatggagggcaatcttcattccccctccatattcctgcttatttaaagcagcgagtcgcttcgctgctggcccagacaacctgtctaagtgaggaactagaaaataacaataggcctttttattccatcgcccgacacgtcccttcatttgatataaatccgccattccaaacttatcggcatgatctatcaaaatggtattggcgtttggaatatcaatcccgttttctatcagtgcagtagcaacgaggatgtcggttttctgatttttgaatttcgtaaagatattagagaggtcctcagctcccatttgaccatgagctacgccaatacgagcctcaggaatcagattgcgaatggtctcagcaagagtatagatgctctcaatccgattatgaatgacataggcttgtcctcctcgaaggagctcgtgccttaaagccgctgtcaatgtttctgtattatgctccatgacaaaagtacttacaggcaacctatccaagggaggcatggcaatcacagatagatcacgagctcctgatagagacatgtgcaatgtccttgggatgggagtcgcagatactgtaagacagtcaatcatgggatagcgctccttcagattgtccttaactttaactccaaagcgttgttcttcatcaataattaataaaccagggttcttaaactctaggcttttgttaatgagtttgtgagttccaatgataatgtcaatttgtcctgaagctacttgctcacagatgagtttttgcactttggcttgggagaaacgtgaaagcacagcaatttcgatcggcaatcccgccattctttctttaaaagtttcatagtgctgagttgctaaaatcgttgtgggaaccataacaatgacttgtcgatggccatcgcaaacagccttgacagcagcccgcatgatgacttcagttttcccaaagccagcatctccgcaaattaatctatccatgagttttggagacatcatgtcattgtaaatctgatcaatagtctttaactgatcgggggtttcttcatagggaaacgtttccgcaaacttgattacggactctccgtgaggagggtacacaaaagcaggagttgtcgaacgttgtgcttctaactgtaagagcttctctgcgtagacaatcaaagatttttcagtaagatctctagagcgcttccatttcgaactatttaaatgatggagatcggcagctttatcagaagtcccaacataccgagagatcagataggcttggttcgaaggaacataaagccgagctttatctgcatattctaaaacaagataatccgtttcaatattcagatggttcggttttttttctattcctaggaattttccaattccattatgaatatggacaacagtctctcctggaatcggaacaaaaacttcttcagtagtcactgaaaagtgagtgcgttgtttttgcctacgcaatacttttgtagaagcaaactcggatagggaaatcgctgcaaaggcttcgtttactaatgcaaagctggaagttagattccctgttttttcatagatttccacatccccacgagctacagtctctgctagagcacgggcctcttttaaagatttcgtttttgtgctgtagatggctaattttaagggctttccatgaggaggcatatattcttgaagatgctgtaggaaagcaagtaggggattctcatcgttctgaataatttgctcaggatacagtataggaatcgcttggcgactcgcttccatgtttcggtgaaatgcttcgatgatgacgcggttttccttgagattcttgacgttaggaaacggagtctccgagaaataaacttgattagacgttgaaatgcgatcgtagagagtgccaatagagaaaaatctatctggaagggacgaaagtgttccagaaatatccgcaaagtcatcttctagaatttctaagttatcaaagagatagagaggaggggtgctgaaatagtctaatagtgaatgagaatagtttcctccagaggcctcttctgtgtacgctggagagatagaaattttagagacttttcctgtcgatagctgatccgaaggattgtaagatctgatagaaatgatcttctctccccaaaattctatcctaaaaggctctggcgaggataacgggaaaatatcaacaattcctccgcgacaagaaaattctcccttttcgctagttagcatgacctgagaatatcctaaacttttacagagttccgtagttgcttctggatctaagacatctccaactgcgagatcaagatgttgttgacttgtagcttgtggagaacgggttttttctaaaagagcttttaatgtagtgacacagaatataggagccctgtgctgattcaagctgtaaagaagatgatctcgcttccccacagcatctatgttcactaattttggagagagatcaatttcagaagagggaaattctacaggagcttggtctaaaaaggtccttaaattttcaaagagatcatcaagacgtgcgggtgtcgtaatcataattacagaagcacgacagtcatgaaacatctttgctgcaaggaatgccgtggctcctggatgaatattttctaatagtaaaggaagtgtttcctctttgaattctttggaaatagaaaaatctaaattaactgggttgaaatccattgccataaagtttcatttaatacttctgttgctgggagagcgggagcactaccttgggccgattgatcttttcctccccagcgaccaccgcaaggagtaagaacagctttcaataaatcctgagcatggacgccttgtgtgataaggtcgtcagagactcgagatagtacaatatatttcccatttttctctgttgtccacagagaaattagtttttctggaatcctttgatgcaaacattgtgcgtactgctgcaaacggtggttctcatgttctgcgagatgatgcacgaggcaagtgattccttgacgttgatgacaattgtggattaacttgtctaattttgtctgaatcagactgttttctaactcatttaaccgtttgtcttgttgtttgcgctcatctaaagttgcagttagcctggagacaatctgatccctagggacttgtaatagcgtacaatctcttctaatacttcgctttgttggtgtactgtagcttcggctttttctccagtgaccgcctcaatacggcggatgcccatggccacagcatgttctttggtaatccggaagaatccgatatccccagtagcttccgcatgcgtgcctccacaaagttcatgagagtgccctgcagaaactacacgaaccacatcgctatacttatccccgaagaattgcttgatttctgatgagttcatcacatcagaatagagagcttcacgaatatctacaggctcattctcccggatactttcattgactagagtctcaatacaaagaagatcttcaggtgaaattgcctgggggtgagtaaagtctaaacgaatttttgtatcgtcaacataggagcctgcttgacggatgtgatcacccaaagtgatttctaaagctttgtgtaataggtggcaggcagtgtgattgttggcaatcctctttctacgataacgatttacctgagcagtcactgcagcttctacagtcagacttccttgggaaattcttccatgatgtacgattaacccggcttttggagatgtcgtatgggtaacaataaaggtcccctcactacaaaagatctccccagaatctccaacttgtccccctttttctgcataaaaaggagaaacttttaatacaatagcaccctcttgcttctcttgaagcgaagaaactatgtgatctttagaaatgatagcttcgatgaacgtatcacaagagagatgatcataccctataaattctgaagttaaatgtagttcattgtagatagattccgaagtcccttgggattgaactacgttttttctagaacgttctttagcttcttgctctaacttatggaaggtatccatgtcgacactatagtcgtaatctttagctaacaaagaaatctcatcaatgggcatgccataggtatctttgagcttgaaagcatcttcacctgaaatgcaagaggaggaagaagaacttttcaaaacttgctgtagaaggtttcctccacggtcaagagttttaaagaaactttcttcttctaaagtgagtactttttgaatttgggatagcgaattctttaattcagggtaggcctctcccatagcatctgctaatgagggaacaatttctgctaagaagggattgcgaaaccctaaacgccgtccatagtttacggatcgtctcaaaatttttcttagaacatagcctcgctcagtgtttcctggaaggagaccatcagcgatagcaaaagataaagaacgtacatgatccgcaattacccggaaagctgcaccactatcatcgggatgatagactttcccagagagctgctcagtctttgcaatcagtcgcgcaacacatccgcttcaaaaacagtgtgcgtcccagcaattaaagagacaagtctctctagaccagctcctgtatccacatgtttattaggtaaagcaagtaaagagccttcgctggtacgattgaattccatgaagactaaattccaatattctaagaaacgctctccatcagtatcgtcaaggggagaagaggcgtttccaaaactggggccacgatcaaagaggagctcggaacaatagccacaggggcctgtgtttgccatgctccagaagttgtctttgtctgtaagacggaaaatacgatctgtaggaagatatgcttcccaaagagcaaatgcttcatcgtctttttcatgtacggtagcgtaaatccttcgggattaaaattaaaaacagataaagagacttcccaagcaaaggcaatcgcctctgctttaaagtagtctccgaaagaaaaattccctaacatctcgaagaaggtgaggtgccttgaagtatgacccacattatctaggtcgttgtgtttccctccagctcgaatacatttctgcgatgttgtggctcgagagtagctcaccttctctttatttaggaaaatatccttaaactgattcattcctgcattcgtaaaaaggatcgagggatcattgtgaggaaatactggagaagagggaagaatggtatggtggcggttagcatagaattttaaaaaattggagcgaatagtattgcttaacatgaaaaagaactctcaacggcagcggttttgcagattccttgccattataggagagttctttattttcgtctctatccctaatttttagttaaaaaactttcctgtttattattgagatttgatcgaaaattcatttgtttttgaaagaattacaaggtaagagttccttgctttttgcttggggatttcctatagttgctgcttttacatagaaggtctccagggtttacttatgatcaataaagaattagatattggtattttaggaaaaattgctggggctattaaacaaattagtattgaatccatccaaaaggcctcttctggtcatccaggacttcccctaggatgcgcagaacttgctgcctatttatatggttatgtcctgcggcaaaatccacgtgatccccattggattaatagggatcggtttgtcttgtcagcaggtcatggatctgctcttctctattcttgtttgcatcttgccggatttgatgtttccttagaggatcttcaggaatttcgccagcttcactcccgaactcccgggcatcccgagtacggcgaaactgtgggagtcgaagcaacgacaggtcctctgggacagggattaggcaatgctgtcggcatggcgctctctatgaagatgttggaatcccgattcaatcgcccaggacatgagatttttaacggaaaaatctattgtttggcaggggatggctgttttatggagggagtcagccacgaagtttgtagctttgcaggctctttaaatttaaataatcttgtggtcatctatgactacaataatgttgttctcgatggatatcttaatgaaattagtgttgaggatacaaaaaaacgttttgaagcctatggctgggagtattatgaaattgatgggtatgattttacccatattcatgagacattctcgagcatcaaacgggggcaggaacgtcctgtattagtgattgcacatacaattattggtcatggttcgcctaaggaagggacaaataaggctcatggttctcctttaggagtcgaagggactcatgaaacaaaacagttttggcatctccctgaagaaaagttttttgtccctcctgcagtaaagaacttctttgctcataaaatacaagaagatcgaaaagcacaggagcaatggctggatgaagttcgtgtttggtcaaaacagttcccagaattacacgaagaattcgttgcgttgacctctcataagttacctaaaaacttagaatccttggtgcagagtgtagaaatgccagactctatagctggccgggctgcttcaaataaactgatccaagtattagtacagcacattccttatttgattggagggtccgcagatctttcaagctcagatggaacttggattgcgaatgagaaagtcatccatacgtatgacttctctggaaggaacattaaatacggcgttcgtgagtttggtatggccacaatcatgaatggtttagcttatagccaggtatttcgtccttttggtggaacatttttagttttttctgactatatgcgtaatgcaattcgcttggccgcattatctaaattaccagtcatctatcaatttacccatgattctatatttgttggagaagatggacctacgcatcagcctgtggaacaattgatgtctttgcgcgcgatccctggattgtatgtaatacgtcctgccgatgctaatgaagttagaggagcgtggattgcaggattaaagcacacaggtcctacagtcattgtcttgtcgcgacaagcattgcccacactgcctgctgcgcatcggccttttaaagatggtgtaggtcgtggtgcttatattgtcttaaaagagtcaggagaaaaaccagactatactctcttcgctacagggtcagaagtttctttagctctttctgtagctaaagaactcgaacacttggataagcaagtgcgtgtagtttctttcccttgttgggagctttttgaagctcaagatgtggactacaaacagagtattgtaggcggagatcttggaattcgtgtctctatagaagcaggatctgctttggggtggtataagtatatcggatctgaaggtttactatcgctatggatagattcggatactcaggagcttctgatgatgtatcagaagaatgtggctttactacagagcaaatccttcagaggattctctctcaatagtcactgtcggaagtttcagagccgctagccatagtgtcatcggcttctccaacttccatatgaggtaatcctcgatactgttgatccttcttatggtcagaagctgctcgttttagcatgactttttcaaggttctctatgacttcttgtcctgttaagatgtggtcttccgtataagtattaaagatgaagttcccactggacttcgttttgattccctccttccttaagggaagatctgaaatcaataataacgctccaatgggcaggtttctacggtatccggcagcaaaaagtgtcgcacactccatttcagcggattgagctttggtttcgtacagtttttttctaaattttttgttaaattcccaaaagcgaatgttggtcgtgtgggtaatgccaatatggtagtttgccttcttatcttctaaaacttcagttgttgctttctgtacaacaaaatttgcaagagccggaacttcaggagggaaataggcgtctgaagtaccctctccacgtatgctagctacggggacaaagtaatctccaacctgataatgagagcgtaagcccccacacattcctaacataagcgctgctttgagatcaggaagaaatgaacataagtctatagttaatgcagctcctggagaccctagtttaaaatctaaaattgaagttttaagatgaggagcatgggcagcagaaaacatagaaccctcaaagacgggcaccccatgaagttttgcaaaggtttggatatagtaagagaagttcgtgagtaagagataaggacaaaattgctttacgctagagccagaataacgttctaacatatcttgagcaatcctggattcagaagtatgtttggacacacgctctcctttgtaatgttttcttctcagattcttagcattcttatcgtttctcggtcattaaaaaaatcctagaaatcaaaagatagaattctgataagggacagctgcaatcatttacatagaaggagagtccttcgattcctgatgtacattcttctggacaaaggagaaaaagctcgataacataaatcgaagaaaattaagaaatagattgctttatggttcgtgtaagtactagtgaattccgtgtgggattaagaatagaaattgatggtcagccctacttgattttacaaaatgattttgtaaagccaggaaaaggccaggcttttaatagaatcaaagtaaaaaattttttaactggcagagtcattgaacgaacctataagtctggagaatctgtagagactgcagatatcgtagagcgctccatgcgccttctgtatactgaccaagaaggggccacgtttatggatgacgagacctttgagcaggaggttgtcttctgggagaaactcgagaatattagacagtggttattagaagataccatctacaccctagttttatataacggggatgtggttgctgtagagcctcctatttttatggagcttagcattgcagaaacagctccaggagtgcgtggagatacagcatcagggcgtgttttgaagccagccgtgacgaatacaggagctaagatcatggtccctatctttattgatgaaggggaattggtcaaagtagatactcgtacgggaagctacgaatcccgagtttctaaatagattgccgttgtaggaaaagtatttcttttttacagtgcgtaatatggaagctaagaaaatcaaagagctatctaaagaagctcaattgctaaaaaaattaagagagaagtctcgggttcttgatgaaaagaacaagcgcaaagcttgggttgctaagcttgtagctatgccagagtctatccgagagatagagaaagaagagcgcgtagaaactcctcaattatttcaagctatagcagagaagattttagaagaaggtgtttagtcacctgaatcttcctgcatcattctataacttctgacagtcccaagttgcttcattagcaatttctaaaggtgcatcaaagtctaagagatttttcaaaatcatagtgtgcacctgatatttttcaggatacaagtctataacatggaaacgtgaattcgttggtagagagatcgacccgctattgagaatataagagggcgaagtgtccgcacaattgtaaacagcagcttggtgttcgtgaccgtgtagataaaggcgtactttgggatatttcttcaaaacgttttgaagatgtgtattgttgataagatcatgactgggattttgtgaagagagcagaggataatggtttgcaatgatgacattctcttcaggggaaagagagagcaaaaaggtttcaatagccgaaatctgtgctaaatgcaccactccatttgctgaaaaccatccattcaaacaagaacaatctaataaaattaaccaccaatgatcagtgatcttgtgaaaggacaccttattctgttggagctggtcatttgggaagtgggtgtaaaacgtttgttgtgcaagagatttcagggtgtagacatcgtggttgccaggcaaaaggtaaaccgaggaatgcttagcgagagtttcaacgaaatgcttagcgagtaagaactctccatccatagccgtgagggagaaatctcccgtgatgcacacgctatccgctccaagagatcggactaccttagggaaacgctgccctatagttgtagcttgaaaatggactaacccaaataccttgcgcagaagtcctttgagccttttattaaagcagtgcacgggattgacagggagaacatgaaaatgtacatcggaaatgtgaataatacgatgcacatgtcggggcttttcttgcataggacgtgggttacttttgtttttctgatctactgtattagaatctagggaaaaattctaacaacaaagatcgatctctaaggagaagcccttagagtcaagattctaaggggctatcccaaatgattgataccaaggggtttattaattttataagagaagatcagagcgtagaaatctcatattgattttctaaaattaaaattttagaagagagaacgagaatcgctgtatctaaggcttgggctaggattgtagatgtcgtagctaacgaatctaagattccaccagcaataagatcttcaatttctctagaaaacacactgattcctaggcttgttgttccaagtgaggagagcttagcaatcacggcatccccatccaagtctgcattggttgccaagagcttcagaggagcacaacaggccttctgtaagagagaaattgcaatactattctcatcagcatcatctttaggagtccctaaagttaaagatgcatagaacaatgcaacgcctcctccaggaacatacccacgacttaaagcagattccataatcttaagagcgagggtatataaaggttcgttatcttcatcagtaggaagaatggctaccgaactttggagcctatttgtgcttttgattagccttttttttgtttcaaggcatgaggtcgtgcgtatttcttctgctaattgtcgcgtctttaaggtcaggacttccgggatatgtaggcctccaatgagtgtcgtttgtgactctgagatttctatagatagacaggaccctaaagtgaccatctcaggagctaaaacatgagatgcttcttggcaaggacaaatgtgggtcccagtaaataaagcaatatcctcggctaattcttgatttgtagtagagagttgaggaatggtgactacagttacttgcaagagcccttgcaatttgttaacaacaagggtagcaagtacgtctggatcgatatcttcacagaaaatgatgaggtgctggttttgttctgaaatttcttggagtaggggaagtaaggagtgaatcatagagatctttctatctgtgatcagaattagaggatgagcaattctagttagacgagacgctgtatcagaaacaaaatacgtcgaagcataccctgcaggaattttaaatccttgaaagacatccatggaagttttgtcgttttctctctccttagtgatggagataagaccctcagggcctaccacagaaaaagcattgtaaaaatgatcggcaatggtgggcatgtgtagagaagaaaaaataatattgcgaacttttagagcatctttaataggccaagattgttgttgtaaggcttcctgaagcttttctccctgcaattttaaagaggcaatgagcttgtgtgtggagattcccttttctaaagctgcatagctttcctgtaaaattgcatggagtaaaataagtccagtagtcgcgccgtcgctgtgttccttatgaattttattcaccatagctttcgcaaaatctacaccgagattttcataggaattcgaaagttctgtttgtgaaatagcgtagaagccacgctctttaaagaaagaagttggggagagggattgcttgggaccatacgatccctttactatctggaaaagtttatctatccctgaaaaaagttttttatcagcattgtaattagataatttttcctgttcggacatgcaaacccccagtagacgtaaaatttttacactaccaagtcgttttttagttcacaataccttcagtaggaaaggtggcacccggaatcgaaccggggatagaggctttgcaggcctcggccttaccgcttggctatgccaccaaaggggaggatgagaatccttagtttaagcgaaagaagattttatggtaagcgagaagtgcgcataattctagagactagggaaatcttagtcgtttttgagagatgcaattgcattttagttctcttaaaaaagaggttatgtaatcaacctaataagggtacttgcattcttgtctgcattttaaatatagtactttttagtgtaggtccatccttctggtagggagttcagactttctaaaaccatagatgctgtaggcaaaattatatgcgagctatgttgcttgaagattgggtctctctgatgctatcagatgtctcttgtccgaagtgtgataaaaaaattacaggatttgctatagatagccagaaagtgcagcctggggatctattttttgcccttcctggaaatgcaacagacggtcatcaatttttaaaacatgccgcaaccgcaggagctgttgccgccgtggtttcccatgactaccaaggagatagctttggtctagaattgatccgtgttgatgatacgaaatctgctttgcaagaagcaggatccaatcaatgcaatttattccaaggcacccttgttggaatcacaggatctgtagggaaaacaacaaccaaagaattctcaaaaacaatcctaagctccatctataaaactcacgcaagccctaaaagttataattcacagttgacggtacctttaagcctcttgatggcggaaggggacgaagatgtgatgattttagagatgggggtctctgaaccaggaaatatgcaagatctccttcggatcgtccagccagagatcgcagtgatcacgcatattaatgaccaacatgcgatgcatttcccccaaggcatccaagagatcctaaaagaaaaaagctatattctacaaaaaagtaaactacaactgctccccaaagattctccatattacctagatttaaggtcctgttctcctactgccgaaaaattttctttttcttttaacgatccccttgcagatttctgctacaaggcaattagtggagactctgtagtcatccaaactcctgaagaaaattattgtcttccgatagctttttcttacaagcctgcatataccaacttattaattgctgtagcactctcttggatcttagaagttccagaagagggagtgatacgctctctacctgaactgaagttgcctcctatgcgctttgaacatagcatgagaaatggaatgcaggtcatcaacgatgcatacaatgcatgtccagaagctatgatcgctgctctcgatgctctacctttaccaagtgatggagggaaaatcatcttaattttaggccatatggctgaattaggcaggtattcagaagaaggacatgctttagtagctgaaaaagcagcttctcgaggagatatgatattttttattggggaaaagtggatcccagttcaaagtgttttaaaaagctattcttgtgaagtgagctttttctcctcagctcaagatgttaaagacattttgaagcaagtggcacgctatggggacgtgattctactgaaaggttctcgtgccctcgctctcgaatccttattagcttgtttttaatttcttaggagcaagtatgatccccttaattccaatgtttctaaaacagtctctatttttttctttggctttgacagggatgaccacccttgtgcttacagtatctctgggtgttcctgtaatgaaatggctgaaaagaaaaaattatcgtgattacatccacaaagaatactgtgagaaacttgaaatgcttcacaaagataaagccgaggttcctacgggaggaggagtcttactttttatctcgttaattgcttctttacttgtttggttgccttggggaaaattttcaacatggttctttattatactcctgacatgttatgcaggtctgggttggtatgatgatagaataaaaattaaacggaaacagggacatggactgaaggcaaagcataagttcatggtccaaattgccattgcagcttttacactcattgctcttccttacatttacggaagtaccgaacccttatggactctcaagatcccttttatggaagggatgctttctcttcccttttggctaggaaaagtcttttgcttaggactcgctcttgtcgctattatagggacaagcaatgcagtaaatcttaccgatggtttggatggacttgctgcaggaaccatgtcctttgctgctctgggctttattttcgtagctctaagaagttctacaattcctatagctcaagatgtggcttatgttttagctgctcttgtaggggcttgtatcggattcttatggtataatggtttcccggcccagctcttcatgggagataccgggtcactacttctagggggcctgctagggagctgcgctgttatgctgcgcgcagaatgcatcctagtcgtgatcggaggagtttttgttgctgaagcgggatctgtcattctacaagtacttagttgtagattaaggaaaaaacgccttttcttatgctctccattgcatcaccattatgaatatcagggcctcccagagactaaaatcgtcatgcgcttttggatctttagttttgtatgcgcaggtctaggtatagcggctgtcttatggagatagatatgtgtcagcgcattcttattttagggactggaatcacaggaaagtcggtagcaaggtttttatatcagcaaggacactatctcataggagcagacaattctttagaatctctgatatcggtagaccatttgcatgataggctactcatgggagctagcgagtttcctgagaatatcgaccttgtgatccgctctccgggaatcaaaccgtatcatccgtgggtagaacaagcagtatctcttaagattcctgtcgttactgatatccaagttgctttgaaaacaccagaatttcaaagatatccctcctttggcatcacagggtctaatggcaagacaacaacgacattatttcttacccatctcttaaatactttagggatccctgctatagctatgggcaatatcggcttgcctatactagaccacatgggacaaccaggagttcgtgttgtagaaatcagctcatttcagctagcaacccaagaggaacatatcccagcactttctggatctgtgtttttgaacttttctcgtaaccacctggactatcatcgcaacttagatgcctattttgatgctaaacttcgcatccaaaaatgcttgcgtcaggacaaaacattttgggtgtgggaggagtgttccttggggaattcttatcaaatttactctgaagaaattgaggagattttagataaaggggatgcattaaaaccaatatacttgcatgatagggataactattgcgcagcttatgctttggctaatgaagttggttgggtctctccagaaggttttctgaaggcaattcggacatttgaaaaacctgcccatagactagagtaccttgggaaaaaagatggcgtgcactatattaatgatagcaaagccacaaccgtgacagcagtagaaaaggctcttatggctgtagggaaagatgttattgttattttgggtggcaaagataaaggtggagatttccctgccttagcttctgtattgtcccagacaaccaaacatgtcattgctatgggtgagtgtcgacagacaatagcagatgccttatcagaaaagattcctttgacgctctctaaagatttacaagaagcggtgtccatagctcaaactatagcacaagagggagatactgtgttattgtctccaggatgcgcaantttgatcagtttcaaagttttaaagaacgcgganttactttaagctgttgatcagaagaaatgcaggcagtgaggtaaatatgaatcgtagagacatggtaataacagctgtcgtagtgaatgctatattgcttgtggctcttttcgtcacatcaaagcgtattggcgtcaaggactatgacgagggattccgtaattttgcttctagcaaggttacacaagcagtagtttcagaagaaaaagtcatagaaaagcctgtagtcgcagaagtgcctagccgtcctatcgctaaagagactctagctgcacagtttattgaaagtaagccggttattgtaaccacaccacccgtgcctgttgttagcgaaaccccagaagtgcctactgtggcagttccgcctcagcctgttcgtgagacagtaaaagaggaacaagctccttatgctactgttgtagtgaaaaaaggagattttctcgaacgcattgcgagagcaaatcatactaccgttgcaaaattgatgcagatcaatgatcttaccaccacccaacttaaaattggtcaggtcatcaaagtccctacgtctcaagatgtcagcaacgaaaaaactcctcaaacacagaccgcaaaccctgaaaattattatatcgtccaagaaggggatagcccgtggacaatagcattgcgtaaccatattcgattggatgatttgctaaaaatgaatgatctcgatgaatataaagcccggcgccttaagcctggagatcagttgcgcatacgttgatctaagcagtcccttagcatgaaatggtttgttatttcctgtttattaggaatcttttctctagggctgattatggtttttgagacttcttcagcagaagtattagaccgctctttagaatgtagtacacataaagctctcatccgccaggtgacctatcttatccttggcttgggagtcgcatcgcttctctacatgatggaatggagagatttcttaaaaatcagtcctgtgttgctttcaggagctgccctagccttaatctgtgtgtttattccaggattagggatatgccgtaatggggcaagacgttggttggggttcggtcagctaacgattcaaccttcggaatttgtcaagtacctcgtccctatagtcgctctatatttccttacattctcttccctctatcagaaacaactgaaaatgtttcttaaacttacagcaattttatttattccgattcttttgattgctatagaacccgataacggatctgctgctgtaatttcagcatccctgattcctgtgtttatcatgacctcagtgcgcctccgctactggcttctaccacttctgtgcgtcctcatagctggaggagcccttgcttatagaatgccctatgtgcgctaccgcttaaacgtctaccttcatcctgaactcgacatcaaaggaagaggacatcagccgtatcaagccaaaattgccgcaggatctggaaagctactaggaaaaggtcctggagctagccttcagaagcttacctacctcccagaagcccaaaatgactatattgccgcaatctacgctgaggagttcggatttttaggtatgctcgtcctcatacttttgtatatgtgctttgtttacggagggtatgcaatcgctataaaagcatcatcactagaaggtgctgctttggcaatggtcattactttgattattagcatgcaagcatttatgaatttaggagtcgtttcaggcctgcttcctagtaaaggagtcaaccttcctttttttagccaaggagggtcctctcttatcgcaaatatgtgtggagtcacgttgttattgaaggtatatgatgaagaaaattcgaaaagtagccttggctgtaggaggttcaggaggccacattgtcccagctctctcggtaaaggaagctttttctcgtgaaggaatagacgtattactactagggaaaggtctcaagaaccatccttctttgcaacagggaatcagctatcgggaaatcccctcaggacttcctacagtccttaatcccataaagatcatgagcaggaccctttctctatgttcaggatacctgaaagcaagaaaggaacttaaaatttttgaccctgacctggtcataggatttgggagctaccactctcttcccgtgttgctcgcaggactgtcccataaaattcccttatttctacacgaacaaaatctagttcctggaaaagtaaatcaattgttttcccgctatgctcgaggtattggagtgaatttctcccccgttactaaacacttccgctgccccgcagaagaggtcttccttcctaaacgaagcttctccttaggaagccctatgatgaagcgatgtacaaatcatacccctacaatctgtgttgttggaggttctcagggagcacagatattaaatacttgtgttccccaagctcttgtcaagctagtcaataagtacccaaatatgtacgtccatcatattgtaggacctaaaagtgatgttatgaaggtgcaacatgtttacaatcgtggagaggtcctctgctgtgtgaagccgttcgaagagcaactcctagatgtcttgcttgccgcagatttggtcatcagtagggcaggagccacaattttagaagaaattctttgggcaaaagttcccggaattttaattccctatccaggagcttatggacatcaggaagttaatgctaaattctttgtagacgtcttagaagggggaactatgatcctagaaaaagaattaacagagaagctattagtagaaaaagtaacgtttgctttagactcccataacagagaaaaacaacgcaattccctagcggcgtatagtcagcaaaggtcaacaaaaacattccatgcattcatttgtgaatgcttataggttcattatatgaagggaactcctcagtatcattttatcggtatcggtggtataggaatgagcgctttagctcatattttgcttgatcgtggctatgaggtctctggaagcgacttatatgaaagctatacgatcgaaagcctgaaagctaaaggtgcgaggtgtttctcaggccatgattcctcccatgttcctcatgatgccgtcgttgtttatagctcaagtatagcccctgataatgtagagtatcttaccgctattcaaagatcatcacgtcttcttcatagagcagagctcttgagtcagcttatggagggttatgaaagcattctggtttcaggaagccatgggaagacagggacctcatctctaattcgagcgattttccaggaagctcagaaagatccctcctatgctattggaggactcgctgcaaactgcctgaatgggtattctggatcatcgaaaatcttcgttgccgaagccgatgaaagtgatgggtctttaaagcactacactccccgtgcagtagtcattacaaatatagataatgaacatttgaataattacgctgggaatcttgataacctggttcaggtaatccaggacttctctagaaaagtaacagatctcaataaggtattctataacggggattgtcctattttgaaaggaaatgtccaagggatttcttatggatattcaccagaatgtcaattgcatatcgtttcctataatcaaaaggcatggcaatctcacttttcctttacctttttaggccaggagtatcaagacattgagctcaatctccctggacaacataacgctgcaaatgcagcagcagcctgtggagttgctcttacctttggcatagacataaacatcattcgaaaagctctcaaaaaattctcgggagttcatcgacgtctagaaagaaaaaatatatccgaaagctttcttttcttagaagattatgctcatcatcctgtagaggttgcacataccctgcgctctgtgcgtgatgctgtgggtttgcgaagagtcatcgcaatttttcaaccacatcgattctctcgtttagaagagtgcttacaaaccttccccaaagctttccaagaagctgatgaagtcatacttacagatgtctatagtgccggagaaagtcctagagagtctatcattctttccgaccttgcggaacagattcgtaagtcttcttatgtccattgttgttatgttccccatggagacatcgtagattatctacgaaactacattcgcattcatgatgtctgtgtttctctaggagctggaaatatctatactattggagaggctttaaaagactttaaccctaaaaaattatccataggactcgtctgtggagggaaatcttgcgaacacgatatttctctactttctgctcaacatgtctctaaatatatttctcctgaattctatgatgtgagttacttcatcataaatcgtcagggcttatggagaacaggaaaggattttcctcatcttattgaagagactcaaggggattcgccactttcttctgaaatcgcttcagctttagcaaaagtcgactgtttgtttcccgtgctccatggcccatttggagaggatggtacgatccagggattttttgaaatcttaggaaaaccttatgccggaccctcactatctttagcagcaactgcaatggataagctgttaacaaaacgaattgcatcagcagtgggtgttcctgtagtcccttaccaacctttaaatctctgtttctggaaacgcaatccagaactatgtattcagaatcttatagagacattttctttccctatgattgtaaaaactgcacatttgggatctagtattgggatatttttagtccgtgataaagaggaattacaagaaaagatctcagaagcatttctatatgacacggatgtgtttgtggaggaaagtcgcttagggtctcgtgaaatcgaagtgtcctgtatcggccattcttctagctggtattgtatggcagggcctaatgaacgctgtggtgctagtgggtttattgattatcaagagaaatatggatttgatggcatagattgcgcaaagatctcttttgatttacagctctcacaagaatctttagattgtgttagagaacttgcagagcgtgtctaccgagcaatgcaaggaaaaggttcagctcgaatagattttttcttggatgaagaggggaattattggttgtcagaggtcaatcctattccaggaatgacagcagctagcccatttttacaagcttttgttcacgcaggatggacgcaagaacaaattgtagatcactttattatagatgctctacataagtttgataagcagcagactatcgaacaggcattcactaaagaacaagatttagttaaaagataataaaaaaactagagatctttttattaaaatctctagtttttacatgtaaacaaaagcagacgaataactacgattaatggtggttactacattcgcaagaatgatgcatattgccttcttcttgttcttcttgattaagatcttcgtcgtaatgacagtgtccactgcagcaggtgtcagactcgccgaaagtatcttcagtagagttagaagagtcattatcacagatgtaatcttgatcagcaatcacatcagttccattttcaggctgaaccaaatctatctgcactttcttttttaatctagaacatacacgtctaagaatcgttcttagcgcatgtattgtgttccctcttcttccaataattttcccaatatcctctgctgcgacacgaatttctaacttaatagattcgttatcctcgtcttcaatagaacgaatttcaacagcttcaggattagtaactaaattcttaacaatatatgctacaaactcttccataaagtccaaattaaattgagatatagaaagaaaaaaacataactctatgtttttaaagttcctgaagaaaggatagatattcaaaatgaaaaagtcaatgtctaatctgaaagcggaggcttctctggatagctgagaatcgttaaccaattcaagtacctcggatccccattttcaataggaaatagtaagacttcaggaacctcatagccagagaactcctgaatagcaagacaaatttccgagaagcgtatgtctatcgatttgatttgtatatgatgttcttcagactcacatagcttgccttcccatagatatgtcgatgtgcctttagggaatacatgcacacaggaagcaagacgctctgtaatcagatgtctagctaaggagcgagcactttcctccgaagggaaagatgtaagaataagaacagcagtcatagagcttttaataataagaaatttggaaaacgcaaatcatagacatattgtttttcgctctcgattacaggactttttttcatgtgcttatacaggtctaaggcacgatctaaggtcttaattggnagtcttaacagactgcctgaagagagcgtcactataatttctccagggtatgcatcagatnaagataaatcaatgattttcggagactccatagcaagctccttaagaagaatcttggtaaaaagcattttttctttagggagtttttgcatttttaaatcttcttgagagaaaaaaatctgagggagattcagagaggggaagtacggttgaccaagaaagcagctcccctcgagattgcataacgtattagatcggttcccaacataagcaataggtgtttgtaaggtatagaaaattgtaatgcccttattatcaggagatttttctataactaaagaggaaaaaatcccaagagcatgcaagctcgactcagcttctttaatagagaattcatggagatatgtaggtgcatccgcagaaagacgtaaatgttctgcaatcgcagtaggagggactttggatagagtggaggaaactaaaaataggttcctaatgggagaaggattgaatttagataaagacagttcagggagaaataaccaacaaaatgtaggaacacaaacaagggaactcaaaacgatcaggatcgaagcataacataaagagtattgaggacccggagggaaaagcgttttgaaaaaacgtcttatcatgagctcattgttttttattatgatcataaataatatcgctaatatttacgagattcctcttggagagattactgatgaatttatcagctaaagaatacggagatatcattgttatttatttacaaggatctttagatgccgtctcagtgcctagtgttcaagagtatttagagcagtttatacagaagaaacatcttaaaattgctctgaattttacagatgtctcgtatatcagtagcgcagggattcgtctactgctgtctaattttaaattggttcagagcttgggaggaaaaatgtgcctatgctgtgtcaaagagagtgtaaccgaagtcatgcggattgccaggtttagacaaatgatcttgctctgccaggtctgaacaggaatgtttaagtaagttatantttctctatatgcttccttttgaattcgagtttaatacaacttcttctcctgaatgcgacgtatgccttgatcctcagaagttatttgtaaagctatttaagcgtacgatcgtcttgctttcaggacctacaggatctgggaaaactgatgtttctttagcattagcccccatgattgatggagagatcgtctcagtggattctatgcaagtataccaaggcatggatatcggaactgcaaaagtatctctaaaagctagacaagagattcctcaccatttaattgacatccgacatgttcaagagccgtttaatgttgtggatttttattatgaagcaattcaagcatgccaaaacattttatcaagaaataaagttcctattttagttggtggctcagggttttattttcatgcctttctttcaggtcctcctaaaggtcccgcggcagatcctcagatacgagaacagcttgaagcgatagcagaagaacacggggtttctgctctttatgaggacctacttcttaaagatccagaatatgctcaaacaatcactaagaatgataaaaataaaatcattcgaggattggaaattatccaacttacaggaaaaaaagttagcgatcatgaatgggatatcgttcccaaagcttcaagagagtattgttgtcgtgcctggtttctttcccctgaaacagaatttttgaaaaataatattcaaatgcgttgcgaagctatgctgcaagaagggctgctagaggaagtcaggggattattgaaccagggaataagggaaaacccttcagcattcaaggccattggatatcgagaatggatagaattccttgataacggagagaaattagaagagtacgaggaaacaaaaagaaaatttgtatccaatagttggcattatactaaaaaacaaaaaacatggtttaaacgttattcgatatttcgagaacttccgacattaggcctctcttcggacgcaattgctcagaagatagctaaagactacttactgtacagctgatgtgttgataaaaggtatttctctccacaggaatgaaaccttcagatcgaatgatattacagatttcttcttcagagctctgtatcgaccatcctgtagctttatgcacgctttcgtctaaaataacccctccaaaatcatcagctccgtaatggagagctttcgctcctaagcttttaccctcgccaaaccatgaggctgctacgtgatcaaaattatccagaaagattctgcccaaagctaaaatgcggtaataggtttcaatagaagcttgttgaggaacgttacgtcttagggccgtattcccaggtttataactccaggggataaaactataaaagccagggcagctatcttgagcatcacggagtgtttgaagatgtataaggatatcttctgggttctccacatgcccaaacatcattgttgctgttgtgcgaaagcccatgagatgggctaacttatgtagattgatccagcccccaggctgcattttttttggagagatgatttttctaactctctctgaaagaatctcagccccgcccccagggatggtacgttgccccgcatcccataacctttggagaccttgctcaatactgatgccagagacccggcaagcatgttcgatttctactgcagaaaagaaatgaggatggatggaaggaaattcttgaacagtaatgcgtacgagttcttcaagataatcgatgcctaaccccgggtgcacaccaccttgcagtaaaacagttttgactcctgaacttacataacgttgtaataggctgcgaacttcatcaaaagataatagataagcgtcgggagatttaggctttctgtagaacgcacaaaacgtacaatctattttacaaatattagtatagtttggattggcatccaaaacataagtaacttcatttgaaggatatcgttctttacgaatcgcgtccgcacgctcttgtaatctctcgataggggacgaaacaaatagctctaatccttcttcaaatgaaattcttttacataaattcataaaataattgacgttaaagattgctagcagcagactttaagttttaacaattttatttgtcaagccccacacctaagttgttattatggataattcagacaacagctttcatactttggaaacggagcagggatcgtttttaaacgatgaattagcagtcgaagaagtggcgtctacagaaagcacagaaatttctgatgcgacattatgtttcgctgatgagattcaagagctcccctccccagaaaagaaagttgcttttatcttgaataagatgagggaagccttaacaggatcatctcaaggctcagacttaaggttgttttgggatttaaggaagcaatgcctccccttatttaatgaaatcgaagataccgcgaaacgggcagatcattggcgttgttatatcgagttgactaaggaaggccgtcatctcaagggtcttcaggatgaagaagggtcttttgtcgttggtcagattgatttggcaatcacatgtctagaaaaagatattcttaagttccaagaaggaacagaagataaaattttcaaagatagagaagataatttcttagaaagccaagctctagataaacatcaggctttttataagcagcatcatacctcattgctatggttaagtagtttttcttcaaaaatcatagatctccgcaaggaactgataaatgttgggatgcggatgcggttgaagagtaaattttttcaacgtctctctaatttaggaaatcaggtgtttcctaaacgaaaggaactgatcgaaaaagtaagtcaaacatttgcagaagatgttgatgcatttgtcgctaaatattttattggatccgataaagaaacattgaaaaaaacggttttttttttaagaaaagaaatcaaaaaccttcaacacgcagcaaaaagactttttgtctcatcgcatgtttttgctgaaacacgattgaaactcagtaagtgctgggatcagctcaaggggatggaaaaagaaattcgccaagagcaaggccgcttacgtgttgtatctgctgaaaattcaaaagaagttcgccagatgttagctgaggtctcttctcttcttattgagggaaatgatctgagtaaagttcgtaaagacttggagggcatttctaagaaaattcgagctcttgatcttacgcacgatgatgtcatctctttgaaaaaagaaatgcaacaattatttgatcaattacgagagaaacaagacgcggcagagcattcctatcaagagcaattagctaaagataaacaagtcaagaaagaagcggctcgctctcttgctgagcgcatcacaacattctcaaaaacttgctccgaaggaacattacttccgaatctcgagaagaatggcagacattgaaagagctcttaggtaaaatgtcttttttacctcctcctgaaaaaatttctttagataatcaactcaatcttgctcttcaaactattgttaacttctttgaagaacaacttctctcttctccagattctcgagaaaagcttgtgaatatgcgccaagtattgaagcaaagacgagagcgtcgtcaagaacttaaagataaattagagcaggacaaaaaattattagggtcttcaggattagattttgatcgggccatgcagtatagtgctctagttgaagaagacaagcgtgctcttgaagaattggatgcaagtattttagaattgaagcaacagattcagcaattgctatgagaagaaactgtatatatgcttttgatttagacggaaccttattgaaggggaatagcagctggagtttttattgctacggcttacttcaaggtttgttttcctataaaacgttgcccccctgcatttaccgcttttttagatttaagtttttttttgggatcttccatccttctattattcgatagtaactcgtctactctcttctgttccctgtgatgatctttatgaagttgccttgaattttgtatcgactctgaccggctccgatttttatgctcctgttttagaaaaactagaagaagcttttgcagataccacaggacaggcgatccttttttcttcttctccagactttattgtccaccccatagcgcagcaactcgggattagttcttggtatgcgtcgtgttatcgcgatcagtctgcagaacagacgatctataaaaaatgtcttacaggggataaaaaagcgcaaattttgagttatattaaaaaaattaatcaagcaagaagccataccttctccgaccatattttagatcttccttttcttatgctgggagaagagaaaaccgtcgttcgccctcagggacgactcaagaaaatggcaaaaaaatattactggaatatcgtttaattccatttaaaaaaaagctcgaccttatcttggataatcgagtatcctaaagctggttttatggattcattttgttttgatctattgaaagtagctgctaaagctattgacgacaaaaaagggaataatctggttgttctagatgttagaacaatttcggaatttaccgattattttgtttttgttgaaggtagtgtgaatgtgcatgttaaggctttagcaaatactatcgtagaagagttaaaaaagcagaaagttagtcctcttcatgtggaggggataacggatggtaattgggtggtgatagattacggatttatcgtcgtccatgtatttgtctctgaaattcgtggaaaatatcgtttagaagagctatggaaggacggatttattgtcacatccaagcttttagcttcttaatggagtaagggtctacatgagtaaaaaacgcgtagttgttacaggattcggtgttgtatcttgcctcggtaatgaagtagataccttttacgataatcttcttgccggtgtcagcggcgtacgaccaattacatcctttccttgtgaggattatgccactcgttttgccggctggatcccagaattcaatcccgagccttatgtagataaaaagcaagcacgtcgtgtcgacccctttattacctatgccatggtagctgctaagaaagcgatcgctatgtcacgttgggataaagaccatctgccttccgatcccgtgcgttgtggagtgattgtcggctctggaatgggtgggctctctaccctagaccaagggatggaaagactcttagttattcataaaaaattatctcccttctttattccttatatcattacaaatatggccccagcacttattgctatggactttggtttgatgggccccaattattctatatcaactgcatgtgctacaggaaattattgtattgatgccgcctaccaacatttagtatctgggcgcgctgatatgatcatctgtggtggtacggaagctgcagtgaaccgtattggtttagagggttttattgctaatcgtgctctctctgagagaaacgatgctccagatcaagcttcacgtccttgggatagagatcgtgatggctttgtcttaggagaaggagcaggaattcttgttttagaaaccctagagagtgctctacgtcgcgatgctcctatttttgctgagatgttaggaagctatgttacatgcgatgccttccatattaccgctcctagagatgacggtgaggggattactgcatgcgtgcttggtgctttaaattccgcaggaattcctaaagaacgtgtcaactatgtgaatgctcacggaacgtcgactccattaggggatctttctgaagttctagctgttaaaaaggcttttggctcccatgtacgaaatctccgcatgaactccactaaatcattgatagggcattgtcttggagctgctggaggtgttgaagccgtcgttgcaattcaagctatccttacgggaaagcttcatcctacgattaatttggataaccctatcgcagaaattgaagactttgatgtagttgcaaataaagctcaagactgggatattgatgtagcgatgtccaactcatttggttttggtggacataattcaacgatattattctcgaggtatgtaccctagttatgatgaagacaaaatatgagtattcttttggtgttattcctataaaattttttggcacccccgataagaacacattaaaagcttgttttatttgccatactcgaggaaaacattggggattccctaaagggcattctgaagataaggaaggtcctcaagaggctgcagagagagaattggtagaagaaaccggactaagtgttgttaatttcttccctaaagttcttatcgaacagtattcgtttaataatgaagaacaagtcttcgttcgcaaagaagtcacctattttcttgctgaagttcgtggtgacatccatgcagatcctatggaaatttgcgatagtcaatggttatctttgcaagaaggactccgcttattaagttttcctgagctacgagatcttaccgtagaagcagataaatttattaataactatcttttctcttcttgattttcaaggagagggaacccctctccttagacattaattcacttcagcagtgtctccaatataggataagtaatcctcgtgagcgagctgtatcaccttttgtgcttccttcttcccgtaaatccccacgatttcaatttttgcagggctacctttaattaaatgattgggagtcgctttatatgttaggaaatagtgttggatcatatctaatactgtgcctggacagtctgaaatatcttcgatctcagcaaagactaaatcgtcctctaaaacagcaataatcttatcatcagcttctccagaatcaatgatgcgaagacctcctataggacgtgcttgaagtaaaatatttccatgatggatatttttttctgtaagaacacagacatccagagggtctttatcaccttggattccttcgcgacgtgtttgttccccgctatagttcccagaagcagtgccacagtatgtttgaggcagtaaaccataaaggcagggacaaaagttagaaaatttttgaggtctgtctactttgagcaagcctgtagccttgtctaattcaaattttacagagtcataaggagtaatttctatataacaacacagggactcataattatcctgggttaatgtagggctgtgccaaggatgtgcaacatataatggttttttagacataagtaactctcaatataaaatttcctatacaatcgggtttagtgaatttagactaacacggagaaagttttaagagaagtgtctgctcaggcctaattgacttttaattaaaagtagtcaataattttattttctaattaaacctcactaatttatgaaatactcactgaactttaaagagatcaaaatagatgattatgagcgtgttattgaagtcacatgttcaaaagttcgtcttcatgcaattattgctattcatcaaacggcagtaggacccgccttaggtggagtgcgagcctctctatattcttcttttgaggatgcgtgcacagacgctcttcgcttggctcgggggatgacctacaaggcaatcattagtaatacaggaacaggcggggggaaaagtgttattattcttccccaggatgctccttccctcactgaagacatgctgagggcttttggccaggctgtgaatgctttagaggggacctacatctgtgctgaagatcttggtgtatctataaatgatatttctatcgttgctgaagaaactccttatgtgtgtgggatcgctgatgttagtggagatccttctatatacaccgcacatggcggatttttatgcataaaagaaaccgctaagtatctttggggatcttcctctcttagagggaaaaaaattgcgattcagggaataggctctgtaggacgacgtctattacaatcgttgttttttgaaggcgccgaactttatgttgctgatgttttagaaagagccgttcaggatgctgcaaggctctatggggctacgattgttcctacagaagagattcatgcattggaatgtgatattttctctccttgtgctcgtgggaacgtgattcgtaaagataatcttgcagatttaaattgtaaggcgattgtaggtgtcgcaaataaccaacttgaagatagctcagctggaatgatgctccacgaacggggaattctttatggtcccgactatttagtgaatgctgggggattgcttaatgtggccgcagcaatagaaggaagagtctatgctcctaaagaagtgcttcttaaagtagaagagcttcctatagttctaagtaagctatacaatcaaagtaaaactacaggaaaagaccttgtagctttatcagattccttcgtggaagacaagctcttggcctatacgtcatagagcaataagcttatccgtggggacaacattgagttggttttgtaacgctgctaatgttgtctcatgggtttcctggtctccagaagcaagaatcactgcgtgattatttaagaccaaactttcttttctatattctaaaggggctcctaaagcatccgtgactctacccccagcttcttcaacgaggaaggctccaggtacgtgatcccaagcacgagcgggagaatcaataaaagggtagcgaatgaaaaaatctacggcgccttcagcaactaaagcatacttatattggctttctacacgacgaggactcggagtgttggggagacccaggcttagcttacgtgttgcatgatgctgttgattcaatgcagctaacgaagcctcacagaattgttttgtttgttttctatcagcataaacaaagcgtctatctagattttgagaatgaacaatagaaagaccatgacctttagctgctgaatatagtttaaatgtctgattataggcagggcatgccatgaccgacaaaatcggtcgatactcataaattagtgatatagcaacggcaaaagcacgatgtctgataaaacctgcagtaccatcaatagggtcgacaagccaaaataaagaagtcggagatggaggagggaccagggtagaaattaagtcatctcttgagactgaagaagttaacaggcgtgtaaattttaagatttcagggattttttcgttgtcttgatcaggatatagagtttcttctccaataaaaggaatattgggaaaggcttttgcaagctgttgttttagataatattgactgccgtaatcagcagcggtgataaaagaaccatcggatttttcccaaaaaggaaccaaacggtgctcgcttcgatagtttagtagttgtgtagtgatttccgtaactacagactcaacgatgttctgatagttaggcaactcggagtgcatagaattttcctcaagtatctagataagaatgttagcaaaagttaggattatgttaaacttcgggagtagcactataatagatagcatagtgcttacaaaaaattctttttccctaagtaaggggaacttatgctaatcaagctatggcgagctacttatgaagggatgtatacatttcttgtgggtgcgttgctaaagttgcgctaccgtatgcaagttgaagggtgggacaccttaaacataaatcctaagcaggggtgtttgtttcttgccaatcacgttgcagaagtggaccctattatcttagaatatctattttggagtcgattccatgttcgtcccatggcggtcgagtatttgtttcatagtcgcgttgttcaatggtttttaaattctgtaagatccattcctatccctcaacttgttcccggtaaagagagtaagcgctctttagaacgtatgaacgtatgttatgaagaagcctcacgagctttaaatagaggggaaagcctccttctttatccttcaggaaggttatcgagaacagggaaagaggaaatcgttaatcagtattctgcttatgtgttattacatagagttatggaatgcaacgtggttttagtcagagtttcaggcttatgggggagtgcgttttcgcgctataagcagaactctacacctaagttaggccctgcgtttaaagaagcttttcgagctttactgcgtcgtgggattttttttatgcctaaaaggtttgtaaaaattactctatgtcaagtagatcatctttttttaaagcaatttccaacaaaacaagacctaaatacttttttggcttcttggtttaaatcaaggagatgacaatttgcccatagaagttcccttacgcataacgaggaagttacgacgtatgcacgatcaacggaataggggtcataacaaccataatttaaggttgcgacctggatctacattattggaagcttttttaatattatgttccgaacatgaagagggaattgcctgttttgacgaacatctaggctcactctcttatcgagaacttcgcaatgctataattgctgtagcaattaaggtctccaagttttctgaagatagagttggggtgatgatgcccgcatctataggagcattcattgcctattttggcattcttcttgcggggaagactcccgtaatgatgaactggagtcaaggactcagagagctacgtgcatgtacaaaaacagtagaggttcgacgtgttcttacttcacagcagttcatcaaacatttaactgaggtccaagggttcgtagaatatccctttgatcttatgtatatggaagatgtgcgtaaacgcctttcctggtgggagaagtgccggatagggttgtattctaaatgctccgtcccttggttgctcagaatctttggagtttcaggggttgagagcgatgatactgctgtcattttgtttacttctggaacagaaaaacttccaaaagcagtccctctaacccataagaatttaatggaaaatcaggaggcatgcctcaaatttttcgatcctaatacacaagatgtcatgttggcatttctccctccttttcatgcttatggattcaatagctgtggcttgtttcctttactgatgggcgttcatgtagtattcgcttcgaatcctctaaaccctaaaaagttagttgagtttatcgatgataaaaaggtcaccttctttgggagcactccggtatttttcgactatattctgaaaacagcaaaaaaacaaaattcctgtttggagtccctacgacttgttgtgatcggcggggatgcattgaaagataccctctacgaagaaactaagaaattacaaccacaaattgctctctatcagggctacggtgctaccgaatgttctcctgtaatttcgattactacgaaagaaagtcctaggaaatccgagtgtgtgggaatgccgatcgaagggatggatgtgctgattatttctaaagagactcatattcccgtatcctcgggagaacagggattgatcgttgttcgtgggaactctgtattttcaggatatcttgggaaccatgaacatcagagttttgtctccttaggtggggatcagtggtatttgactggagatttgggtcatataggtcctagcggggatctatttttagaaggtaggctaagccgatttgtaaaaatcggtggagaaatggtaagcctagaagctttagaaagtattttgcatgagcattttactgaaaatcaaaatgaagacgcaggttccctagtggtgtgtggtattcctggggataaggtaaggctgtgtttatttactactcttgctacaacaatacatgaagtaaatgatatcttaaaaagcgctgaaaccagtagcatagtgaagatatcgtatgtgcatcaggttgaaagcattcctatcttaggcattgggaaacctgattacgtttcattaaatgctctggctgtttcattatttgggtaagtagccgtttctctgggtaggttgatacatagtgagtttgcaaggagagtttcttgactaccagtgatgttatagattttgtaacaaatgattttctaggtttcgctcgttctcccacaatatactgtgaggtaagtaagcgtttccaaatacattgtcagcagtttcctcatgagaagctcgggatccgaggttctcggcttatggtagggccttcttcagttatcgacgatcttgagtctaaaatcgcaagctatcatggagctcctaatgctttcatagtcaatagtggctatatggcgaacctaggcttatgtcatcacgtatcacgatctacagatgtccttttgtgggatgaagaagtgcatatgtcagtagtgcacagcctatctgcaatctctgggcaacatcatacttttcatcataacaatctggaacacttagaatctctattacagtgttacaggataagctctaagggaagaatttttatctttgtctcttctgtatattcttttagggggactttagctcctcttgagcaaatcatagcactatcaaagaagtatcatgcccacttaattgtagatgaagctcatgctatgggaatttttggagacgatggtaaaggactgtgccatgccttaggttatgagaatttttatgctgtattggttacttacggaaaagctttagggacgatgggagcctctttattaacgtcatcagaagtgaagtacgatttaatgcaaaattctccgcccttgcgttattctacatctttatctcctcatactctaatttctataggcacggcgtatgattttctagcctctgaaggggaaatcgcacggaagcaagtctttaagttaaaagagcactttcatgagtgtttcgactctcatgctccaggatgtgtgcagcctatatttttaccacacacctgcttggaagaagcaatttctgttttagaaactacagggatccatgtaggcgttgttgcctttgctaagcatcctttcttacgtgtgaacttgcacgcttacaatactgtcgatgaagtgaacctgttggctcaagttatgaagccatacttagaaaaaagtagtcatagggtccacatcaatcatgaatttcacctttggcgagagctttgccagcattaaggcgtgatggagtttcttattcactggaatgacataagcactcttaattaaaaactgatagcggaacgtatccttgattttaaaatgaccgcaaggagtcactggcatcagtggattcgtgctttctagctgctcttttagaatgttatggactcggtgggcctcttcccaagtctgcttgggacatttccccatgaaaatacaacggataagacggataaatggaggatactcacagagttcgcgacctgtgatttcctgactataaaatgccgagtagtcctgacgcatagcactatgaattgtgggatggtcaggaagaaaggattggatgagaatttctccaggtaggtggctccgacccgacctacctgctacctgtgtaatgagctggaagacttgctctgaagctcggaaatcagggatatacaatccagaatctccatttagaatgaccgcgagtgtgactgcagagaaattcatgcctttggcaatcatctgggtgccgatcaaaacatctgcttttcctgttgcaaattgcctgagtaacgtttcatggctccccttgaatttggtagtgtctgaatcaatacggatggtacgtatctgaggaaaaatctgctggagaattttttctattttttctgttcctgagcctcgatattgcaacgtcatagttccaagacattttggacaagattgtgggaggtctttaggtgaggagttgcatagatggcagagaagcacatttgcatatttatggaaggtgagcaccatgtcacaatgagggcatttcaatgtatgcttgcaaacagtacaagagacgttggtatgatatccccgacgattaaagaaaatcaaaacctgctctcccacttccagacgttcggctattttctttaacacaggctgggaaaatagaatcttggtttttgacttttccctctctaagttcatgttgataagagaaatttttgcgggatgagcagcagctgctcttgaagagagccgagacagaacgtacttgccagatagcgcattagtatagctttctaagctgggagtcgcacttcctaaaaccacagtagcatgagcgagtttgcctcgcattacagcgacatccctggcatggtagcaaggaggactttccgtttgtttataggcgggatcgtgttcttcatctacaatgatcagtcccagattcttcatggggcagaaaagagcagaccgtggtcctatgaggatacgtagggatcttcggaagcttggcgccacgtgcgacttttgatcgctgtcgctaagcttgtgatggagaacacctacatccttgccaaagcgcgctttaaataatgagactgtctgcactgtgagagcgatctctggaacaagaagaattgtacttttcccttgtttaagagcctcgcttgttgctcgaagatagatctctgttttaccacttcctgtaattccgaaaagtaaatgtgtatggaattgtgaggtttttagtgaggaaaaaattttatctatagcactttgctgttcaggatgtaaatccttaggagcaggcgggaaaaaggttaggaggtcttcttgaagctctaactgcgctgcatctacaatatcaagaatgcccagcttttcaagagaatgaattggagattgcgatactttggcagtctccataagggaagataaacccggtggggacgcatgttgtagtagaatttttaaaacagccccttgagaaggatgtaaaacttctaattttgcaagaatctctttagtttttgctttactttgctttaagacgacacggtagtgctgcttaggctgaatcacattcgaagagatagcgggaagaaataattttagagttttcccaagaggagcaaagtagtattggctgatccaaaatagcaagtctagaagatcttgaggaaggacaatctctgaatcggataatcctaagataggtaaaattttcttacattgggtcgttgtttttatttgataaataactccaacttttttccctccccgtaaagagatagtaacagcagttcctttagtaatgtgctctagattttcaggaacgccataatcgagtaccttgttgatgttagagcctacgatgacttcggcgtataggcgaaaggtagacgattcaatatagcccatagatttcgttttagctgtgaatctttttcatactctagtgaagaatagaggggaagaaagatacatccattttgtgtcagagattgatgataatcagttgtaggaattttataacggatcacatttaaaggggctagagctaaaaaaaaattggggttgtttacgaagatattcgtcttcgcatgaatcaaagtcaactttgtagggaaaagttgttgcgtaagaatttttgctaatctgttaaaaaacagcacttcttcgttgttttcttcataaacaaaaatagagcaggggatcttcggagcaggaagactacaatcttttaaagcgggatatttctcttttaaaatagcattttgtgacaggtctggatgcagaggaacacatttccaatctgaaggcttagtcttttcttgagaaagatttgtcggtggaggaggggtgattggttggggttctgcattggggacttctacagctttctcaggtatagaagaaacacttgcagagattgcagtattcggaagagttacattcaggagagatgcaagtgttggatagagttcctcagaataacgatccaaaagttgacagagagtgtcatgaaaattttgagagttttccataaatagccaatgtttctaaaaaagagaggtacgttttggtacccataaaaggagagctctctgtggataagaatttctattcttattttatcctaaatcagataatagtgtcatcatactcaacaaacttattcgacacgtttttttaaggatagtgacatgaaattttggttgcaaggatgtgcttttgtcggttgtctgctattgactttaccttgttgtgctgcacgaagacgtgcttctggagaaatttgcaacaaactcgtcctatagcagctgcaaatctacaatgggagagctatgcagaagctcttgaacattctaaacaagatcacaaacctatttgtcttttctttacaggatcagactggtgtatgtggtgcataaaaatgcaagaccagattttgcaaagctctgagtttaagcattttgcgggtgtgcatctgcatatggttgaagttgatttcccccaaaagaatcatcaacctgaagagcagcgccaaaaaaatcaagaactgaaagctcaatataaagttacaggattccccgaactggtcttcatagatgcagaaggaaaacagcttgctcgcatgggatttgagcctggtggtggagctgcttacgtaagcaaggtgaagtctgctcttaaactacgttaagggattttataacttatttttgagaccttccttttttaagttgaatgtgagaactttcttacaaacccttggattaggataaggtctcaaaaaagtgcgtaggatattaatcaggttgctgagactttctgttttcagaatctaaataattagagatcactgctgctaatctgtctactacatttggactgagaggatttagatggagaagatccctttcgggtataggaattttagtccccgaggtttttacttcaggaagctctagaaaaggtgttnctacgcaattttctctttcgaagaggccgtcgctaatgagttcttgatcatgattagagttgtaaatgaaaatttcgggacaacgcaatctttcgctaggtttcacagagtctatgttccaaccaacgagttttataatcgcggaagctatgggcttacaaatttgattcgcgacatctgctagagagcgagggccccgatcttttacaacaatccatgaagttccatcactgccatcagtgacctcacgatctagagcagcagcttggacactagttcccaaagagtatccgaaagctatgatttgattggctttaggacctgtctcttcatctcgtaggtagcgtacgcatgcctgatacgatttaaccagattttctcgtttcgcttctcctttgctggacataattccaggatagttgaacacaagaagattcgagccggttgctttggctagctggtgtagagaggaatcgccccgatcgaacaggttttccatcaatccagagtttccttgagaataaagaatccacctgtggggaagagcatgaggtatctttatagctaagctatcaaccaccaaatcgtcatattgtataaccacacgatcggcagctgagatttccttaaggcttaggagttgtttaatatgggacagaaaggtcattcgccgaattgccacagctgtttttgacatgctctgagatatgatagaagatgggagaatgaaaaactgacaggttttcttgagtacccacaataacgctaagggaaggaacagaatgattgagataataaacttcacaatattccaaatcgttcctagaactttaaataaggtgggatgggccttccgtctttcagaagctatctctgttttttttgaagagaacatgattaaagacggctttggatccgtctctagaatcgtatcatcacgaaagtttattggggtaggggatgggatcatacaagagtcctaaattttaggtacacagagtataaagagaacaaaagaaaaagaatacgcattataattttttaattttttctagagagactctcaaggattgcttcagcaagcttttgtattgtagggtgtttcagagggcttgagtggagtagatttacctctcctataaattttttactcctggcaaatggggttcgttttattgcatgagcaagagtaaactccgggagcaatgcggtatcatcaccaacttctgaagggcgaaatcgatccgcagaataaacaagaatttctgggcaaggaagctctcggctgtttttttccgcatccattttccatcgagcgaggactgcgatgagttttcctattggcccgaagaaactattagcagctgcgggtaaagagtggggagcacggtctttgactgctacccaagaagtctcgctatttgtaaaaggattttttgcaaagctgcagactggactacccctcctaaggaatatcctaggtgatgatttcgttagccccagggccctgaattttatcttgtaggtactttgcacatagattatgactgtcgctaggttctctaagttcaattttcctgtgctcgacttaaccccaggatagttgtaaattaggatattagcgcctagcagtttagctaactctttccaggagagaaacaaggaatctttcaggcctatcatgtcttcgaggaaatctccacttcctagagaaatcagcagccaacgtttaggccttgccgtactgaaatgtattgctaaagtatcaatggtaagatggtcttgttggatcgtgattcttttactttccgagactgctgggtctttgaaagagggatctagattctttacaaaataatcttgtatttcctgttccaaacgatactttttaaagcaggttttcaagacgctgtaaagcatcgaagaacgggggaaaagagccaaggaacatactaattgacataaccaataaattcccaggggcggaataatcagaccgattaagagtttgaaaattttaacaatgatcgtaacaattttggtgagtatggggtgcttcttactaaagtcacttaactgcttggcgtgtgttgacgaaaaataggaaactggatgaggatttgaaaatattcctgacaaaatatcagacctgtttgaaagattcaaaagagtgaatgcgaaatccttacgtctctaatctcaagggactggggacgtcaggtcaaacaaagttcagtgttatcggcggctgtttttcgcgcttatattataacggtgtccttagaaagattaaatagttaagtgcctttaaatctgattcttaaggagcatcccttctttctaagagagctttttcaaaattggtgtggcaagagccactcttgttttgctgtcgatgggatcgatatcagacgataatcgtacttctataaattctttattttgaacatagggactattttttatcgcatgagcgagagtaagttcaggtgctaagagcttgttctgtctgactgttgatcttcgtaaggaatccgtaggatagagaaaaatttctaggcagggaaggtcttggcttctctctacggctttggtcccccagccaaaaagacgagctactagctttcctatgcgtctgcaactgtggaaaccttctggagatataaagagaggacacctatctttgactgctatccaagtagtatcatcgtttgcaacaatcttctggtctcgcaatgcttctgcttgtatcaaacctcctagggagtacccataggtaatgatttcttttgctccagggccctgttctttatctttaaggtatcttgtacaaatattatgagctgatgctaggtcctttaggctgctgctccctgtgctggacatgactccggggtagttataaacgagtatattggcccctatcaacttggcaaatctttgccaagaatcaaagatctccttacaagcgatttcttccaagctacagtcacttcctaaagaaatgagcatccaacgattcgtaggtgcttgtgaaaggcatatttccaaagtgtcgatgagaacattatcctggaggataggaactcgtctcatggaagcaacgcggtttttcgaggaataatcttgcaaagcacgcaaataattagtttttaaggttttagtgttgggttgcttcttgaaaatttttaataaattcttggaagggagaatcgagtttgtacaaagcgtttgacatagccagtagattcctaagggaaggatgatcagccctatcagaactttaaaaattttaataattacagaagcaatccgtgtaagcacgggatgcctgtctttaaactcatgaagtttttgggcgcgtgttgaagaaaaataagtcgcttgtggagaagggtgggaatgtaaaatatcctcaacaaacgcattacttccgtgaattggagccatgaacttttcctataaaatttaagttctttttacggaactacttggtttttgatttgttcgtatagagggggggggttcaggtagaatgttgccgatatggagtcgtctagagcaggcttcaatgtctgtccacaaaagtttgtggtcttttctttattgccatccaagaactgatctagctttacagttagtaagattttcaggaccgaattctaagagaataaattttaagcaataagggaataaaaaagaatcatatcttcactcggttctgactttgtaaagaagtttatcctcattcttgattacacgaatctaaccaactataaacaaatttttttgaggagaaaatttcttctactgttttggcctgaactcaagttgtttatctaaaagaacttaaaaaatacaacagctctttctttagaggatacagaaagtcgagttatagatagagattttactaacttaaggataaatattaaaatatttatttaatattccaagagtttttatttgatagtttctatttttaattttaatttattaattctttaaaataagatgagcgagctcgccccctgctcgacaggattgcagatggtcccccatacgcaggtccatcatgcccttgatacgcggagagtcattctaacgatagccgcctgtctgtctttaattgcaggaatcgtgttggttggcttaggtgctgcagcaatcctgccctcgctttttggagtcattggaggaatgattcttattctgttttcttcgatcgccctcatttatttatacaagaagacaagggaggtggatcagattgctctggagcctcttcctgagatgatttctaaagatcaaagcattatagattttgtaaagacacgagactatgcatctttagaaaagaaagcgacctttgcttatactcatactcattattacgatggaagcatggtcttctatagggagatccctagatttatgttaggctcttatctcgcgcttcgcaaagacatggaccgccaagctcttttttgaagaaggacatccatgttatgttgctcgccaggcttttaattcagggattcgactctatcgtcagttatttgacatagaatatttaacgaagctatacaaaaacaaggattacgatcctgagcatcgacaaagtttaaaaagcctaatagattggatgaaatgcgaagaccatggggaagactttttgcgtcaacatcggggctgtgactacccatcttctggctatacgggaatgtttttcaaacattcttaagtctttgtccgcatcctgaatcttgcatctagaatttctttttcataatctcatccttcatggtttagaagatttgttttggtgtgtcttagttcacgcaaaaaagtgggagagacttgtaagggagacttctttaactaaatgactatcgattgaaagaaggagttttgtatttagaaaagcgtattcttcttaaattttttactgatacatacatagaatgtatagaagtatcagaatcttcaaaagactcagagtgatcaacaacagtggatccatttatagaagtaaaacaagagctgtactaccatttagaatataggccttggttttgctcggggaaattccatgatatctttctttatgaatctaaagttttcctagagcgaagagagtcaaaaactcagtaagctatataaaatttgccgtgtaattaaagcatcagatactctgtctggtgggatcggcctgctttttacaactttagatagatagattttagagtcttgggttggaaaagcgatatctatacaaacatactagaggaaagaatgacggcgagagcagaatatttagaccatgaggattttttatataggagtcacaaacttcaggaactttctgagttgggtgtagtcctttatccttacgagtttcctggagttttttcatgcgaagatattaaaaaaacgtttgctagtcaagagttagggaatagtgaagctgctatgagtaggtccactcctagagtgcgttttgctgggcgtttggttcttttccgtgcgatggggaaaaatgcttttgggcaaattttagaccataatcaaaccatccaagtgatgttcaaccgtgagtttacctccgtacacggactttctgaagatgctgagattactccgattaagtttatagaaaaaaagttagatttaggagatatccttgggatcgatggctatttatttttcacccattccggagagcttaccgttcttgtagagactgtaaccctactttgtaaatccttactttcgttgcctgataagcacgcaggtttgagtgacaaagaagtccgctaccgcaagcgttggttagatctaatttcctcaagagaggttagcgatacctttgtgaaaagaagctatattattaagcttatccgtaattatatggatgctcatggatttttagaggtagagactcctatattacaaaatatctacgggggagcagaagctaagcctttcacaacaacaatggaagctttacattcggagatgtttttaagaatctccctggaaatcgctttgaagaaaatcctagtaggaggagctcctcgtatttatgaactcggtaaagtcttcagaaacgaaggaatcgatagaacacataatcctgaatttaccatgatagaagcgtatgctgcttacatggactataaagaggtcatggtctttgtagaaaatcttgttgagcatcttgtccgtgctgtaaatcacgacaatacctctctagtctattcttattggaaacatggcccccaagaggtagattttaaagctccttggattcgtatgacaatgaaagaaagtatcgcgacctatgcaggtattgatgttgacgttcacagtgatcagaagcttaaggaaatcttaaagaagaaaactacctttcctgagactgcatttgcgacagcttcccgggggatgttgatagcagccttatttgatgaacttgtctctgataatttaatagctcctcaccacattacagatcaccctgtagagacaaccccgttatgtaaaactctgcgttccggagataccgcatttgtagagcgcttcgaaagtttttgcttagggaaagagttgtgtaatgcctattcggaactcaatgatcctatccgtcaaagagaactcttggagcaacagcatactaaaaaagaactccttccggatagtgagtgtcatcctatcgatgaagagtttttagaagctctgtgtcagggaatgccccctgcaggaggatttggtataggtgtcgatagacttgttatgattcttacaaatgctgcatctatacgcgatgtgctgtatttccctgtaatgcggcgcttcgatgcagagaagacgaattaaaggggcttaactttaggccctgacttagagtcttcgacaaggaagcctgcggcaagtatctcatcacgtaaggtgtctgccatcgcccaatttttagtttttctagcttcctcacgttctgcaacaagttgcattacggtttctgggatgcacacgcttgtggttagaggaagcacaccaagtacagtatcgacttttttaagagtgtctaagatatagagagagtcggctttagaaaagtgcccttggtcgatcaaggtgttgatttcgtgaacaaaatcgaacagagatgcaaatcctgtagaaacatttaagtcattagcaagagctcttgagaaagcttctatgaattgactgctagagtccaaggttctgggaaggggagattccccagggagatctacgccttcaagtcgagaaacaaaatcttttaagcggcgtaaggcatgcctacaggcaaggagagcttcttctgtaaagttgagttgcgtacgataatggctttgcagtagcatatagcgtacttcttgaccagtaaattcctggtggagaaggtctcgtagagtgaggaaattccctaagctctttgacattttcttcccatcaataagcagatgttccgaatgcagccaatagcgtgcaaagggtttccctgaaagagcctcagattgggcgatttcattttcgtgatgaggaaatatattatctacacctcccgcatggatatccaaagaatctccaagaagttccatcgccataatcgaacattctaaatgccatccaggtcttcctattcccgaaaggactttcccaataaatgacgccatcacgttctggattgtatgctttccacagtacaaaatcacttgggttttctttgtcatactcatcagcagaaattctggagcagcagcgtaagctacttagatccagatgagagagcttcccataatttggaaaacggtttagagaaaaatatacggaagcatcctgacctatataggcgattccttgctctaagagctttgtaatcgcttggatcatttgagggatgtagtgtgttgcgtgtggatagaaatctgctctagcaatatttaaagtatcgagatcttcaaaaaaggcttcggtatatggctgcgtgtattcttgcagcggaatattttttttcgaggctcctgctatggttttgtcttctacatcagtaatattcatcacatgggttacagagtagccaaagaatactagagtgcgtttgagaatatcttcaaagacataagttcggaagttccctatgtgagcgtagtcatacacggtaggaccacaagtatatagtcttacaggggtgtgattggggaaaaaaagttcttttttttgagatgctgtattgtagaaatagagaccctcgatatgagaaaatgccataactgtatcactcttgactcaggagtttgttgttatatagacagagagaatttaacgtcagtctcttcggcctatcctaacaaaataaattttctagatctatgatttttgctttcgaaaatcttataggagaaaagatagcaaatttccttcttttcaaaagaaataaaaaatcgcataaatattcttagaatttcatatttattcatgcaatagaagctaaactttttttagtagcgaagttcaacgtttttaagtagtgttttttatttcgttttaataaaaaaaagactatacaacaagagtcgctagaaagatgttctcgaggcatatctggcccgccctgaatagaataaattgcgtcctaatcttaggaaaggaggaggtagcccgtgatcctgttacaaaatatcaaaagatgttccttaaaacagttgaaggtcttggctactcttttgttgagcttgagcttacctacgctagaagcagccgagaacagagattctgattctattgtttggcacctggattatcaggaggctttgcaaaagagcaaggaagcagagcttcctttgcttgttattttttctggttccgattggaatggcccttgtatgaaaatccgtaaagaggtgttggaatcacctgaattcatcaaaagagttcaggggaagtttgtctgtgtggaagtggagtatctgaaacatagaccgcagttgaaaacattcgtcagcaaaatcttgctttgaaatctaaatttaaaattaatgaactgccctgcatgattttgctctcacatgaggagagagaaatctacagaataggttcttttggtaatgagacgggttccaatttaggggacagtctttgtcatatcgtagagagtgattctttactaagaagggcgtttcctatgatgacgtcgctatctttatcggaactgcaaaggtattaccgacttgctgaagagctctctcataaagaattcctcaagcatgctcttgagcttggggtgcgcagtgacgattacttctttttatctgagaagtttcggttattggtagaagtgggcaaaatggattctgaggagtgtcagagaattaaaaaacgccttctcaacaaagatcctaaaaatgaaaagcaaacccattttaccgtagccctgatagagtttcaagaactggcaaaaagatctcgagctggtgtgcgccaagatgccagccaagtcatcgctcctctagagagttatatttctcaatttgggcagcaagataaggataacttgtggcgtgtagaaatgatgatagcgcagttttacttagattctgatcaatggcatcatgctttgcaacatgcagaggttgcctttgaagctgctcctaacgaggtgcggtcacacatttctcgctctttggagtacattcgccaccagtcgtagctttcgtttttccaagacgatgtaacccctctgggatttgatttataaaatcctggagaagttttgaaaagacagggcgctgtttatgtcccttggggaaaacaacaatttgacaattgggaagttggtggcggacatgccgaaatacttcacgaacgacacgtttaaaagagtntctttcgtgagctttgccaaattttttagatacagtaatacccatcctacaagtcccgggatgcctagaagggaccacgtagaaagtcgcctgactaccacgacaacaaaaacctgaacgcgtaatgtaaagaaattgctttcttttcaaaacgcgggattgttttggtaaggtgagtgggtgcacgaaatactaaattataaatcgactagggaatgcctaccgtggcggcggcgacgattcaaaagttttcttccatttcttgtggccatacgagtacggaaacccacagaatttcggcgtttccttttgctaggttgataagtccgtttcacagtgtcttcctataattccttgcctcattcacggttgagtcttactaaagaggctttgcccgaaattttagaagattatatcaataaagatcaataagaagacatcggctttcttccaacttatctaagaaaattcgagagatgacagtctggtattgtcaaaaaagctcctaggagattaaattggttccttgttgtaacttagtatgcttctcctttttatgagaagtgaaggtaatatctcatgaaagttagttcatctgttaaggctgatccatctaagggggacaaattagtccgccgtaaaggacgtctttatgtaattaataagaaagatccaaatcgaaagcagcgccaagcaggacctgcacgtaaaaaataatttaaaaatttaggtaaaacgcatggcgaaaaaatcatcagtagcaagagaagctaagcgtcgacgattggtagaggctaattttaaaaaacgatccgaccttcgtaaaatcgtgaaaagcttgtctgttagcgaagaagaaaaagaaaatgcccgtatctctttaaataaaatgaagagagatacttctcctacacgtttgcataatcgatgcttattgacaggccgtcctagaggctacttaagaaagtttgctatctctagaatctgttttagacaaatggcttctatgggagaaatccccggcgttattaaggctagttggtagtctattctgattagagccccaaccctatttaaggacgtggggctttattttgatgcttctttcaaagcctgttgtagtgatggaacatccttcactcgttgccaatctttcattccctttttccatacccaaatttcttctggatacgtttttccctttaaaagtacgaccaactcctcaaaagatatcggacctacgttttctctatctttatttaaataaaaccacttctctgtatcgataacgatttcttgaagatctcccgatgagggtatctcgtcattacctgctaaactttttttcaaatcatcaaaaagatcggagttatcaaaaggatcgttttgtggcttttctaaagcgtttcgacgagaaggaagaagaagaaggacaactagaccaataaatccaaaaaatgctcctgcaaaaaaccagccaataacatttcgttttttcttatctgctatgtaggcagatagacaacctagaatcacataaaataataaaatcgaaatagggagcatagtgcgtagcgtacctgaaagattaatagtctgtcactaacgcctattatttccatgtgttgtatttctcgctagagaaatagggcacgtttcataaggaaacgtagaaaatacaagtcttaaattaaaaatatcagttcaagaagaacaatttcagaacttttctgatgccatatagtagtgaaaaagagaaggtagatctatagacgttaaagtggataaaaaaactcataggcaagagtgcgactttttttctttactagcagagcggtaggggaacctagaagttggatctaatggatgtagcatattaaccgctggacgattagactgtcgctaacacttattatttccaccgtgttatatttctttagtgaagaaatagagctcattggaggaggaaaaatggaaaaacaaaatttaaaattagatgtcaaagagattgagtttcctgaaacggtattcagccgtgatatcgaaactcgtgttatccaagtaattattttgcattgtttagcaaaaattaacggtgtttccctcctcggaggaaatctaatagacgctctgttcggtagagatatcgaaagaatgaaggggatctatgtagaacaggattcaaaaaatcatctggtcaaagttcgtgtcgaagtgaacgtagattacggtgtttctataccagagaaaacagaagaaatccagggatgcattgtttcagaaatttcagaatatacaggacttcatgtggccgctgtccacgtgatcattaaagggttgacacaaccaaaagatcgtattgatgaagaaattgaagaggaagtctctgttcaagatcttccttcacctgaagacttcttacttgagaattctgaagggtagacttaatcagatttgttgaagtctttttgccttgcaagaagcactgcaatatctttcttagttagcccaggaatagcttccagctcttcctgggagctaagcattacctgtttccaacttttaaatttctgcaacaatcgttttcgctttacctctccgattccagggattttttcctgttcaaataaagcctttcctctttttttcctgtgcttactaatcgcaaagcgatgtgcctcatcacgaaggatctgaaaaaattgtaataaattagaagtcgggggaagagaaaaaccctctgggaacgtctcgcagaaaatcttctccttatttaaccctcgactatgattacttttttcttttgcgatagtaacaacctgaattcctgtaagattgagagtttggattattttttttgtcttgttatagtgcgttttccccccatcaaccacaatcatatcaggaagagctgtggtcagtgaatgaaaccttcgtaagagcacttcttctaatagagccaagtcattctgagtcttttcagaatctatggaaaacgtacgatattgcttgggatcgaacccattattttcaaatacaatgtacactccagtagcgtgagcaccttgcatatgagcattatcgtagcattctatccgatacggatattgtgacatccgcagtattattcttaaagtcttggtaggggagcttgatgaaggaagtgtagttgctgcatacgccttggcattgcgataggctagatcaagaagttcttttccatatcctgtttttggagaacgtaggcggggaggagactccgcattcaatacgtaggagagagtaggaaattctaggggaagaggtgtcagaatttctttaggaatgtagggttggctaacataatattgcaaaataaaagaggagagcaagtcttgatcttcttgagcattctcaaagaaagagaaatggcgtgccccaagaagcttccctgagcggacagtaagtagcgtgaggatggtgcgttgtttatgtctgtaaagaccaagagcatcaatattttgaaaatgaaatttttccacctgttgctttgccatagcttgcttaattagggacaacgtgcggtagtaattcgcagcttgctcaaattctaagttatcggaagccttttgaatcactttttctaagtccttgaccacttcttcgatctttcctttaagaaagaggatcgccttgtctaaggttccttgatattcttcaggagtgcaatagccgacacaaggagcaagacagcgcttcatgtcataaagaatgcaagggcgtttccttaaggcaaactctcgatctgaacaagtcctcagaggaaaccattggctgataacctctaagagagtgtggcaggcttcagcacttacataagggccaaaaatcaattgtcgttgtgaagaggttatcgccttcgtgcggatagcttccactttgggccacgaatgtgacagggaaatcgcaaggcagaaaaaggttttatcatctttgagcaacacattgtatttaggatggtgctgctttatcaaattgttttctaaaaggagggcctcagtttcattcgacacaacaatagtttcaatagacgcggtctttttcatgagaaaagggatgcgttctcgagagtcccctttctcatgaaaataggatgctaagcgatttttgagatttttagccttgccaatgtagaggacttgatcatggacatccttcatcaggtagactccaggagaggaaggaatgagtttgagagaaaaatcctcaatgcgcataactagaataatgtcagttgttgcatcttatcttgagcagggcgtgtaatggattccgggccttctaattgtcttaggatctgctgagctctcgataccacacaaaggggaaagccagcaagcctggcgacatgaatgccgaaacttttttgtgaatgtccttgagaatctcatataagaaaacaggctgccctgctttatctttaactccggcatgaaaattttcaacgtgcggacaatggtcttctaaagtcgtcaattctttataatgagttgcaaaaagcgtcttagctttctttttgtcagtgaaaaggaggtactctacaacagcttgagcaatggcaaggccatcataagtactggttcctcttcctacctcatctaggatcactaaagagcggtccgtggcattgtgaaggatattcgcagtttcggccatttctaccataaaagtagacattccttttgagaggttgtctccagcgcctatcctggtaaaaattttatcaatcactccgatgtgagctgattttgcagggatatacgaccccatttgagccataatcacaagaagagctatctgacggatataggtagattttcctgccatattaggcccagtaagtaagatcattcgagtttgagagccacgcatttcagtgtcattgggaataaatttccctgtgtctacaagagtttttgctacaggatgacaaccacgataaatacataaggtgtcactcatatctacacgaggacgacaatagccctgagcatgtgcaagatccgcaagagaaatgatgtagtctagatcagcaagactttgagatagagccaaaatctcagtgcgtaactgtaggatgtgtgagcaaagatccttgaagaattgcgtttctaaagtttgaagtttttcagagatattagacatatcatcttggaattgctgcagctcaatagtagtaaacctttctgcatgcaatcgtgattgccgacggatgaaatctttaggaagttgaggagcaaactcgctgctcacttcaatataatatcctaaagcctgagcaaagcagattttgagttttttgatccctgtttctttacgaatgcgttcttggtattcccaaatccattcttgagaatgctcttgattgtggcgtaagcgctttaaatcattgtggaactcatccacaaaaatatttccatcagaaactcggagagggaggtcgccgttcaaggactttgaaagcagtgcaattaaggaggctagctttgtatctaacgagcatttatctataaagaattctggaagagtcgcagaagccagttgttcgtagatttgagctcctgcagaaaaagaatctctgagtgtcccgatatctctaggccctgccaatcctgtggtcactttggtcatcagtcgttcgatatcacgtacttgacaaaggtacgttttgatattttttcttaaagtcacttgccgaagaaaaattctacagcatcttgacgtacaaggatctccttagggttatagaaaggactgatcaaaatttgacgtaaaagtcttccccccataggtgtgcttgtatgatccatgatacgtaagagagaatttttcccctgaggatcattcaagggagcgaggagctcaaggttcacttgagatgccgtatctattaataacttttgctgttttccacgcgtttggggaatcgcaatatgtttcgtaggtaataaaagtttatcttggatataagagagaaggcctccagcagcgttgatcgctgggacgagccctttcaggccaaatccatctagggaggccacttgaaaatgcgttgtaagtttttgagaggcgaacttatgttcaaaggcccagtccgcatacgtagataaggtcagcttgaggtgttgttgcaactgcatgacaatagcagtttctttattataaaatttgttacacgagagcacttcagaaggagcaagacgacagatctcgtcaacaagctctttggtattctcacattcttcaataaagaaagatcccgtagaaagatctaaacaagcaaaaccaaacagagacccgatacgagtgatagcaacaatatnattattgaatttttcctggagcagggtggaggatagcaaagtgccaggagtgacaaatctctgaatatcccgggccatgggaccgatttttttactctctttttcttttgcaggctcgccaaattgttctgcaacagcaactttgaatcccttgccgatgaggcgatccacataggtatcaacagtagatacaggaatcccactcataggaattccctgtcgttgtgttaaagtaagttccaaatgttgggataaaagaaccgcatcgtcataaaaagcttcgtaaaagtctcccatccgaaataaaagcacagaatctccagctttttctttacactgatgccattgttccatcatcggggtaggttttttttccgtcataacttattcgcaatgtacgttattgttttcatatccattaggattcaaatgtattgagctaattgattactgctttattaccgtggcttttgctaacggttgctttgactatacaagaaagtagagttttcgaacgagcctctaaaattcctgagagacagcctcagttgtaaatctagagtgggagttaagaatgctgcattacgagccggtccccttgagaaaagataaacaggatgggatattaattccaaggcaattctcggtagtaaatccttccctgggatgctgtaaatagaaaatttctttttataagaattccctaatataaaagaaattcatccagaaagaaaagctgcattagacaaaatacagaggtaaattaataattggggagagtctctttattttatagagcctcagtctttttaaactaagaaatctgtaagttaaaattgcagcataaccaagttgcgtaccgctatgtatacggaagagagcttagataacctgagacacagtatagatattgtggatgtcctttcggaacacatccatttgaagcgctccggtgcaacatacaaggcatgttgtccttttcatacagagaaaacaccttcgttcatagtcaatcctgcgggtgcacactaccactgctttggatgtggtgcacatggagatgccattggcttcctcatgcagcacttgggatactcttttactgaagccattttggtattatctaaaaaatttcaagtagacctagttctccaacccaaggattccggatacacccctcctcaaggactgaaagaagaattacgtcacatcaacagtgaagctgaaacttttttccgttattgcttgtatcaccttccagaagcgagacacgctttgcagtatttataccatcggggattttctccagatacaatcgatcgattccatttgggttatggaccagaacaatctctttttctacaagccatggaagaaaggaaaatctcacaagaacaactgcatactgcagggttttttgggaataaatggtttttgtttgcacgaagaatctctttcctgtccacgatgcgctaggacataccattggattttccgctaggaaatttttagaaaactcccaagggggtaagtatgtcaacactccagaaactcctatattcaaaaagtccaggatcctctttgggttaaatttttcacgtaggagaatagccaaagaaaanaaagtcatcctagtggaaggacaggccgattgcctgcaaatgatagattcaggatttaattgtacagtggcagctcaaggtacagcatttacagaagaacatgtgaaagagttaagtaaattaggagttttaaaagtcttcctactcttcgacagtgatgaagcaggaaataaagcagcattacgtgttggggatctttgtcaaactgctcagatgtccgtatttgtctgtaagctaccacaaggccatgatcccgattcttttcttatgcaacgaggaagctcaggactcattgctttattagagcaaagccaagactatcttacgtttttgatcagtgaaaaaatgagttcttacccgaagtttggccctagagaaaaggctcttctagttgaagaagcgattcgtcagatcaagcattgggggagtcctattcttgtatatgagcatttaaaacaactagcctccttaatgatggttccagaagacatggtattgtctttagcaaaccctcaggtaacagccgaaccacaaaatattcccataaaacaaaaagttcccaagatacatcctcatattgtgatggaaacagatatcttgcgttgtatgcttttttgtggatccaatactaaaattctctacacagcgcaattctactttgtcccggaggatttcaaacatcccgaatgtaggaaattgtttgcgtttatgatttcctattacgaaaaatatcggaaaaatgttccctttgatgaagcctgtcaggtactttctgattctcagattcttcaactgttaaccaagcggcgcctaaacacagaagctctcgatactatcttcgtacaatctcttcaaaaaatggcagataggagatggcgagagcaatgcaaacctctctctcttaaccaaaatattcaggataaaaagcttgagattttggaagactatgttcaattgcgtaaagatagaacaataatcacacttctagatccagaaagtgagctcattccttaacccagctcttcttttgtaaagaattcttgtttttctaaatcccccggatttcttagatgtttcctaatttccttggaggaggaacctgcaatgatgtgcctttcaataaaccggaaagcggcgtaattcctattaaaagcaacttacttataatttattgaaattttaataaatataatataaaatgttgtttcgtttttatttttattattagttttttatgaaatcttttaagtttttgttgccatttttaagtgttattctttgctgtggaaacctactctcttctccacgctccagagcaatttcagtgaccgaatccattggaatgtcggcagtgaagactcttgttctatctgagaaggctcatgaattcttagagggaatcggatatggagttggagcatctagtattctccgcgactggcaaacacaacagtggttagaaatagaatccttattagcacaaaatgaggtgatgtaaatttgagatattttcacttacaaagtatctttgcctatttatatcggcgacctgttctctatagcttagcaagtatgattttctctactgtagtctctaaaattcatagcttgaccgcgatctagctttccaactctcatatccttatctatctccaaaaaatagattttataaaattataagtttaattctatctgtttgcaatttgataaaattgattatctgtgataacttactttaactttaaataaagatttttaaataaaaattatgatgcaccgttattttattcctttattagcacttctcattttctctccttctttagtcagggcagagctacaaccaagtgaaaacagaaaaggggggtggcctacacaactttcctgtgcagaaggttcgcaactcttctgtaaattcgaagctgcctataataatgcaattgaggaagggaaacctgggattttagtctttttctctgagcgacccacaccagaatttgccgacttaacgaatggttcattttctctctctacgccaatcgccaagggctttaatgtcgttgtgttatgccccgggcttatcagtcccttagactttttccaccaaaatgggatcctgtgattctctatatgggaagttttctagagatgttccctgaagtggaggcagttagtggccctcgcttatgttatatcttaatagatgaacagggtggggctcaatgtcaggctgtcctgcctttagaaacaaagaattagagtatatttaaaaacaaaattttgccatcctacttcggacataattttgatcaattaaggaggcattacatgcgtatcgcactatctctactttcattattaatgatattccctatcttcggagaggaaagtcgccctggttcagaagacggcaacagtaatacgcaggagatagtcggatctcaggatacacaggtatgtctttatcattcctatgaacagggcttgcaagcatcccgaatcgaaggaaagcccctggttattgtagtactttgcaattctggtgatgatggccaggcatgcaccatagggttaagtgaaacatgtgaggaggtcctttctgtactttcaggatctattttttccgagttagctaacttcgtcgtacttgtcccttcaggagtgaacccactcatttatcctccaattgaagatccgattctcgcagagattgtaaagtttaaggagttgttcaaagatgagtctttccctacaggattaagtattattgttgttggtgtcactccagaaggacctggtgatatcatagaagtcagtccggtttcgttaaccgtagaggaagaagagacgctaccaagtgaacaaactacagaagtagagagcacgtctgaacttcaatcagaagatccagctatagcataaccaagatcttcccttaataaaagaaagcgctcgtaggattcctcccacgagcgctttctttatctaaatgttatgaaattatacagctacagattcccaatgacacaaggaaaacttatccatagcagtaagtaatagcgaaatccgtaagttgcggattgcaccatcatcattagcaatatgcacagtattcagaaaatcctgaatatcattggaaagatcagcaagggataagaaatattctaaaaaggcatgtgctgaagtttccttaggaaatccagggaaagcatcaagaacttgcttaaaattagattcacgatccccaagaacttcaataggggacgaagtcatggagagttttaaagaggaaagaatcttctttaaacgattgtgagtggtcgtaatcactgctaatttttctgtatgctcttcctttaatagctgaagggcttcagcagtatctaaaatctcaataggattttncgttgcagaatctataagaacagcagcaatctcatccttacgaaactctagggatcccataaatgtttttaaccgaccccaaatgaattcaaggatttcgtgtatagtcttggacttatcccagaccttttcttcaatggtgctaggaaaatggtccgctagacgatctaaaagagaagcaagatctatagggagccgagaggcggatactagtgttaacacttctaaggattgacgacgtagtgcataaggatcatgcgatgacgtaggcttaagtcctaaaataaagcaagcaagcaagttatccaaacgatctaaaagagaaagaagagttcctatggttgagagcttttgacccatagtaatgtgtcgtaggtgctctcctacagcaaccgcagacgctgtgggaagattcgcatgcttcagataatactctcccatgatcccctgaagttcagggaattcattgacgacagccgacactaagtcagctttgcagtattggatggcaatgtctaggtcctcggaagccgctaaagaggaaaaagtagagaacactctttggtgtgcttttaaacgctctaccttgtcatataaagaacccaaagcttcaaagtatgtcacagacttgagcttttcaataaaggttgttaaaggagtctgtaagtcttgtttgaaaagaaattctccgtcagtgagacgaggagtgagtgccttttcatttccttcaatgattgtatcattcggagaattatcacaaactacaataaaaaagttagaaatagctccagaagaggtttcgtgggtagggaaatacttctggtgatttaccatctcagctataagtaactctttcggtaaagcacaaaattgctcggaaaattgcccacaagagacaaaagggtgctccgacaggaaggtagcttcttcaattaaacggggaagaggaatcgcagaaattgtatcagaactatgagctcgtagcccttgttctataatcatgcgacgctctttttgtgaaactacaacacacgcttgccttaaggtttctacataatcttgaggagaggaaatcgaaatttttctcggatctaattgacgatgaccaaaagaatttcttgaagctattatagtaccgagagtgattggtaagatgtgttctccataaagagcaactagccaacgtatagggcgggcatactcgactccgctgttatcccaaaccatctttttagggaatttcatcctctgaattaataaaggaagttcctgcattaagatatcagcagttcgtaaccttatctcaggatgtaataggaataaatattcagaaccgttgactgtacggatagctaaggaagcgtgacgggaaagatcttgataatgagaaatatccacaccctgagaagcaaaaaactgctggccttgaggagacacatctccatcaggagaaaataaagacgtcagcataggaccttttttctcaaaagccttctgcacgacctcaggagctacgtttttaacaagcaaagccaaccgtcgtggagagccaaggacctctaacccctcataaacaatattatgatcagtaagaacctggcgagctaacgattctagttgttgtattccaataggaacaaaagtcgcaggaagttcctcagaaccaatttctagtaagagatcctctgtagatgaaatcataggaactacagattctgatgtttccttaggctcagatgttgaagaaagactaagtaaaggataatttaaagaagcacgccactctacatagctatccgcaactaaacgagttaattgacggatacgagcaatataacgtgtacgctcagtaacagaaatcgttccccgagcatcaaggatattaaaagcatgcgacgctttgatcacgaagtcataagcaggaacagaaagaccatttttaagagttcttaaagcttcctcagcgaaatcttcgaaatgcttaaaccacatctcggtgtttgcatagtcaaaattatattcactccaagctttttcagaagcttgtgtaatttgtccatacgttaaagtgtcattccataagacatcataaatagaggttttcttttgcaaatacatcgcaattctttcaatgccataggtgatctccccactgatagtatccaaaggtttactcccaatggcttggaaataggtcaactgggtaatttccatcccattgagccacacttcccaacctaagccccaagctccaatggtagggttttcccaatcgtcatgaataaaacggatatcgtgatcacgaaggtctaaaccaatggcccgtagcgattccgtatagagtgagagaaaattttcaggcacgggctttaaaatgacctggagttgatgatagttttgtagccggttcggatgcacgccataccgaccatcttgcggacgccttgaaggttctacataagcagccttatagggctcaggtcctaaggctcgtaagaacgttgcaggattgaatgttccagcaccaacttctaaatcgtatccttgatggatgacgcacccttgctcgctccaaaatcgtaagatagtcgcaatcatagactgtaaggtgaggggatgttctgacacaaatgactccaaggtataacattttttcttttgacattctccttagctaaagcgggagattcttgtttcattgaaggtagcatagattttaaagctacagtcacaccttctccacaagcgtagatttccgtgtgtctcacggtacgtgttaggatgagtatataccttttgaaaaatactgcagtacagaaaaccaaaagaaaataacgacatagatttaacaagatcagagaacaagtttttaaaacatcatttccattctaattaaattatatgaagattttttaccttttgacctaaaaactctcttgagtaatcttaagaacaatcctgtgagcagatgtttggattataacactcaattttgagttattttcatagtgcttgacaatattttcaataatttagaaaaattagaaaattttctatttagcttagagcaagagggttctcgatatacaaaaatggatcatgcgagcaattgattttaaggaaaacacgacttccttttaaattcaaagttatcctcgatcttgtgaataaaataactatagggtttccttaagtaagctagaacaaaaaatacgcagactgtgatttcagtgctttcctcttagtaaggcactcatctcatggacagacaagaaccatatattaggggagtagggtggggctacctaattacatcactttttccagactctttattacaccgattttcatgatcctgtatttaaaaggaaaatggtttggaatcactccagtagtgttgccttacgtgctgttagctctcctggcaatctctgagttaacagacgctatcgatggttatgtcgcaagaaaattttcacaggttaccgatttaggaaaactcctggatcctatggcagatagtatctacagaatttctatctacctaacttttacacagcctccagtcaatttacctttgcttctggtattcatcttcctagcacgggattctgtaattagtactttgcgtactgtatgtgctttccgtgggcgtgttgtcgctgcaagggctagtgggaaactaaaagctatactacaaggagtcagcttcttcttaattcttttggttatgattcctcactccctaggacttctttctcagaatggattggaaatctttgcctcagttacggtttcaatcatagctgtgtattctatagcctcaggaatcgaatacttctggatgaacaaaaactttttatcccaaagagctaaaacaaaagattcagaaaagaatcatgagagtaaagattgataaagatttacgtaatgcttagccatggcatctaagccagaggcccgaagcattcccgactcaatcaaattcaaccaaacgtcaggctcctgacgatacgtcgttacagcgttgctaagcatagcccgaaattcattaaaattgtttgtatcaaagaaagtgaaaccatttaccccaggaatcactgtatcagcaagccctccagttttacgaactaaaggaactgtgccataacgcatcgctatcagctgggtaagtccacaagcctccctatgtgaagggatgcagatcatatcggcagcagcataagttagcctggctaaaggatcattaaagtccaagatcaaacgaatgttgggggagctcgctaaacaatcttgtaagttacggaactcattaagaagaacctcattttgacttgtcccaatcaagataaaggcataactgtgctccatagcatggagaataatctctttcataaattcaggacccttttcctcaacaatgcgtgagatcacacaaatcaaaggaaaatagtctgaactgatccccaacttctcatataataccgctctgttctcttcttttttagtaaagagaacgtcaggttcgcttaataggcttgcatcgtactgtacagctaaagcaggatctgtcttcgggttccaaacgtcttcatcaatgccattgatgatcccagaaaatacagaatttcttgctagaatcgcatcatgaagttcgtaatcagaatagtcgtttataatttcctgcacataagtaagagacactgtcgtaatgtaatccgaacaatagagagctcccttcattagaacagaagtttgcggatcgcgaaatagttggtagtgactcaaatgaaaatcatcaatttgcgacgctgctaatagctgcgtactacaataccctcgataaccaaaattatggatagtaaagacaatcttcgaatgcacagggtttaaagggttttttaataaacccgcaagtaaacctacatgccagtcatgcaagtgcacaatgtcagcaggatccgcttcttgaagataagctgcagctgcagctgcaaaagcagagaaacgtacaacattattctcagagtacacggacgtggttgagaaaagctctatttgtgaatccaacgtaattatagtaagcgtaagaccctcgtaagaataagaaattgcagaggcttgctgcttgcctaaaaattcataatagaaagaacgctcggaaagaacttgagacgaagagaatttggaaattaaaggataatgagggagaagtacttccacatcattttgtttcgctaactccttagatagactagctacagcatcgcctagaccgcctactttaacgattggagtgaattctacagcgacttgtacgattctcatagactctccctaaagctataaaatatcccatatcaagggcgaaggtaaaatctcaagaccaaaaaagagagttttttatcattttcctattttcaaaaactgaagattcgttaaaataatgcctttctgttggggtgtggccaagcggtaaggcagcggtttttggtaccgtgcatcggaggttcgaatccttccaccccagagtccttttcttctccttttggtaactgtattctttagttgtctcttcttacaagaaggatatacgttcaattctttaattagggaaagtattgactttttccaaactggagatataattttgcctcgaaaactgtcgatagacgtccaagacatgacagtgattggccctctaagaaaatatgtttggactctcagagtgaatgcatagcgcacagctcttttagctcaagattacggagaaaacaacattatggagcttgtagttacaagtcgagagactggtaagaaatcttttcttaagaaaattcgtcagcaaggtggaatccctgctgtagtatattctgcaggcaagagccttgcgaatatcactgtggatgcacttgtgtttaaaaagtttttatcgaatttagaaagcggagccctatcttctacggtcttttctttgtcttatgaagggcgtataattaaagctctagttaaagatatccaatatcaaatcaccacctacgatgtaattcacctcgattttgaagaactcgtagaagatcgtcctgtaaagttaaatattcctatccgttgtatcaatgctgtagactgtattggagtgaaactcggtggatctttacgacaagtgattcgtgccgttcgcgtagtatgcaaacctaaagatattgtaccttttctagaacttgatgtgcggtctgttggactttctcaaacgagaaaactatccgatataaagatccctgctggaatagaaacaattacacctttgaaagaagtcgctataaccgtctctagaagataatatggctaagctcattgtagcgatagggaaccctaggcatgggtatgcaaatactagacataacgcagggttcctattggctgataggttagtggaggagctccaaggccccccatttaaaccgttatcaaaatgccatgctttaatgactctcgtagagtcttcttcagggcctttggtttttattaaaccaacaacttttgtcaatttaagcggtaaagccgtggttttggctaaaaaatattttaatgttgctctgagtcacattctagttctcgctgatgatgtgaaccgttcgtttggtaaacttcgcctttgttttaacggaggaagtgggggacacaatggtcttaagagcattactgccagcttgggttccaatgaatattggcaattacggttcggtgtaggaagacccctcgaagaggtgttgagctatctaatttcgttttaggaaagttttctgaagaagaaaatcttcagttgggatccatatttgttgaggcatctactctatttaccgagtggtgttcgaaattttaaatggcttgagaagtttctgaaataattttagtggactgagatatcttaaggataataaactactctatctgtctgtgtttaggagtttttaatgggaaaaaaagaaaatcaactttacgaaggcgcctatgtgtttagcgtcactcttagtgaagaagctaggcgcaaagctttggataaggttatttcaggcataactaattacggcggtgaaattcataaaattcacgatcaaggacgtaaaaaactagcgtataccattcgtggagctagagaaggttactactattttatttatttttctgtctctcctggagccattacagagctttggaaagagtatcacttaaatgaagatctacttcgtttcatgactcttagagcagattctgtaaaagaagttttagaattcgcctctctacccgaataatttgttaaggagaaaatatgaataagcctgttcataataatgaacacagaaggaagcgttttaataaaaaatgcccttttgtttccgcaggttggaaaacaatagattataaggatgttgaaaccttaaaaaaattcattaccgaaagaggtaaagtattacctagaagaattacaggtgtttcttcccgtttccaaggcgtgctatcccaagcaatcaaaagagctcgccatttagggttgttgccttttgttggagaagattaatttaaaggaagaagaatgaaacaacagctacttttacttgaagatgttgatggattaggacgtagtggtgatttaattaccgctcgccctggatatgtccgtaactatcttatccctaagaaaaaagcagtgattgctggtgcaggaactctgcgtttacaagctaaacttaaggagcaacgcttaatacaagcagctgctgataaagcagattccgaaaggattgctcaggctctcaaagatatcgttttggaattccaagtacgtgttgaccctgataacaatatgtacggatctgtaaccattgcagatattattgcagaagctgctaaaaagaatattttcttggttcgtaaaaactttcctcatgcccactacgctattaagaatttgggcaagaaaaacattcctttaaagctaaaagaagaagtaaccgcaaccttattggtcgaagttacctctgacaatgaatacgtcactgttttggctcaaggaaaacaaactgaggaaaatcaagaaggctaatacgtagggtagaaaagtttgttataaggatatcatgcaatacttttctcccgcaaagttaaacctttttttaaaaatatggggaaagcgtttcgataattttcacgagctcacaaccctttatcaagctatagattttggagacacactttctttaaagaatagcatgaaggatagtttgagcagtaatgttaacgaattgctttccccctcgaatctcatctggaaaagcctcgaaattttcagaagagaaacacaaattcaccaaccagtttcttggcacctcaataaatctattcccctccagtctggcttaggaggaggcagtagtaatgcagccacagccctctacgctcttaacgagcatttccaaacccatattcctataacaacattgcaactttgggctcgagaaatcggaagcgatgttccttttttttttcttcaggaacagcattagggaaaggtcggggagaacacctcttctctataaaaaaactcaaccataaacataaatatgttctctatctcgatcatcaaggaatacccacagaaaaggcataccaatccttacttccacaagactatagtacaggaaatcataacgcctgtttctatggtgaaaatgatctagaaaaatccgtatttcgtatacggacagacttgaaaaataaaaaacacatgttagagaggatgtggagtcctttcgaaagccatgtgcttatgtcaggttcaggagctaccctattcgtttgttatctagaagagttagaacaagattcaaaagtatcctcccaaatccatagcctaatcaaacaaacccaaggaattcccgttagccgtctttatagggaaccgcattggtattctctaaagcaatctacttacaaaaacagcccgctagagtgttttcagccacagatatgattttatttgcctctacagaaagtgagttttctgcttggcaaaatccatgaacattacctaaactcgccttttccttcagcacagagaatataagagtagaagcttcggaaattttcgttacttttttagcagtcgtttcatctgctttaggaagtgtaatcttgtaagacataaataaaccctcacattctcttcctacttaaaggatttttttattttaaacaatttcttttataaatgtgttttagcttcttaatgtgaaatttctatttctctacgagaagaaaaccagagatcttcctaaattttttgaccctttctttttactgtgaatacctttatgtctacgcataagtattaacttagctcgtctggttctctatgatcctgcctccatactcttattctttgaaaataggcgccgcagtgctctttttttgttccatactgcacacatttctgactccctggctctacactctatgtcagtcttacgaacataaaaaacttgttttcccagaatgctggaaacgctatgcccggttgtcagaactcttcagaatcctaagtagagtagaaattgtatttttcttgtgggcagtacccttgttcttctggtttctatataccgaaggatacaggatttccatggcctattttaatagtagaaattatggattcgctgtcttcattatggtgatcctcattttactagagtcccgccctatagtatatttcgcagaacttgtgctctcctcaattgcaaaattaggaaaaacctctcccaaatcctggtggtggacattgatgatcgcaccaccacttctctcctgtctccttaaagaaacaggagctatgattatcggtgcgactctacttatgagacatttttatgtttttactccgtcaagacgcttcgcatacgctactattggacttctgttttctaatatttccataggaggactcacaagctatgtatcctcaagagctctcttccttatctttcctgcactaaaatgggaacactcgttttttctttcccacttcgcatggaaagctatcgtcgctatcctaatctctacaacaatctattattttatctttcgaaaagaatttaaaaagttcccagatatccctagtgacaaagatcctagcgttgaaaaagtgccctggtggatcatctgtgttaatattatttttgtcggttctataatattatcacgatccacacccttgttcatgggagctctactactcttttacttagggtttcagaagttcactatcttttatcaagatccaatcaacctttccaaggtatgctacgtaggacttttttatgccggattggtagtcttcggagatcttcaagaatggtgggtgctgaatctaatgcaaggtctgtcagatttcggatacatgacagtttcctatacgctgtccatattcttagataatgcacttgtgaactatctagtacataacctctccgtagctacagattgctaccactatcttgtagtcgcaggctgcatggcagcagggggacttaccctagtctccaatatcccaaatatcgtgggatacctcatcttaaggtccgcatttccctcatcgacaatccatatgggatggttgtttctcggagctttaggcccctccataatttccttgggagtcttctggttattgaaaaatgttccagaattcctctactgttttttcaggtaaactaaagataaaacaaaggcataagatatgatcttatgcctttgtttttaagaggtcttctgagtgccacgtatatagacgctagtttgcgtccctagttcattgctaaggaaacactgacagtattttaagaactcttcgtatgttaacgtttccgcaatagcaatcttcaagtcgggagtcgaaaactccacaaaaggccgctcaaatgctagagaaaataacgccgagttcatcatgtctaaggaatgctcaggctccaagattttattgatatacgctttgcgtatgtttgcgaatttctcttgcgatattccaaatttctcaggagaagctgagaccttgttaaggaacagagaagttttagcaagaagctcttcaggagaatacgcatccgaacggatatagagaaatccaaacggcctggaagcaaactctcgatagcgcgcacccaccatataacccaattgctgttgcgttctaagctcctcaaaagtaatgtgatgcaaccattcaaagagcatctccgcacaaaccttcccttgtatagacggggaactcttatcttgaagtaataagagcatcccgtttgcagttaacggatagtcatgatggatctcagaaatttcctgagactgtagctcgtaataaaagggctttgtagcatgcgaagatcgtgacgcagtgaaaacttgtagcatctcaagataatctttcttctgctgctcagaaaggttccctaagaccataacttcaagatgtacactgttgaaaaggttcgaggcaaacgcttggaattcagaaaaacttaacttctcaagagctgatagcttagtagtattagaatacgtctccttcataacttgtgaggcaagctcatcaagcccagaacgaaccggacagttgagcaaagctccttgataaagctctaacaactgctttttatatactaagaatgtctcatacctaatctctaaattaggtaatgaggttaaaattgagtttaacaatgcagggactgttgttgtgtaccctgaaactcttaaatcaataccatcaccacctaaagcagaagtaaaagaaaaaccagcttgcgttgcgggataatactccctcaaaagctgatggttcacaggctaagcaatagagctccgtagcaactagaaattgaggggaggacctcgaaatctgaggagagcggatgcgaatctgactggagagtttcggtgctgtatagtagtggtcctcgcaatggtacagagttaatttatcatcttggtaactgagtgcaggagcaaaaggaaattcttgttttttcagtaggtgtacaccaggaagagtcacctctttaggaataaacagattcggctttggaagagctatgggctttagtgactgcacctttccataatcctgaacaccgtccagagcttttacatagtaggtcatgtcaaaaataggatcgtggagctgagtcgcttcttcccaatgctcagagttcttactagataagacaaaacgtgcttgttcaggatcagagactaaattaagaagagcagactcgtcttcagaagagtatttaggatacacaaggctatgataaggatacgtagatagatcctcattgcccaaggatacaatctgcttacaaagcagatcaaacaatggacttttggaactgtaacagtagtttaaagcattaattgtagaaatttcttctaacgtatagttgggaatcccgtgttcctgaatatatcgaagatattggaaggtactatcaataacctgagaatagtgtttatcgcctttctccgtaagctcatagctaatatagaattctccagtatttaaagaacttctaaagaattccacgtctaaatccgtaattagctgctcgtttttcaataaagagactaaactgttcttactctcatttcttaaaacttcagcaagagccttgtaacagcctaaaggaatcggatgggaagattcataaatatgccagtaaatttctagattagaggtaggctgaatcgcttggttaatatagagattctttaatgacgaggtgtcaccagaaggaagaaaaggttcctgtctttcataattttttgatctaggaatctgagaaaaaatctttgagaactgtttctttgctttagagagcggagctgatgtgtaagcaatagcacacatattctcaggagaataatgtagcttaaaccattctgccattttctctgtagtcactggggtgagggtggaagcattcccacaaccaaaacgtgcgcagggatggccctgaggagcaacaagctgctgaatgcgatgcacacgtctcccatcagaaagaggatgagcagcgaattcttgatgtactgcgtacttttctctatcaagatcttcttgacgaaacttcggattaataaatagatgaacaaattggtctaaagcatcagaaaacgcagaatgttctactgaaaatacaaagactgttttatttgggtaagtgaaagcattatgcaccccattattttcgcttaaaaatccagggaaaccagagacctcaggatacttttcatttccaagaaagacacagtgttctgtgaagtgcgccatcccaggatactcttcaggatcggcattatttcctgttttcacaaggagtgctgctcccgaagtaggaagattagggtcggaaataataagaagagggagcccgttactacaaataatcttttcaattttctggtccgcagcggcaggagtggaaacttgtaaagggcactgattggggacgactttgaactgctgttcacacgatgttatggatagggaagtgcaaattaaaatagggacaaaaaagtttccaaaacatcttacaattcctcgtatagattttttacaaatagaaaatactttttctgctcttaatgttctttgggcgtgtttatcgcaatgaataagttcctcttttgaacataatgcatcaaaaaatagttctgctccgaagttgaagaaaacaggagcaaagaaaatggctcgctgctccccaattgcattctctattttcggaggaggggggagaatgtcataggtttttaaagcaaagggataaaaatgtgtcgtttgattagaagccttagctaataaacgaaacacttcaatgctttctggagagaattctgaaggatataatcttccttccgcattttttctgtcacgacctcctgcaggggctacgtaaataaatttgcctccttcatttaacaaggtctttaatatttgcatgcttttctgattatgaagaagcttttcttcccggagttctggtggagtggcaatatgacgcttagaataaatacataataaatcacatcccatgctaaatggtcgtgctaggggatcagaagtgactcggtctccagctacaaaaatcatgttctccattaactcaggatgcgtcttgcctaaggcataatacatgagttgtggatcgcattctgtctggtgatttgcaaggagaacaacattatctcccctagcaatgtattcttctatttccttaaggcggtgtaggtttaaaattcgagagtttttatcgtcaatgactagagaaaaaaaatctatactcaaacgaaatagatctataggagctcgaatttttttatgatacggagggaaaatgaaagggtttttcaagtcctcgatgataaccttgacccattgtaaacatagcacctcagcttgatcagctgcagctttttttgtagctgcatcgatgtaattctgatgaaaaacagaaaatttctgatataaaggctctgggagatactggttatcaaaagcatagcgtaaatacctagaaaactgcatgtatattgccctataaatctatactttcccctgtaatgagagagaagaattggtagtggtttaaatgaaccgagtccgatgtattgatctgaagtttagcttttaattgcttagccaaattgatcatttcattgtcatcgttttcttgtttcatatagcttgcaatttctggatgcacaacaagacaaagatgagagtgttctttgtgattaataacctttttcaaatccctctcaatctcgatgaccacactttcaggtgttttaataatggcgttgccgctgcagtagggacatagagtgaataatgtctgcattagagattcccgatttctctgtctggtcatctcaacaagaccaaattcactcatgcttaaaatagtacagcgagcagcatcgtatttcatatgttctttcaatcgttccaaaacacgtcgctggttcttacgagatttcatatcgataaagtcaataatcactaatccgcctacattacgtaaacgcaactgtctggcaatttcttcagctgcttctaagttgatttggaccagagtttcttcaactccactttctaactgtgtgcttcttcccgaatttacgtcgatagtgtgcatggcttctgttttgtcaaaaaacaaataaccaccgctggacagccaaatttttcttcttgtcgccttatcaatttctttctctatattgaaacgctcaaacatcggaatagaatcccgataatactctatcttgatggaagcatccggagagtatttttttaacatatgtttgcacttttgatacgtagcataatcatcaataaggagtcgcttgtagttcttatcgatacaagtaatcacagctttttttagtatgtccgtctcagaataaagcaagcagggttgctctgtggaatagaatttttctaaaattgttttccaagtgagtaacaagtcgtgggcctcattaatgagagcttcagtagaggctgtagtgctcgctgtacggcaaatcaaacccatgtcttgaggcatttcaaaagaacgaatgagctgttttaactgctctctcatatggggatcttcaatttttcgagaaacacctcggtgaggtgagtttggtaaaagtaccaaataacgtcccggaatggagatgttagaagttaagcgagctcccttacttccaataggctctttgactacctgaacgagaacggggctgtctaatttgagaaattcttcaatgggagcttcctcagaagaaagaagaggagcttcagaagcttcttcgggaagagcatctacatccatatcgaacatctgttcaaacttcttcgaattctctaaaatatcagagatatgaatgaaaccattctctctctcatcaatattaataaacgcagattggatatttctcagaatgttggtaacacgacctcgataaatattgcctttgagctgacgaactttctttctctctatagttagatcaaaaagttgaccatttttcagatgggcatagcgaatttctttcgattctatgttgagtaaaatttcattttccatgactttccttgtgcctataccatatccttgagcttacttattctgtttgggaaaagagtggtttctagacgtcgaaacttaaatttctaactgctcgtgagataagttacgttggtgattataaagaaaataggtaaaaaattctacagaaatggctttttgattctttttaaaaataattaggttattttaatttaattcttttcaactgtaggtctttgttttctataatcattgtctttggtaagctatctttctaatcctcaaaaagccttggttctaggtagtaaaggttttagtatggactgtgtcgataatttaaaattatatatttttcgtttgaaactacctggagatacggaacgcatcagctattctattagccctgaatacattcgtgagaagggggaagaagagcttttgaattctcccatcgaggtggaagggtctctgggacgcatagatagtgaccaatggattctctcgctaagcctaaagactcagctaggtttatgttgcccagtgtgtaacaattttttttcacactccgtctgcttgccagatcttcaacgtgtgatatctcatgatgaggtaggttcgggagtctttgattgtagacctttgattcgtcaggagctccttttagaaagcgattgtttcgaagagtgtagtgggcagggctgccccgaaaggaaaaatatcttaaaatttttggaagacagaaaaaaacatgaggggaataatccctttgagtatttataaaaggtaaggaacatggcggtaccacgcaatcgacatagtaatgcaagaaagaatattcgaagaagtcacgatgctaagaaggcttgtcacgcagcaaagtgcagcaattgtaagcatgcccttcttcctcatactatatgcccttcttgtggattttataacggtaaagccgttatgactgtagaaaagaaataaatcttatctgattttatggaagtgcaaattggcatagatttaatgggaggggaccattctcctcttgttgtttggcaagtgctggttgatgtacttaaatctcaaagttctactattccctttgcatttactctttttgcttccgaggagattcggaagcaaattcaagaagaatttatatcagatctgcctcaagagaagtttcctaagatcatttctgcggaaaattttgtggctatggaggactctcctctagcagctatccgcaaaaaatcctcatccatggctttaggattggattatcttcaggaagataaactcgacgcttttatatccacagggaatacaggggccttagttacattagcacgtgctaagattcctctatttcctgccgtatctcgtcccgcattacttgtttgtgttcctacaatgcgaggtcatgcagtcattctagatgttggtgccaatatttctgtaaagcctgaagaaatggtaggtttcgctcgtatgggacttgcctatcgtcagtgtcttggcgattctaagattcctacgatcggattgcttaatattggttcagaagaacgtaaaggtacggaagcccatcgccagacattccgtatgctgcgagagacatttggcgaactttcttaggcaatatagaaagcggtgctgtctttgacggtgctgcagatatagttgtcaccgatgggtttacaggaaacatcttccttaagactgctgagggtgtatttgagttcttgcagcgtattctaggggataaacttgaagcagacattcaacgtcggttggattacacattttatcccggctctgtagtctgtggtctttctaaacttgtgatcaaatgtcatggtaaggcgtgcggttcttctttgttccatggcattttgggctctataaatctggctcaagcacgcctatgcaaacgcattttgtctaatttgatttagttaactacattcaattttttgcttctctgtatagctttttctttattgacgggatcttgttgatagtgctacatattttgcaaaatactttataaacacctctcaggtttaaggttgcaatggtagcgaaaaaaacagtacgatcttataggtcttcattttctcattccgtaatagtagcaatattgtcagcaggcattgcttttgaagcacattccttacacagctcagaactagatttaggtgtattcaataaacagtttgaggaacattctgctcatgttgaagaggctcaaacatctgttttaaagggatcagatcctgtaaatccctctcagaaagaatccgagaaggttttgtacactcaagtgcctcttacccaaggaagctctggagagagtttggatctcgccgatgctaatntcttagagcattttcagcatctttttgaagagactacagtatttggtatcgatcaaaagctggtttggtcagatttagatactaggaatttttcccaacccactcaagaacctgatacaagtaatgctgtaagtgagaaaatctcctcagataccaaagagaatagaaaagacctagagactgaagatccttcaaaaaaaagtggccttaaagaagtttcatcagatctccctaaaagtcctgaaactgcagtagcagctatttctgaagatcttgaaatctcagaaaacatttcagcaagagatcctcttcagggtttagcatttttttataaaaatacatcttctcagtctatctctgaaaaggattcttcatttcaaggaattatcttttctggttcaggagctaattcagggctaggttttgaaaatcttaaggcgccgaaatctggggctgcagtttattctgatcgagatattgtttttgaaaatcttgttaaaggattgagttttatatcttgtgaatctttagaagatggctctgccgcaggtgtaaacattgttgtgacccattgtggtgatgtaactctcactgattgtgccactggtttagaccttgaagctttacgtctggttaaagatttttctcgtggaggagctgttttcactgctcgcaaccatgaagtgcaaaataaccttgcaggtggaattctatccgttgtaggcaataaaggagctattgttgtagagaaaaatagtgctgagaagtccaatggaggagcttttgcttgcggaagttttgtttacagtaacaacgaaaacaccgccttgtggaaagaaaatcaagcattatcaggaggagccatatcctcagcaagtgatattgatattcaagggaactgtagcgctattgaattttcaggaaaccagtctctaattgctcttggagagcatatagggcttacagattttgtaggtggaggagctttagctgctcaagggacgcttaccttaagaaataatgcagtagtgcaatgtgttaaaaacacttctaaaacacatggtggagctattttagcaggtactgttgatctcaacgaaacaattagcgaagttgcctttaagcagaatacagcagctctaactggaggtgctttaagtgcaaatgataaggttataattgcaaataactttggagaaattctttttgagcaaaacgaagtgaggaatcacggaggagccatttattgtggatgtcgatctaatcctaagttagaacaaaagnattctggagagaacatcaatattattggaaactccggagctatcacttttttaaaaaataaggcttctgttttagaagtgatgacacaagctgaagattatgctggtggaggcgctttatgggggcataatgttcttctagattccaatagtgggaatattcaatttataggaaatataggtggaaggaacttctggataggagaatatgtcggtggtggtgcgattctctctactgatagagtgacaatttctaataactctggagatgttgtttttaaaggaaacaaaggccaatgtcttgctcaaaaatatgtagctcctcaagaaacagctcccgtggaatcagatgcttcatctacaaataaagacgagaagagccttaatgcttgtagtcatggagatcattatcctcctaaaactgtagaagaggaagtgccaccttcattgttagaagaacatcctgttgtttcttcgacagatattcgtggtggtggggccattctagctcaacatatctttattacagataatacaggaaatctgagattctctgggaaccttggtggtggtgaagagtcttctactgtcggtgatttagctatcgtaggaggaggtgctttgctttctactaatgaagttaatgtttgcagtaaccaaaatgttgttttttctgataacgtgacttcaaatggttgtgattcagggggagctattttagctaaaaaagtagatatctccgcgaaccactcggttgaatttgtctctaatggttcagggaaattcggtggtgccgtttgcgctttaaacgaatcagtaaacattacggacaatggctcggcagtatcattctctaaaaatagaacacgtcttggcggtgctggagttgcagctcctcaaggctctgtaacgatttgtggaaatcagggaaacatagcatttaaagagaactttgtttttggctctgaaaatcaaagatcaggtggaggagctatcattgctaactcttctgtaaatattcaggataacgcaggagatatcctatttgtaagtaactctacgggatcttatggaggtgctatttttgtaggatctttggttgcttctgaaggcagcaacccacgaacgcttacaattacaggcaacagtggggatatcctatttgctaaaaatagcacgcaaacagccgcttctttatcagaaaaagattcctttggtggaggggccatctatacacaaaacctcaaaattgtaaagaatgcagggaacgtttctttctatggcaacagagctcctagtggtgctggtgtccaaattgcagacggaggaactgtttgtttagaggcttttggaggagatatcttatttgaagggaatatcaattttgatgggagtttcaatgcgattcacttatgcgggaatgactcaaaaatcgtagagctttctgctgttcaagataaaaatattattttccaagatgcaattacttatgaagagaacacaattcgtggcctgccagataaagatgtcagtcctttaagtgccccttcattaatttttaactccaagccacaagatgacagcgctcaacatcatgaagggacgatacggttttctcgaggggtacctaaaattcctcagattgctgctatacaagagggaaccttagctttatcacaaaacgcagagctttggttggcaggacttaaacaggaaacaggaagttctatcgtattgtctgcgggatctattctccgtatttttgattcccaggttgatagcagtgcgcctcttcctacagaaaataaagaggagactcttgtttctgccggagttcaaattaacatgagctctcctacacccaataaagataaagctgtagatactccagtacttgcagatatcataagtattactgtagatttgtcttcatttgttcctgagcaagacggaactcttcctcttcctcctgaaattatcattcctaagggaacaaaattacattctaatgccatagatcttaagattatagatcctaccaatgtgggatatgaaaatcatgctcttctaagttctcataaagatattccattaatttctcttaagacagcggaaggaatgacagggacgcctacagcagatgcttctctatctaatataaaaatagatgtatctttaccttcgatcacaccagcaacgtatggtcacacaggagtttggtctgaaagtaaaatggaagatggaagacttgtagtcggttggcaacctacgggatataagttaaatcctgagaagcaaggggctctagttttgaataatctctggagtcattatacagatcttagagctcttaagcaggagatctttgctcatcatacgatagctcaaagaatggagttagatttctcgacaaatgtctggggatcaggattaggtgttgttgaagattgtcagaacatcggagagtttgatgggttcaaacatcatctcacagggtatgccctaggcttggatacacaactagttgaagacttcttaattggaggatgtttctcacagttctttggtaaaactgaaagccaatcctacaaagctaagaacgatgtgaagagttatatgggagctgcttatgcggggattttagcaggtccttggttaataaaaggagcttttgtttacggtaatataaacaacgatttgactacagattacggtactttaggtatttcaacaggttcatggataggaaaagggtttatcgcaggcacaagcattgattaccgctatattgtaaatcctcgacggtttatatcggcaatcgtatccacagtggttccttttgtagaagccgagtatgtccgtatagatcttccagaaattagcgaacagggtaaagaggttagaacgttccaaaaaactcgttttgagaatgtcgccattccttttggatttgctttagaacatgcttattcgcgtggctcacgtgctgaagtgaacagtgtacagcttgcttacgtctttgatgtatatcgtaagggacctgtctctttgattacactcaaggatgctgcttattcttggaagagttatggggtagatattccttgtaaagcttggaaggctcgcttgagcaataatacggaatggaattcatatttaagtacgtatttagcgtttaattatgaatggagagaagatctgatagcttatgacttcaatggtggtatccgtattattttctagttcgatgtgacagggcttcaatcaaaaaaaagggttacttttagtaacccttttttatttctcttaatgcttatagttcgatgatctttaatacatagagcaagtaggcgatacaagctttattaggttcataggtctctgggtccattaagagtgtagaaaagacctcggtatgagcggaagtttgaggaagccgtaaggatgcatataatatatctagagcaaactcacggattaaagctttggtttctggatctgctttttgcatggatttaaagacgctattaacaagttgatttccagaatttaaatacttatttaggaaaagagcagctgacaaatcagcgtcttctctgccttgatgtgtgtccactgtagtttgacgtaaagttagggcgccgagagtatcttgtaggtgttctgtaactagaccgagatttttcccatggaagaatttcatagtgttgatcacatgccattgtagtttggctgctgactcgtttcgtagaacttgttctattgcctctgtgtaacgctcaccgtgttgctgagccgcaaaccgatactcttcagcatcatcaccatcttggatggacatcagctctcgttctttaaactcttgaacccaaatcagaagctgattgtctccttcattagctatactatagagtctgttaagagatctggttatgacttctccccaagtcggcttacaagtcttgcaagaacttgcaataaataaggccgcttgcattttttcctttgtactaggagttttgggtaaagaggactttccagtaagagcttctatgaggagcttgatcaatattgggaacgtctttttatcaggattactatcatgttcgtttttcagtccctcaaagtacttcagcatgtgcttccattctggagttagcacgcctagagactttaatacttttttcagttgtgagcatagatccggaatcttccgcatggcttcttggctntcttgcggcgaaattgctactagtctatttaaaaagggattaggtaagggtgctttgcctacactttgttcaacaattttaaaagagcgaagtttgttatcctcaaaaagcaacgcttgcaaagcgaaaatgaagggttgaatgacctcattcgtttcttcagtagtaggttcacttaaatcctctacgatttttttagggggaagaggcatgaagagacgaagacctgctacgatgagattcaccggtaaaagaatgataaacagtactgaagtaataataaatgctaggatgttgagaatcacccaacataagggaccaccagagcacccgcagggattcagtattttttttgacatactgaataggctagaaggatgtaggacctgagccacgttggttaggcgtgtttgacacgcattttcttccaagataataagttccgtcctccgaggataaatcggcgaagtttttggaattaaattgtactttgctattaactctgcaggggaaaacaaagagatggggttagacatatgcatcttggagttatggattaagtagaaatattttattatactttctaagattgattgttattcaattaatttttatttagaaatactataaaaaagtagctcaaaacgaattgttttatacttatttatgagttcttaaagaacttgttttaagaaacctaaatattcatacagcgggaagtgtgtcaaaaattctttttaaaaactcttcagaagctatttgccctgtcgtcatcactttacataatttgcggcagtcctccttttgtttttctttagagccatgttgatttagcaaatctaaagcggtagcagtttcttctggatgaaaatcttttttccctccaatgaactctggaaaaatcacggagttcataatgatatttggtaaggaatacgcgggcaaaagaattttaaaaatatattttgctaagaatgtgtcaaaaggtcgaagtcgacacatgactattgtgggtgtttgatttaaggcagtttctaagactatagtgccacattttgctagtgcacaatcacagcttctcatgagctcatagcggaaattcatggggatgatttgactatgctgacatccttctgcttttagagtatcttcaatgatttcgtcgtacttagcgcttgatgaggaaaccacaaattgatgtgtttgagatagcgatgaatttagaaaagcttgtacctggatccgtaaatttcggctgatgtcaccacgacgacttccaggaaacgcagcaacaataggacggtcagaattaaggaatttctctttccaagaggcctgttctttgtagtcagagatctcctcaactagggggtgtcctaaatacacagtctcaagagatgtgtttttgaaaaggccttcttcaaaaggaaggatcagtaggagcatatcaagatgttgctctagtatgcgttttcttttggggcgccatgcccaaatactcgggcaaacgtaatggatgatttttcctcgatacccatgttttctcagctttttaattaagagaaggtgaaaatcggggaaatcaatgaagataagagtcgctggcttgtgtttgagtatcgtttttaggattttgcggtaatttcgatataatctaaataatgaccccagaacttcagcaaatcctgaaacttgaaactcctccatgtttagaatgggctggagaccttcttgtcgcattgcaggacctccaacaccccagaaccgtatgtttggatagagagactttatggattggattaacttaccccccaaaatgtcaccgctagcttctccagcagagagaaagcagtgtgtatccaaataaggagtcgaacgttgttctttataaaagagacgtaaatttgcgatggacgggaataatccacagccatagcacaggatgtttataggatctccgatgcgaatgaagtacaccagcgccagcaatcccccaagaagtccaattttccaaaatagtaaggggaaatctttagtattattcgattctatgtagaaccattggattaaaaaacgacccgaaaaaatagcaagccctaaacagcctataagatgccaagaaagttgtgcaggaggaagaggaagatggaagatattaggagaggccatccattccatgttcacatagaggaaaggcagagtcacgaacaccacgctcagagccatcagaactaaggtcgctcgaaaggaaatcggtcgagaggaagtaatatttaggtttctgaggtagataattaagttaatgacatgaagtacagtcacaggaaattggctttgaattgtcccgtggacaatcatcaaagtggctcctattgaagagagaatccaaaagcttcgaggagcatagacctctttgcgctttttactcagccaccactgtattgagaaggcactcccaaaaaaaagactagcaagaaatcctaggggataaagcagataaactaggccagaagggatcatgtttagacctacttttgagaatgagaatcctttttacacttaagtgtttgatgatgacgtatccaagcaacatacactttatcgagcttaggatacactatactacgaatttccaataaagataatgcttctaagaaccttgtgtgatgtaaaagtttcttattaaagaagagcgctttttttgtagggatcaggggagtgagtctgtactgcatttgtaaaattaatgctgtcaggataaaattcttttttgagcaacttgtgaacgagtcagcaaagaattgttctaggaaatttttgatataatcaaaaacggatgtcaaagacaaatacgggtgcttctgatgcttataacggacattaaagttcactaaaggaaaaaggaatatagccatcagctgatgacgatcatactctgcctctttttttagtattttgtcatctagagcttttaggtaggtggctgtttgctcttctagtgcgcgatttaagcggaatgccttatccatatagggaaaaaggatctcaagaagatggttctctattagcagttggaaaaagttctttgcggctccggaatttaacattttgataagttcttcgaagacccgtgcccgagaacttttaattagctcttggcgacaagcaattaaagcttcttgagtttgcgtttctacagtaaacggcgaccgtgataaaatctttaacagtctcagcatgcgtactggatcttgcttgaatcttgtaaagggatcgccgatagtgcgcaaataacggttccttaaatcattaacgccaccagtatagtctataatctcttcatgctcgggatcgtaaaacaatccattgattgtaaaatctcttcgcaagacatcttcttcaggagtcccccatagattatctttagtaatcaagacatcttcatcggtgcttcccgaacgaaatgttgaaacttcaataatctgcttagagaatctaatatgggcaagacggaaacgcttaccgaccaaaatacaatttttaaagatagctttaatttcttcaggtttcgctgaagtggagatatcaaaatccttcggcgtggtatttaataacaaatccctaatgcaacccccaacaatataagcgatataccctgctttacggagggttttgatcactgacagggcgtgaggagagaaatctttgagtttgatgttatggttagaaacagaatagatcgtaggagttaaagtgatattagattttttttttaacaattctaggcctctaccagagagaatattgttttcgcagaccattattatagttattaagagttaaaagtcttggaagaaaaagagtgtgtagtttgcgtctacttccattttaaaatcccaacatagcaaaactagggaagttttcaaggataaaaatgaaaaacaaaagatgttttctatagagattcctcttcaatttttaattatatatggatcattcttaagactctagcatccacagaacccggtagagagctcttaaatgccttgatcctggggagcagaaaggatgtaaaaagcatggaataaaaaatatctagtttctgacagaattcaattatagaactttacatccattggagagttctctatagaagatcgaagtattcttcgagaagagtactacagtcagaggctactttcttttacttatagtttactgcttataaattcgcttttatttgtgcgtgtagaagtgaaaagatacggagaataggaatagattttaggagaaacatgcaacaaagtgtcagaaaactttttggtacagatggtgtgcgaggacgagcaaattttgaacctatgacagtggaaacgactgttttattagggaaagctgtagctagagtacttcgtgagggtagatcgggcaaacatcgtgttgtagtaggcaaagatactaggctatcgggatatatgtttgagaacgcattgattgctggctcaattctatggggatagaaactttggttcttggtcctatccctacgccaggagttgcgtttattacacgggcctatcgagcggacgcagggattatgatttctgcttcacataatccttacagggataatggaattaagattttctctttagaaggatttaaaatttctgatgttcttgagcagcgtattgaaaccatggtgagtgaagctgactttggtccattacccgaagatcacgcagttgggaagaacaaacgtgtgatagatgctatgggacgctatgtagagtttgtgaaagcaacatttcctaagggacgcactttaaaggggttaaagattgttctagactgcgctcacggagcttcttataaggtagcaccttctgtatttgaagagctggatgcagaggtcatttgttatggttgcgaacctacaggaatcaacatcaatgaacactgcggagctcttttccctcaagtcattcaaaaagctgtaatcgaacatcaagcacatcttgggattgcgctagatggggatggagatcggattatcatggtggatgagaaggggcatattgtcgatggagatatgatcctcagtatatgtgctggtgatcttaaaaaaagatccgcattacctcataaccgtgttgttgccacgattatgacaaatttcggagtcttgaaatatttggaaggattaggcctacaggtattcacctctccagtaggggaccgtcatgttttgcacgccatgttagaacatgaagtgaccttnggaggtgaacagagcggacatatgattttcttggactacaataccactggagatggaattgtctcagcgctacaagttttgcgcattatgatagaaagtgaatctatgctctcagatttgacagccccaattgtaaaaagtccccaaacattgatcaacgttgctgtaagagagaaaattcctcttgaaaccatccctttaattgaaagaaccttgagagatgttcaagatgccttaggcccctctggacgcatattattaagatattctggaaccgaaaatatatgcagagttatggttgaaggtcataaaaaacatcaagtagactgccttgccaaggctcttgcggatgttattgatgcagaattaggtacaggtagtagagagtaggatcgtatgtgcgggatatttggatatttgggaaaccaagatggtgtgtctattgttctagaaggcttggcaaagttagaatatcgtggttatgattccgcaggtcttgctgctgtagttgaacaagagctttttattagaaaaactgtaggtcgtgttcaagagctttcaaacttgtttcaagaaagagaaatccctacggcatcagttattggccatacccgttgggcaactcatggagtgcctaccgagattaatgctcatccacatgtggatgagggaaggtcgtgtgctgtagtccataatggaattatagaaaatttcaaagagttgcgacgcgagctgactgcgcaaggcatttcatttgcttcagataccgattcagaaattattgttcagctgttttctctatattatcaagagtcccaagatcttgtgttcagcttttgtcagactctagctcaactccgaggtagcgtagctgcgctttgattcataaagatcatcctcatacgattctttgcgcttctcaagagagccctttaattcttggtttagggaaagaagagacgtttattgcttcagattcgcgagctttcttcaaatatactcgacattctcaagccttggcctccggagaatttgctatagtttctcaagggaaagaacctgaggtttataatttggagcttaagaaaatccataaggatgtacgacaaatcacctgtagtgaagatgcttcggataaaagtggctacggctattatatgctgaaggaaatctatgatcagccagaagttttagaaggtctgattcaaaaacatatggatgaagaaggacatattttatctgaatttttatcagatgttcctatcaagagttttaaagaaatcacgattgttgcttgcgggtcttcctatcatgctggttatctcgctaaatatattatagagtccttagtttcaattcctgtacatattgaagtggcttccgaatttcgctatcgacgtccctacataggtaaagatactttggggattttgatcagtcaatcaggagaaacagctgataccctagctgctttgaaggaattacgtcgcagaaacattgcttatctcctaggcatttgcaatgtcccggaatcagcaattgctcttggtgtggatcactgtctgtttttagaagcgggggtggaaatcggtgtagctacgacaaaggcttttacctcgcaactcttgttgcttgtgtttttgggtttgaaattagcaaatgtacatggtgccttgactcacgcagaacaatgttcctttggccagggattacaaagcttaccagatctctgtcaaaaacttcttgcccaacgagtctctccattcttgggcgcagccttactcctatgaagataagtttctttttctaggccgtaggttgatgtatccggtggttatggaggctgccctcaaactcaaagaaattgcttatattgaagcgaatgcgtatcctggtggagaaatgaaacatgggcccatagctttaattagcaaaggtacccctgttattgcattttgcggtgatgatattgtctatgaaaagatgataggcaacatgatggaggttaaagctcgtcatgctcatgtgattgctattgctcctgaatctcgtgaagatatcgctgcagtttctgatcaacagatctttgtcccagattgtcattttctcgctgctcctgtgttatatactatagttggtcaagtgatggcatatgctatggcgttagcaaaaggaatggagattgactgtcccagaaatcttgccaagtctgttactgtagagtaagtacttcacagtagtagacctcgcaatcctatgatgaaactctttagaacttgtcttaagagtgcatatgaaatttaggtatacgttatgtcaaataaagttctaggtgggtccttgcttattgcaggttctgccatcggtgctggtgttttagcagttcctgtattgaccgcaaaaggcggttttttccctgcaacttttctctatattgtgtcctggcttttttctatncctcaggcctttgccttcttgaagtcatgacttggatganagaatcaaagaacccagtgaacatgctttctatggcggaatctattttaggtcatgtaggcaagatttctatatgccttgtctacttgtttctcttttactccctactgattgctatttctgcgaagggggaaacatcttatgccgcgtgtttaattgtcaaaatttaggaatctcatggattcgtcaccttggccctctaggttttgctatattgatggggcctatcattatggcgggaacaaaagtgattgattactgtaatcgtttctttatgttcggcttaactgtagcttttggaattttctgtgcccttggatttttaaaaatccaacctagctttctggtgcgttcctcatggttaactacaataaacgcatttcctgtgtttttccttgcttttggattccaaagtatcattcctacgttgtactactacatggacaaaaaagttggagatgttaaaaaggcaattctcataggaacgttgattcctcttgttctctatgtcttatgggaagttgtggttttaggtgctgtctctcttccgattctttcccaggctaagataggtggatatactgctgtagaagctctcaagcaggcccatcgttcttgggcattttatattgctggagaactttttggcttctttgctttggtctcctcttttgtaggagttgctctcggtgttatggacttcctggcagacggtttaaaatggaataaaaaatcacatcccaattttcaattttctttttaacatttattattccccttgcttgggctgtttgttatcctgaaattgttttgacctgtcttaagtatgctgggggattcggggccgccgtgattatcggggtattcccaacattgattgtgtggaaagggcgttatggcaaacaacatcacagagagaaacagttagttccaggaggaaagtttgctttatttttgatgttcttgttgatagtaataaatgtagttagcatttatcatgagctttaaatttgttttgctctatttttcaatttcaagtgagcaaataggannnttctatgggactatatgatcgtgactatatacaagattctcgagtgcagggaacttttgcttcaagagtctatgggtggatgacagcagggctaatcgtaacttcatgtgttgccctgggtctttatttttctggattatacagaagtttattttctttttggtgggtgtggtgtttcgctacgctaggcgtgtctttctttatcaactctaaaatccagacactatcggtagttggtcaagtgatggcatatgctatggtgttagcaaaaggaatggagattgactgtcccagaaatcttgccaagtctgttactgtagagtaagtacttcacagtagtagacctcgcaatcctatgatgaaactctttagaacttgtcttaagagtgcatatgaaatttaggtatacgttatgtcaaataaagttctaggtgggtccttgcttattgcaggttctgccatcggtgctggtgttttagcagttcctgtattgaccgcaaaaggcggttttttccctgcaacttttctctatattgtctcctggcttttttctatggcctcaggcctttgccttcttgaagtcatgacttggatgaaagaatcaaagaacccagtgaacatgctttctatggcggaatctattttaggtcatgtaggcaagatttctatatgccttgtctacttgtttctcttttactccctactgattgcctatttctgcgaagggggaaacatcttatgccgcgtgtttaattgtcaaaatttaggaatctcatggattcntcnccttggccctctaggttttgctatattgatggggcctatcattannncgggaacannantnattgattactgtnancntttctttntntnnggcttancngtnncttttggaatttnctntgcccttggatttttaaaaatccaacctagctttatggtgcgttcctcaatggttaactacaataaacgcatttcctgtgttttttcnttgctttttggattccaaagtancattcctacnttgtactactacatggacaaaaaaagttggagatgttaaaaaggcaattctcataggaacgttgattcctcttgttctctatgtcttatgggaagttgtggtttnaggtgctgtctctnttccgattctttcccaggctaagataggtggatatactgctgtagaagctctcaagcaggcccatcgttcttgagcattttatattgctggagaactttttggcttctttgctttggtctcctcttttgtaggagttgctctcggtgttatggacttcctggcagacggtttaaaatggaataaaaaatcacatccattttcaattttctttttaacatttattattccccttgcttgggctgtttgttatcctgaaattgttttgacctgtcttaagtatgctgggggattcggggccgccgtgattatcggggtattcccaacattgattgtgtggaaagggcgttatggcaaacaacatcacagagagaaacagttagttccaggaggaaagtttgctttatttttgatgttcttgttgatagtaataaatgtagttagcatttatcatgagctttaaatttgttttgctctatttttcaatttcaagtgagcaaataggagggttctatgggactatatgatcgtgactatatacaagattctcgagtgcagggaacttttgcttcaagagtctatgggtggatgacagcagggctaatcgtaacttcatgtgttgccctgggtctttatttttctggattatacagaagtttattttctttttggtgggtgtggtgtttcgctacgctaggcgtgtctttctttatcaactctaaaatccagacactatcggtttctgctgtagggggccttttccttctctactcaacattagaaggaatgttttttggaaccttacttcctgtctacgctgctcaatatggcggaggggtgatctgggccgcttttggatcagcagccttggtatttggcttagcagcagtatacggagcgtttacaaaaagcgatcttactaaaattagtaagattatgacttttgctttgataggacttctgctagtgactctagtctttgctgtggtttcgatgtttgtatctatgcctttaatctacttattgatttgctatctagggctcgtcatctttgttggattgacagctgctgatgcgcaagcaattcgtcggatttcttctactataggggataacaataccttgagttacaaactctctttgatgtttgctcttaagatgtattgcaatgtcatcatggtattttggtatctgctgcagattttctcatcttcaggaaaccgagactaaacaacgacttagatcttttctacttcaggaaataatttgtttagaaaaagatctaagtcgaattcattaagatcctttaaagattccccataaccaataaactttgtggggattttcagtcgtttagctatttgaaatagggtgccacccttggcagagccgtctacttttgtgaagataagaccagaaaggggaacaacatcatgaaatacccgcacctgctctatagcattattccctaaggtagagtccacagtcataaaaatttcatgaggagctccctctagagctttgccgcaaaccgagactattttggaaagctctttcataagattgccatgtacatgcaggcgacctgaggtatcaataatgactctagagtacccccgggcgattgcagattgaatcccatcaaaggcaatagcagcagcgtcccccccgggttgtccagagacaaagccacagccaagttcgttggcccagagtcgtgcctggtccatgccagcagctcgaaaggtatccgtggctacaagcatgacgctttcagatcgctctttgtagtaatgagcaagtttggccgctgttgtcgtttttcctgagccgttggtcccaagaagtaaagaaacaatcggtctggtctgggaactttgtgaagcttgagaaggaagaccttctagagactcgcgaagtaaaactgtaatcagatctttgatagtagatgcgtcagcttttttagtccgacgtaatcgtgcacacaattcttcagtaagctcagtaccaaaatctgcttcataaaacaaactttcagcatcttctataagatctaaagatatattttttttaaataaagattgaagcttgtttctaaagaatttgaacattgctaatagcaaagttagttgaagtaaaagaaatgatacaagataagaaggaaaaagcaaagagttatttatgcatcttcatgagtaccaagctaaagatctcttagcttcttacgatgtgcctattcccccctattgggtagtgtcttcagaggaagaaggggaacttcttatcacaaagtcgggattagattccgccgtggttaaagtacaggttcatgctggaggtcgagggaaacatggtggtgtcattgttgcaaaatcctcagcaggcattttgcaagccgtagctaagctcttaggaatgcattttactagtaatcaaactgccgacggatttctccccgtagagaaagtcttgatttcaccacttgttgctatacaaagggaatattatgtcgcagtgattatggatcgaaaacaccgatgcccagttcttatgctttcaaaagcaggaggtatggatatcgaagaggtcgcacactcttccccagaacagatcctgacattaccactgacctcttatgggcatatctatagttatcaacttcgtcaagccactaagttcatggagtgggaaggagaagtgatgcaccaaggtgtccaattgatcaaaaagcttgcgaagtgcttttatgaaaatgatgtctctttattagagatcaatcctttggtgttgactttagagggtgagctacttgtcctcgattctaagattacgatcgatgacaatgccctataccgtcatcccaacttagaagtattgtatgacccctctcaagagaatgttcgggatgtcctagcaaagcaaatcggattgtcctacatcgctctaagcggaaatatcggttgcattgtgaatggcgccggacttgccatgagtaccttagatattttaaagctccatggtgggaatgctgcgaatttcttagatgtcggaggaggggcttctcaaaagcaaatccaagaagctgtatctttagtattgtccgatgagagcgtgaaagtgctttttatcaatatcttcgggnngattatggactgttctgtagttgcctccgggctcgttgcagttatggaaacaagagatcaagtggttcctacagtcattcgtctcgaaggaacaaatgtagaattgggaaaagaaattgttcagcaatctgggattccttgccaatttgtctcttctatggaagagggcgctagacgcgctgtagaactgagtatgtagatttaggagatacatgttccactcactaagtaaaaatactcccatcatcacacagggaattacagggaaagcaggttcatttcatactgagcagtgcctcgcctacggtacgaatttcgtagggggtgtgactccaggcaaagggggaaccctttggctagacctgccagtctatgattctgtacttgaggcgaagcaagctacagggtgtcgcgcgaccatgatttttgttccaccaccttatgccgccgaggccatcctagaagccgaagaggccggaatcgaacttattgtttgtattaccgaagggatccctgttcgagatatgcttgaagtggctagagttatggacaacagtacttcacagcttatcggcccgaattgtccaggaattatcaagcctggagaatgtaaaattggaattatgccaggatatatccacctgccgggaaatattggagtggtctctagatcaggaactctgacatacgaggctgtttggcagctcactcagctcaaaatcggccagagtatttgtgtaggtattgggggagaccccctcaatggaacctcatttattgatgtcttgcaggcgctggaggaggatccctatacagaactgattttaatgatcggggaaatcggcggtagtgccgaagaagaggccgcggcctggatccaagcacactgcacaaaacccgtggttgcttttattgctggtgttacagctccaaaagggaaacgcatggggcatgctggggccatcatctctggaaattctggggatgccaaaagtaaaatacaagttctacgtgaatctggagttactgtagttgagtctccggcccatatcggaaaaactgtagacgctgtattacgggcaaaagaactctaatgcttaatcatctaacctacaagtacaaggttcgcttaatcctttggattgggagctctctactttaatgaagatcttgtgcttggggactcattcttgcgcctagttcttattcatgtcttacgtcgctatttccctgtgggtaaggaaaatcagaaaaagagacctattcgcaagttataaagtatttacttgaaatattatttccctcatctactagctctttaagaactagccaagggtggatagaagtgccttcaaggagtgctctggcagccatatctaagtgtgtgttcaaaccctattctggcaacacaaataagatagatgttgtgggatactatatcataagagtatactgtttccaatttcttcaaatccgtaagcttttttctttccttacacacgactttattttttgaaatatcttatcaataccttagaacgaagttctaattaaaataaaatcaggatgttatgcaggtctacgagttctctcgtcaagttcaacccacatttcaaaatttactcatggaaaaattagatgcctgctttttctttggaggaaagcgggtaaaaattatcggtttagatgaacctaatctggcttgaggaatagaagaacaggttgcactatccattgctataaagatccttaaaattatccttgcacttattttgttcccattagttttactcgcctgggtgattcgctatcaattgcacgcaaatttccattgtagtgtagtgcccttcccaggattttcggtaaaccaagcatacaaatgtagtgaggctaagatagaagaaatgctagatcttctagacttagaaaccctggaatggtcatcaagatgccttcgtcaagatatgacatttgcaaatcggctagaggaagagctgattcaagaacttcgtgtgtcagagaccgaggagttgattagtcttggtggtaaacgaaaccttgtgcgtttacttctcacgcactctttttaatcctccaaaagagatcgcgtgtagagtctgtaggtcatgaggttgtctttcctgtatttgataggctaaagagagaagaggaaatcattggggatggacccatcactcgatccaatgaggaactgtgggctcttctagatcatggaactgctcgcgggatccataagaccctttggttttcgattttttttaagtatctaacacaaatcgaactgttctagaagcaggtattggaggggagattttcaagagacttaacgctatattccagacttctaccggtcaaacattgactttagctccgaagctctcgaatctttgcttttctgttcatttctctgggttgctgcgttgggaaaacattcaagttgagtagagagaaattgttnattttgtttcttnncaaanattttatcttaccagtctcttctatttgtctgagttacttgagtgatgcgtgaatttttacatgtgacttttggatcatggataactggaacttttataaaagatatcgagttcagaaaagaagaaaaaaacctcttttatttaatgatttattttttaaagtatataaataatttataattataaaataatttactttttaataattaaaatgtaaactgtttgcactttaataataattataattatagattttgatgcttgtctattgttttgatccctcggtaccaacttcaccagaacaccgcctgatggcggcattagaccgttggtttttcttaggaggacatcgtgtaagaattctcacgcttgagggtaatcactatcgggcttttcaagaaaatatgtctatctcaacagtagagaagatattgaaactaatttcctatctactcatccctattgtccttattgctttgctaatccgttgtttcttacactctaggtttaaatgtaattggaaatgcgattctctaagtgacgcaagagtcccccacgacgttcaacctttcaatgatttccaacttttcaataatcaggagaggctaaatatatggaaaaatcggagatatgtctctggaatagatgtgcttatggtgccggtcgattatctcagatctcagtttcccggttttaaggagattccagaagctatccgttgcgaaaactatgtaagtgatggtcagttttctgaagaaagtaaaacaagctatcttagagcgatgctgaccgacattgttgggtatatcttgtcattagatgagacctattggacgaatgtgatcctcaagatccgtgcgatgtgcatcaccttcgaaagtttccctggaaaagaagcagaccctaactattcccctcgcgtaactcaccactattttgatgaatcttggaaggcacttgcgcgacatgtattaggagaaggtaacatggtgaatagactagatgaggcgctaattcgtacagagaagccgggcaaagaaggggaatgtattacgaaacagtttttaaaagattactgtaaaaagcatctcgaagttatgagttgtccagatttcattgaatctctggtagatgaaaaaatccgagagtttcgttgtccaagtattttaaactcagcagtatgtgatgtaatagatcgcaaatgccaagaacatttgttaaaggcaataataaacgaagcaaaccgcaggctccctgggatgaaaaatagctcattcactatgcgtggtaaccaagttttattttataccatcttttctccaccaaaattgccacctgctgcgagttccgtatatttttaaagaaaggagatctcttggtctcctagtcctgctataaggtcttgatatacatctttttggagtaatttcatcttttatattattttattaaaatctttataattcgtttcttttgaaatatttattgtatttcttaataactgtatataaaccaatttgctaatattttaaaaagtagttttttgatggaagtttatagtttttccccttcagtaagaacttcgtttcagcaccgtgtaatggcggcactagataattggttttttctaggagggcgccgtttaaaagtagtttctctagatagttgtaactcagggcaggcttgtgaagaatacgtgcctatttcaacgacagaaaaggtcttaaagatactctcttacctactcataccgattgtcataatagctctgttaattcgttatcttttgcatagcaattttacggcaaaggtatcacagaaaccttggttaaagaccctgcagttaggaattgatataaaaagcttcatacttcccggttctcatgtaaacacgatggattcagctactttgtttaaagcaattcgtttggaagggaagcgtgttgatgtagaatatcataggctacatagcagcgataaggtggttttttatatccctgctcagaaacttccagatgatctgcgtttgactcattggcttccagaaaaagaaacaagaaagactgagtatgtgagacatatgctggcccatgtcatgggttatctaacatcacagggtaaggaacggcttcaacaggtagtgcaagactctcgaagcagtacttccttgggggctgaaaaagtccttcaatacagattcattgatcatccacagagtcaaggagaatttcaacgtctgcttaatgaaaatataacgaccaaaggttccgaggataaggaagttgtacagagtgatttatttgacatggcttttcagtgttggtggccacagtttatttcagttatacaatctccgaccttcagtgaagaattagtacacgaaatgagtcagaaacttgatttagattgtatatacccagaagatgatgaatttgagcagaagttccttaatacccttctgaaagcagtcttgcaccacggttttgaaggaatcagtgttgcgagtatgggtgttatcttcctgatttgtccggactctcttgcattacagattcccttcttaaggaatcaaaaatgatgcaggtgtcgaggttcttagttttaaggtagtaagacctccccgcggtagaatataggatcttcaagctcaaagtctccggctttgagcgatgttcccctcaaactttaattctacatcatgaagtattctcaatctaaagataaaaaatccttttgtagtgctgtgttagttacatatgatttgtttttttaatatgcattgtatttttcaataaataatgataaacacttcgcgaatgttttgaaaatatttttttatggaagtttatagttttcacctgcggtaaggacttcgtttcagcaccgtgtaatggcagcactagatgcttggttttttctaggagggcaccgtttaaaagtagtttctctagatagttgtaactcaggttgggcgtatcaagaacttgtgtctatttcaacgacagaaaaagtcttgaaactactctcttacctactcgtaccgattgtcataatagctctgttaattcgttgtcttttacatagcaattttaggatagacgtagagaaggaacgttggttaaaaataagggagttaggaattgatatagaaagctgcaaactccccagttcttatgtaaaccaggtttcctcgtttatttggtttgaaaaagataaatccaaacggccacgtattgatgtagattatcatacgctacatagcaaagactgggtagttttccctatcgtttttcagaaaattccaaagacctcgcgtttcagttattggttctcacaaaaagaaacaaggaagagggattatgtgagaaatatgctggaccacgtcattggttatctaacgtcagaaggtggggagtggttgcagtatatatcgaaaacctcttatcaaagcgctacttccttggatcctgaaagagttcttcaatattgcttaactgataaccaggagctccagggagaagtgcaacgtttgcttaatgaggagagtgcgaccaaaagctctggggataaggaagttttgttaagtcatgtatctgacattatttgccagtgttggtggccaaagtttcttgaagttatacaatctccggcctttattgaagaattagtagaagaagtgagtggtaaacttaatttagattttttatgcctagaaaaggctaatacattagatcaggagttgagaaacagtcttctaagagcagtcgtacaccacggttctgaaggagttgatattaagaaagttggtgccggcctcattatttatacggaagctattcaattacagattcccttctcaaggagttaaaaatgatcgtagtgtcggggtgcttagttttaaggtaacaagacatcctcgcagtagaagagaggatcttcaagctcaaagtctccggatttgagcgatgtttccctcaaactttaattctacatcatgaagtattctcaatctaaagatataaaatccctttgtagtaatgttttcgtcacatatgatttgtttttcgtaattactaggtagcagaacctgtgttagctagtatacgatggtattctgcttcatcgaaagacaaccttcttgagggatagatatgataactaagcaattgcgttcgtggctagctgtacttgttggttcaagtctgctagctcttcctttatcagggcaagctgtcgggaaaaaagaatctcgagtttccgagctgcctcaagacgttcttcttaaagagatctcgggagggttttctaaggtcgctaccaaggcgactcccgctgttgtgtacatagaaagtttcccaaagagccaggctgtaacacatccttctcctggacgccgtgggccttatgaaaatccttttgattattttaatgatgagtttttcaatcgtttttttggtctaccttcacagagggaaaaacctcaaagtaaagaggcggttcgaggaacaggtttcctagtatctccagatggctatattgtgactaataaccatgttgtcgaagatacaggtaagattcacgtaactcttcatgatgggcaaaagtacccagcaactgtaatcggactcgatcctaaaacagaccttgcagtcattaaaattaaatcccaaaacctcccgtatctttcttttggaaactccgaccacttaaaagtcggagattgggcaattgcaattggaaatcccttcggtcttcaagctacggtcaccgtagtgtcatcagtgctaaaggaagaaatcaactccacattgcagattttgaagattttattcagacagatgctgcgattaatccaggcaactctggaggccctcttctaaatattgatggacaggtcatcggtgttaatactgccattgtcagtggtagtggtggctatattggaatcgggtttgcgattcctagccttatggcaaatagaatcatagatcagctgattcgtgatggtcaagttacccgaggattcttaggagtgactttacaacctatagatgcggaactcgctgcttgctacaaactcgaaaaggtttatggcgctttagtcacagatgttgttaaaggatctccagcagataaagcagggctaaaacaagaagatgtgatcattgcttataatgggaaagaagtcgattcactgagtatgttccgtaatgctgtttctttaatgaatccagatacacgtattgttctaaaggtagttcgtgaaggaaaggttatcgaaatacccgtgacagtttctcaagctccaaaagaagatggaatgtcggctttacagcgtgtgggaatccgtgtgcaaaacctaactcctgaaactgctaagaagctgggaattgctccagagactaaaggcattttgattataagtgttgaaccagggtctgtagcagcttcttcaggaattgctcctggtcagctgatccttgctgtgaatagacaaaaagtatcttcgattgaagatctgaatagaacgttaaaagattctaacaatgagaatattcttcttatggtttctcaaggagatgttattcgcttcattgccctgaaacctgaagaataaaaagcttggagtcatacatttgattcataaagaggaatgaagagagttctctcttcactcttttattttaggaagcttatcaagaagctgacaaatagaaaggaatccctttttaagttggtccatcgagaaatgctcttctgcagcgtgaatatcatcactaagatacgaagtcccacaaatgataggtgaggtttgtgctgcttcccctaataggggacctatcgggatcgtagcaggcatcactaatctcaggcattcttcattgtagaggtcactatagatctcttgaagcactttgactattgggaggttcgcagaacttctccaacctcgagatcctcctggaagaatttcataagagaacctttaacgaagaagggacttgttgtttcaagtgatggataacttggtgagcagctttatcaggatcttgattaggaacaagtcggcaggagaggtaggcagtggctctataggggatcacagtcttaaatcctggtcccgtataacctccagaaattccattgatttctacagtaggacgtaacgcagattcttcagggctataagaagcttcgtaaccctgaggtcgaaaccctaagttttcttcgcattcccgaagggtatccgacttcggaagatcaggacgatcgctatccgaggggagagcaagatcatcataaaatccttcaatagctatagaattgtcagggtgatgcagagagctcagaatttctgataaagcacgattcgtattgtaggcaattcctcctaaaactcctgagtgcatgtccttgttcccctcttcaagggagattttcatggaaacaataccccgagctccaatgcttacgtaggggtgtttttcagaaaggaaacccccatctacgatcagaagatagtccgcgcgtaaagcttcttttttcttttctaaccaagtaaataatgcgagactcccactctcttcttcaccctcaattaaccaaataatatttagagggaagtttccttgagattcgtaatagtgctgtaatgcctttaaggtgtaaaaacattgtcctttgttatcagaggctcctcgggcatagagattgccattctcttctctaaggataaagggatctcccttccaaccatcagatagctgtgctggctgcacatcatagtggttatagagcataagagtagggctaagaggatcttcgcttttataggatgcatagatgatagggggatgcccaggcgtttcccagagctctacatcgaaaatcttattcacatgatctactaaaaaatgtgcacaattttcacaatcctgaagatgatcactatccgcagatatcgaggggaagcttataaattttgcaaactcttccaggaaatttgcactatttatatcaaaatgtttcgaatctagattcataggtttcccagagcagttgttgaaaataatatcacagtaacttaacttgtcttttgtcgaaaagaaaataagaacatagggtttagcgtgctttttagcatgattaagcatgacaaattagggattcagccctaactaatcagatgagttacagaaagtatgaaagctggtgatacgtatagaaatttcattattaagtcatgcaaagatcttcctgaaatagaaagtaagctccttgaggcggaacataagccgacaggagcttctattatgatgatcgtcaacaacgatgaggaaaacgtattcaatatttgctttagaacatgcccacaaacttctaacggtgttgcgcatgttctagagcatatggtcctttgtggttccgagaactaccccgtgcgggatcccttcttttcgatgacacgtcgtagtctgaataccttcatcaacgcgtttacaggtccagattttacatgctatcctgcagcttctcagattcctgaagatttttataatttactcagcgtgtatattgacgccgtgtttcatcctttgcttaccaagcaaagtttccttcaagaggcatggagatacgaattcaattccgagaatcatctctgttatacaggagtagttttcaatgagatgaaaggtgcgatgatgtcgggagaggcacggctctctgaggctctaaatgcagctattttcccttctgtgacctacggcgtaaactcaggaggagaacccagagagattgtaactctatctcatgaagacgtccgagcattccatcaaagccagtatagtatcaatcgatgcttgttttacttttatggaaatatcaaaccttcccgtcatttagatttcttggaagaaaagctactcagacaagctacaaagctagaaaagcaggcagtatccgtacctttgcaaaagcggtttaaggaaccagtaaggaacatcttaacgtatcctgtcgatcatcaagaagaagataaggtccttttcggaatttcttggcttacctgttccattttagaacaacaagaacttcttgcgctgcatgtgttagaaattatcctcatgggtacagatgcctctcctttaaaatctcgattgctgaaatcagggttctgtaagcagacagaaatgagcatcgagaatgatatccgtgaaatccccatgaccttggtatgtaaaggatgttctccagcaggagcccagaaattagaagctttgattttcgcttctcttgaagaaatcatccgcgaagggatatcagaaaatattgtagagggagcagttcatcagttagagttatctagaaaagagatcacaggatattctctaccctacgggctgtctctatttttccgctccggactattgaaacagcacggaggctctgccgaagatggcctgagaatccataacctcttttctgagctccgtaattcgttaaaaaattctgattatcttgccaagttgatccgcaagtacttcttagataatccacattttgcaagagtgattttacttcctgataccgaacttgttgctaaggacaataaagatgagcagcagcttttactcagtgttagtgaaaaactcacagacgagaataaagaaaaaattcaacaaaatgtacgagaactcacagaatctcaagaacaaaaggaagatctgaatggtattcttcctaaccttgctttggataaagtgcccacgtctgggaaggaatttcctttaattaaagaggggctgagtcaaggagaagttcttcatcacgaatgcttcacgaatgatattgtcttcatagatgttgtcttagatatccctccgctatctggagaagaacttccttggttgcgtttgctcgtatttttaatgttgcagctgggatgtggaggcaggtcttataaagaacatttagagtttttgttagaacatacaggtggcgtggacgtctcttatgatttctctcctcatgcaaataaaaatagtttcctctctccatcggtaagtatccgaggcaaagctctgtcatcgaaatctgagaagctctgtggtattgtcagcgatatgttaacaagcgtggatttcacggatattcctaggattcgtgagttgctgatgcagcataacgaagccttgaccaatagtgtgagaaatagtcccatgagctatgcagtgagcatggcctgctctgggaattctataacaggggcgatgtcttacttgactacagggcttccctatgtgaaaaaaattcgcgaactcacaaaaaactttgatcagaatatagacgaagcggttgtcatcctacaacgattatacaccaagtgtttctcagggaaacggcaaattgtcattagtggaagcgctcataactatcagcaattaaaagataataagttttacggtcttttagactacctgattgtgattcccgaaccttgggaaaatccaagtataaacttatatgtaacctctcgggggttgcatattcctgcacgtgcagcattcaatgctcttgctttccctattggcgatatagcttatgaccatcctgatgctgcagctctaacagtagcagcagagatcttagataatgtggtcttgcatactaagattcgagagcaaggaggagcctatggctcgggagcagctgcaaacctatcacgaggatctttctattgctatagttatcgagatccagaaattgcaactacctacaaaacgtttctaaagggagtgtcagagattgcttctggtaatttcactaaagaagatatctatgaaggagctcttggagttgtccaaggtttggatatgcccgtagcgccaggaagccgtgcttccgtagcgttttataggctaaaaagtggtaggattcccgtgttgcgccaagcattccgccgttctgtccttgaagtgactaaagaacacatttgtatggttatggataaatatctagagtcaacagttcaggagacaactttgatatcttttgcaggggaagagatgcttcgtaataatgttcttactctagataaagatttccccatagtaccagcaatttgagacttagtcttgtttttctaaagactcaataacagctaagttcgtatctatatcacatgtgtgtggaaacgaggtggctaagctttctataggggtaggctcttcaatctgatgggatgacgaggtttccaagccttcgaacttccttaatgtaggcagtacccggtattgaaagctagaggtcatatcgttgtaactttgtaccgtctggtttaaatttttgcctatcttctgaaaatgtgtgaacactacctgtaggcgacgatggagctctttacctaaaagactgacctcttgaatttgtttttgcagattctcttgcttccacatgtaagcaatcgtcttaagtagagcaagtaaagtcaaaggactggataagattacgtttgaagaagctccaatctccatcaattcaggagctaaccgaattgcatcattgaataagctctccccaggaagaaaaagaatcacgtattctggtgattgatgaaacttttcccagtaactcttggatttcagagtcttaatgtgctctttaattttatcaacaagatcccccttgtcaatctcctctacagaaaaataggagtctgaaatcggagctttagcatcaataattaaacagcgatcttgaggcagccgaataataatatccgcccgaaatgctccttgggcacttgtggtttgactgtcgtagtcacagtattttaacatcccggcaagctctaaaattctctccagttggatttctccccaacgtcctcgagatcctgggtgctttaaaatgtccgtgagaacatgagtttcatgctccaattttttctctacagcaagtaattgcgatatctgttcttttaaccttccacgatcttcggcatgcttagtttcaaatgtctctaaactttgcttaaatgtcgtgagtgtcgtttggataggagaaagtatagactgaaaagatttagacgtatcaccaaaataattctgagcctcttctttcatatctttgatgagtttgtgagaagaaagtgctagacgattgctgaaatcttcaattaactgctcttgatggcggctaagatttaaagaagtctgtagcagttggttttcatgttctaatttctgaatcttctctagaaacgcacgcttcttccttgcatagagagaagacgatacgaagactcccagaaaaaacacacacccagataaaagtaggcacgctagggaaacagggaggttcataacagatgctagctcttttttctatagatgattgaaaagatcggaaagcctactaaagtatatagccaagatacaaggaaaaagacttcaacaaaatgatctacaagtcctgaaaagaaaagacatgctgctaaacctatagtcactaccagcagaaaagaagaaacattaaagcggaaatgcttcactccaggaaatttccatggagaaatcatcagacccccaatgaaaagaagggcaaatgataatagacctacccgaagttgggcagggaggtctggaaagaaatccgaagcaagaaataaagctaaggagacaatacttgcagcagcagcaggaatgggcagaccaataaaacaataaggctttgaaacatctacagtcttttgagaaaagaggttgtaacgtaccaaccgcaacactccacacagagaataaataatcgaggtgatgagtagtagcgaagagaaaaaattcccaacataaatcccatcaagactttttatagcaatcaaaggtggggcaatgccgaaagtgaccgcatcagaaagagaatcaaactgagcaccaaaagcgctctcggctttcatgattcgagcgatcgcaccatcagaaaaatccgcgatcatagcactaataagcaagagagataagccctgcaaacgatggaataactctacagaggacgacgttcttaatacgcttttgaaaataataaataatccacaacaaagtccaaaagcagtaatagcgttaggtgtcactacgcgacgcttgcctcgtgcttctagatctaatcccgccatgtcaatttgccagagtttcttttgctcgtagcataatggattcttctaaaatcaacaagtttttgcagtcctcttgtctattaagatctctatctccaaaagctcctagagtatgatatttttaccgagaaagggagcatttttcaattgcaggaaaccatgacaattcctatatatggtagataagcgcataacgtttcactacatattgggttttttaaagaaaaatccttcttatgtttaaaggcgtttttctttctactttttaattataacaaaggaaaaagtactccaatatttatggttttggagtcctgattttctagtgcgcaaagaataanagaatctaatatttanatatcattttagggaaaagttatggtcgaagttgaagaaaagcattacaccatcgtcaaacgtaatggaatgtttgtcccatttaatcaagatcggattttccaggctttggaggcagcttttcgagatacgcgtagcttagaaactagttctccactacctaaagacttagaagaatctattgcgcaaattactcataaagtcgtgaaggaagtcctcgctaaaatttcagaaggtcaggtagtcactgtagagagaatccaggatcttgtagaaagtcagctctatattagcgggttgcaggatgtggctcgcgattatattgtttacagggaccaacgcaaggcagagcgcggtaactcttcgtccataattgccatcatacgtagagacgggggaagcgctaaatttaatcctatgaagatctctgcagctctcgaaaaagcattcagagcgacgctccaaattaatgggatgactcctcctgcaacactatccgaaattaatgaccttacccttaggatcgttgaagatgtcctaagccttcatggtgaagaagctattaatctggaagagatccaagatattgttgaaaagcaacttatggttgccggctattatgatgtggccaagaattatattttatatagagaagctcgtgcacgagcccgtgctaataaagatcaagatggacaagaagagtttgtcccccaagaggaaacgtacgttgttcaaaaagaagacggcaccacctaccttctgagaaaaacagatttagaaaagaggttttcttgggcatgcaaacgctttcctaaaactacagattctcaactgcttgcagatatggcatttatgaatttgtattcaggaatcaaagaagacgaggtcaccacagcatgcatcatggcggcacgtgccaatatcgagagagaacctgattacgcttttatcgcagcagaactcctcacgagttccttgtatgaagagaccttaggatgcagctctcaagaccccaatttatcagaaatacataaaaaacattttaaagaatacatcctcaatggagaagagtatcgcttgaatcctcaattaaaggattatgatctcgatgctcttagtgaagtcctagacctctctagagaccaacagttttcctatatgggagtccaaaatctctacgatcgctattttaatctgcatgaaggacgacgtttagagactgcgcagatcttttggatgcgggtttctatgggcttagccttaaatgaaggagaacaaaagaatttttgggcaatcactttctataatctgttatccacattccgctataccccagcaactcctacattgtttaactccggaatgcgtcattcccaactcagttcatgctatctttccacagtaaaagatgacctaagtcacatttataaggtgatttctgataatgctttgctttctaaatgggcagggggaattggaaatgattggacagatgtccgtgctacaggagctgtaattaagggaaccaatggaaagagtcaaggcgtcattcccttcattaaggttgccaatgatactgcaattgcagtgaatcaggggggcaaacgtaaaggtgctatgtgcgtatatttagaaaactggcacttggattacgaagactttttagaattgcggaagaatacaggagatgagcgtcgtagaactcacgatatcaatacagcaagctggattcctgatctcttctttaagagactagaaaaaaaaggcatgtggacactctttagccccgatgatgtcccaggtttacacgaagcctatgggttagagtttgaaaagctttatgaagaatatgaacgtaaggttgaatctggggaaatccgtctttataaaaaagtagaagccgaagtgctgtggcgtaaaatgttaagcatgctttacgaaacagggcatccttggattacatttaaagatccttcgaatattcgctcaaaccaagatcatgttggcgtcgtacgctgttctaatctatgtacagagattttattgaactgttcggaatcagagactgcagtttgtaatttaggttccataaacttggtagaacatatccgtaatgacaagttagatgaagaaaaattaaaagaaactatctcaatagccatccgtattttggataacgttattgacctgaacttctaccctacaccagaggctaaacaagccaacctaactcacagagctgtggggttgggggttatgggattccaggatgttctttacgagttgaacattagctatgcctcacaagaagctgtcgaattttctgacgagtgctcggagatcatcgcatactacgctattctagcctcgagcttactcgcgaaagaacgaggtacatatgcttcttattcaggatctaagtgggatcgtgggtatctacccttagatactatcgagcttctcaaagaaactcgcggagagcataatgttcttgtagacacatcaagtaaaaaagattggactccagttcgtgatactatccagaaatacggaatgagaaatagccaggtcatggcaattgctcctacagcaacgatctcgaatatcataggggtcacccaatctatagagcccatgtataaacatctctttgtaaagtccaacctttccggagagtttacgatccccaacacctacctgattaaaaaacttaaggaattaggactttgggatgcagaaatgttagatgatctaaaatattttgacggatctctattggaaattgaaaggatccctaatcacttgaaaaagcttttccttacggcatttgaaatcgaacccgagtggattatagagtgtacctctagaagacagaaatggattgatatgggagtttctctaaatctgtatcttgctgagccagatggtaaaaaactctccaatatgtatctcacggcttggaaaaaaggattaaagactacctattatttaagatctcaagctgcaacatcagtagagaaatcatttatagatatcaataaacgcggcattcagcctcgttggatgaaaaataaatcagcgtccacaagtattgtggtcgaaagaaaaacaacccccgtttgttcaatggaagaaggttgcgaatcttgtcaataacggaaaaaagaggagctaaaatggaagcagatattttagatggaaagctcaaacgggttgaggtaagtaaaaaaggattggtgaattgtaatcaagtagatgtcaatcagctagtccctatcaagtataaatgggcttgggaacattacctcaatggatgtgcaaacaactggcttcctactgaagttcctatggcaagagatatcgagttgtggaaatcagatgaactgtctgaagacgaacgcagggtcattttgttaaacctaggatttttcagtaccgcggaaagcctagtcggaaataacatcgttcttgctatcttcaaacatatcacaaaccctgaagcaagacagtatttactgcgtcaagcttttgaggaagccgtacatacacatacatttctctatatttgcgaatctttaggacttgatgaaggcgaagtattcaatgcctataatgaaagagcctcaattagggctaaagatgattttcaaatgacattaacagtcgatgtccttgatcctaatttttctgtacagtcttcagaaggccttgggcagttcattaaaaacttagtaggatactatatcattatggaaggaatcttcttctatagtggttttgtaatgattctctctttccatagacaaaataaaatgacaggaattggagaacagtaccaatacatcctcagagatgaaaccatacatttaaattttggaatcgatcttatcaatggaattaaagaagaaaaccccgaagtttggactacggaactacaagaagaaatcgtcgctcttattgaaaaagctgtagagcttgaaattgagtacgctaaagattgcttacctcgaggaatcttgggattaagatcttcgatgtttatagattacgttcgtcatattgcagatcgtcgtttagagagaattgggttgaagcctatctatcactccagaaatcctttcccttggatgagcgaaaccatggatctgaataaagaaaagaatttctttgaaacccgggttaccgaataccaaaccgctggtaatttaagttggtaatttcacctctttttcaagggagttttgagagatggtcttagatcgtctctcaggatttttcagctttcccttccgaagaaagtccttagaaaaaacttcaagaagctttatactttcctaaagcaaacagtctctgatttctgctttttatgaaaccccaagatctatccccgccatttttatggaaagaacgccgtccttgtattcaagatggagttctctatgttcctagacattactttgaacaccagaatttttcaacaagctaccatcaagaattttttcaaaatcatacttctatagcttgtgaactatgctctggtaatggggattgggtagttgctcaagcgcaaaaagatcctcaagtactttggatcgctgtggaacagcgttttgatagggtaaggaaaatttggtctaaaatgatcaaccaccagatccaaaatttaaggattgtctgtggtactgccgaaacctttttccagtactatgttcctgatcagtttttgcaacgccttgttgtgaattttccagatccctggccaaagatgcggcatcgtaaacaccgtcttctccaaccctcattcgttcaagaaatctcccgctctctccaagattccgcagtttttgctttggctaccgatgataaaacatacctattggaatccatagaagcgctgcaaacacatttagctccaagaatggaaacaccatattatataaaaatgacagatacttatggaaattcttggtttgaaaacctttggcggacaaagggacaggaaattttttatacagaatttataaaaaaggctgggatatagctgacttgaacagctgaccttcacgatgtcaacgtgacgctctaaccaactgagctaataccccgagttcagctactatcctaactagaaaatggtatctttgcaataggcttcttcatgtttgcatatcgtaccctgcttacacataatgtagtccaggtatcacacgaaatttttaaaaccacagttgttcccggagatacagtcattgatgcgacctgcggaaacggtaacgacagcctttttttagcgcgcttgcttcaaggagagggaagacttgttgtctacgatatccaaaaagaagcgttgtccaatgctttactattgtttgaaacacacttgtcagagcaagaaagaagtgttatcgaaatgaaagagcagtcgcacgagcatattttagagaaagatgtgaagctcattcactacaacttgggctatcttccgaaagggaataaagaaatcaccacattggcaagaactacagaaataagcttagaatatgctttaaacatagtccgccccgatggactcattactgtcgtatgctatccagggcatccagaaggagaaaaggaaacacatagtgtcgagagcctagcacaacggttacatcctaaggaatggtgcgtgagtcattttatgtagcgaatcggtgtcgagcccctagactttttatttttcagagacaggggagtgaatcttcggttgataagggataatgcgaatctcgtgttccagatcaatgccttgcgtttttaacgttgattggatgatagctatgagttgcttgacctcatcagaagtggccttgccagtattgataatgaagtttgcatgcaacggagaaatttgtgcccctccgattgctaatcccttcaacccaggctgcgtcaataagcttgccagcagaagttccttcaggattacggaaaatacagccagcagaaggctgcgtatagggctgcgtcatgagccgatgttgcagaatggatttcgagtggtcggcagaaacttgcttttttgaaagctggaaggtcgctgataaaataaactcttgttgtctatggaagcgcgaggagcgatagctcagctctaattcttctacagaataggaacaaagctctccttcagagttgattgtctcaacatttctcaccacggaagatatgtcgctttcatttgtacctgcattcataaaaatggccccgccaaccgacccagggatgcccgcagcaaactcaagtcccgaatatccattataggcagtcgctttacctaaagctgcaaaggaaagacccgaatacgctttaatacgagcatcctctaggaactgtttaccatagattgcattgtagagtacaaagccatcaaaaccacggtcatcaaataaacaattagagcctttccctatgatgaggaagggatagttgattgaatgtaggaaacggataacttcacgagcctcctcaatagtatggatggctttaaagtaatttgcaggtcctccaatgcggaaagtggaatacctattcagccacacactacgacgaacaggaaaaggaaaatgcataggcgcagcttctttcatttttagaatcccttggtctaaattaatcagattgataaagaattttcatttagagatgaatctgtgaaaatgtcattcaaaatcgcctgaatgaaaggacaggcttctgaataactaaactttttaactagacgaattgcttctgcaataagaatggccttgttaatgggtgggctgtaaaaatgctcaaagagagtcaggcgtaggacatttttttctacaagatctaaactatcaaaagacttatttttaagagcattcccaataattagatccaattcttgtgatttttctaaaatgcttttagtctggtttaaagctacgagtacgtgtttttgagacaccgcagtttgtgacataagcaaaggaactaaactgtcctctgctgaaggagccatatctagggcatacaacatctgcaagatgatttctctcatcttttgctgagggaattccttcgagatcgaaataggggaccccgagaatttttcaggactcaatgtggccatgacaagcaaccaaaaaatagttaataatacacatttaactgctaaagaggtccttagctaaggagttgtgagaaagaaacaaggttatctattagaaagttttaattgcaacaaaaacttcttagttgaaaaatgtactttgttttcggaactcacttattttctgattcagagaaagagttgctggagattttttatataaaaatttttaatttctaaagacgacaaggataattatgagaaagggatttccgttgcttttcttttcctaataccctaagatagccttcttcttgtctagaacggataaaagatcggattgtcttttctggaacactcagtgctttcagaccatagcaattgtcttaacaggaaattgagatagagtgtggcattaaattttaagattaacaggcaaataagagctcctaaagttcgtctcattggttcagccggagaacagttaggaatacttgctatcaaagatgctttggatttagcccgagaggcaggtcttgatttagttgaagttgcttcaaatagcgagcctcctgtatgtaagatcatggactacggtaaataccgttatggtctgacaaaaaaggaaaaagatagtaaaaaagctcaacatcaggtgcgcataaaagaagttaagcttaagcctaacatagacgaaaatgatttttcgactaagttaaagcaagcgcgtacgttcgttgaaaaaggaaataaagtcaaaattacatgcatgttccgtggtagagaattagcttatccagaacatggttttaaagttgttcaaaaaatgagtcagggtttagaggatattggtttcgttgaagctgaacccaaactagcaggtcgttccttgatttgtgttgtggctccaggaacagtaaaaacaaagaaaaaacaggaaaagtctcatgcccaagatgaaaaccaataagtctgtttcagcacgttttaaattaacagcctcaggccaattaaaaagaactcgtccagggaagagacataagttgtctaaaaagtcttcgcaagaaaaacgcaacctatctaagcagcctcttgtagataaaggtcaggtaggtatgtataagcgaatgatgcttgtttaaaggtaaggaaagttagttatggtaagagcaacaggttcggtagcttctagacgtcgtcgtaaacgtatattaaaacaagctaaaggtttctggggtgatagaaaagggcatattcgtcagagtcgctctagtgtcatgcgcgctatggcattcaattacatgcacaggaaagaccgtaaaggggatttccgtagcctttggattgctcgtcttaatgtcgcttcaagaattcatagcctctcttatagccgtttaatcaacggcttgaaatgcgcgaatatttctttaaacagaaagatgctttcagaaatagctatccacaatcctgaaggttttgcagaaattgcaaaccaggctaaaaaagctttggaagccacagtttagggattagaatttctatggaaatgaaagaagagattgaagctgtaaagcagcaatttcactctgagttagatcaggtgaactcttctcaggcacttgcagatcttaaggtccgctacttaggaaaaaaaggaatttttcggagtttctcagaaaaattaaagcaatgtacagataaggcaaaactaggttcccttatcaacgactttaaaacttatgtagaggatcttttacaagaaaaaagccttgtgcttcttgcttcagaacaagccgaagccttttctaaagaaaaaatagatagctctctccctggagattctcaaccttctgggggaagacacattttaaaaagtatcctcgatgatgttgtcgatatttttgttcacctaggattttgtgttcgagaagcccctaacatcgaaagtgaagccaataattttaccttactcaacttcactgaagatcatcctgctagacagatgcatgatactttctatctaaatgctacaacagtactgcgaacacacacatcaaacgtacaggctcgtgaactaaagaaacaacaacctccaatcaaagttgttgcccccggcctatgttttcgtaacgaagatatttctgcacgttctcatgtgctcttccatcaagtggaagctttttatgtagatcacaatgtaacgttttcggacttgactgcaatcctcagtgcattctaccattccttcttccaaaggaaaacagagttacgttttagacatagctactttccttttgttgagccaggtatagaagtagatgtctcttgtgaatgttgtggcaaaggatgtgccctttgcaaacatacaggttggctggaagttgcgggagcgggaatgattcatccccaagtactacgtaacggaaatgttgatcctgaaatctattctgggtatgctgttggcatgggaatcgaaagattggcaatgttaaaatatggcgtctccgatatccgactttttagtgaaaacgatttaaggtttttacaacaattctcttaaggaagaatggcagagcggtttaatgcacctgtcttgaaaacaggagacctgaaagggtccgggggttcgaatccctcttcttccgtttcctttttattcacgtttattccgatagaggaactttgtggctaagagccacgagtttctggtattcaacgagttctttcttttttcttttgatttcttgccttttcaggtttcatagtttttattaacttttaattttctctttattaattatttatatctaaatctattatttttatttttaaactaattgatggttaatttgtttttataataaattagaaagacgatctcataaaaaataatctaacttttttggttccatcgaggaggtagaatgaaaaggtctcgacgtaacttcgaacaggctttagaaaatttagaaaagctcaaagagatttctttagctacctcgaatgattcctacctaaataatccagcacgcttcaaccagagaaaacaaacaggctcttctgtcatggaaatgaaagaggctctgaaaaatgttgaaaattatctactcgaaatcagctgtgtttcgaaaagtcatgcagataaagctcttaaagaatcagattttttaattgcaggtgtgcaaaacgtcttttcctttttagagaaccaagaagacctctataagtctttactagacgaatattctgaagttactaaggcttatgatgaggtaaaaaagaatcttaaagaagtcccaacttatgacctctcgacagatgaagaaaccgaggaacacaaagaacccgagtgctttttaaataaccttgttgaagttaagcgggaccgttcctatgagcttttctacatgctagatgagcaagacaaacgcttttataacgatgctcttgtccagatcatctataagcaaaataaactacacgaaactgtaaatgaaggtgaccccctaactaaaacactcctctggaatagtgaagaagttaaaaacattgcctcttcgctggttatcgtaaatgatatgcccttgcgattgttttatcagcgtgctttaagccatttagacatcgaagctgtggtcaaagttcataacgcagtcatggcgttgttcttctcaagatacgaagctacaatggtcttcaaaagccctaagaagcataatatatggtactttaatgactttttgctctttttgagagaagcatggaaagacttaaataataacgtgattgattctcaagagagaaaacagacgaaacttcttgcttccgctttaagtctcgggatctttgaaagcaaactagtatttgaagaggcatctcgttatctctacttcaatattcaaacgaaattagaaaacgccaacgggaagaagcctctttcaccaggacaatatcttacagacgcttatgaagaacttcatcgtcttatctctaaatatcctaacgggcctctttttaaagctatggatagagttttagaacatgaatcccgtccctatgatcctatgattttaggaatcctccctagccttgaaggaacgttaaagctccacgggaaatctatagatatcatacgatctcccagtcctgtgacccaaagctcgattttgtatgctaattgtaatgaggaattcttagggtttcttaatgctaaagcacatcgcagtgaggtgactttagttctaaatattcagaatcgtatatcaagaaaagaacgtgcgcgaagccgtgttatcgaagaagctttagaacaagaagaacacgccccctatgtccacgccttctctttccctgaacccgaagaactcctccagaatttggaaagtattcatggagatattgaaacttttgctgatttcttttctattctgcaagaagagtttcataaaccccttcttgcttcatcattttttctaacgaaagaattaaaagagttcgtaggtagcttcttaaaagaaaaactcacggcgttgaaagacattttctttgctaagaaaaaaattctattcagaaatgataagcttttgcttctacacctcctctcgtacctaattgtctttaagttaatagaacgtaccaatcccaactctattgtcgtcgtatctaaagatgggctggattatgtttctgtctttattgcgggatttgcgttcttttctagggaagcgttttgggatgaacatagcttgaaactattacttacgaatgttttatctcctacactcgtagctagagatcgtctggtcttcgtatcccatattgaactcttaagtaaatttgtaaactgtctaaagaaaaatcgtcagggattttctagtctgaagtctttcttcaaagatgacattgaaggttgggagttcaccgggtacttgcatgaactcactgaagtttcgcataagcataatttgtaagtagaaagagtactataagaggaaaagccatcacaggaagtgtgggaagaacgctgctactggctaagacgattcccgcctttaggaagacaaagaaaatatttaccgtccctaaagggatcaaataggctagagtgaccgttggtgttctactaaatctcaaacagagataggcagataaaatgatagccgccatacaggcaagtggtgaaattaagacgtaatagaattgagccagaagagaaagaatcctttgtggcacttgtgtcgagagtcctaaacctgtagcgttccaagggatggccttgaaaaattctgaaagacggtttttattccctgcagaaaatagcttggaaaaaggattttcatagaaattaaactcgatctcaggaaactccttcatatcgaaaaactccttaagctcaagattttctgaatcattagcgaaaaattgtgtgacatttaaaccaatcggaagagagagggtggtgaacgctaacttttccatggtgtaaatggttttaggatctttgatccagaagacattatttaaagtaagcgtcttaggctcaatagaagaatataagagtactgtttgatctttgaggtaaagagcaggaatttttccctgctctttatctgtcgtgcctctatccatattttctttagtaatagagattttctcgcaaataggatgcaaccactggaaattcgcatagagcaccatcatgatcacagctcccgaaaggagaagaggatgcattagagattttaaggagagaccagaagcttgtagaagaataatttctcgcttattttgcatagcaaaaagcgtgcttgttgttgctactgcaacaagctgaggcatgaggaactctgcttttaacgaaatctgtgctaggtagtacaatatagagagcttgacagaagctccagaagcagctgtagaggcccctttaagggtatgcaaagagtgatgaatggaagcatagaatataagagcaagtaccaaaagagaggtaagtgcaaaccaaaatctagtgagtaagtggcgtttccaaatcaacatacgttaagcataccctcgactttccctatacgcgcgagcagcaaagacaacccaagagaccaattgggggaagacaaatagcatgaaggctaggggtagattttttgtatttttcccaacgataagcagaataaggtccaaaatagggaaaatgaaatataaagctatagattttcgaaatctaggtttatgaattccaaggatcatgccagcatacgtcagcgtgatacagagaaaaccaatagcaactcttcggagcgtttcaggaagatgcgagtgctttagggactgtttaacaagctgcttccaaggcagatagtctgtccgtgtctttaaataagattttcctgcaaacaatgttgaagtaatcttgggaattagcaattcatctaaggtttcaatatagaatctttgagaagatggtgaggaagattctgttaacgagtctggaagctttgagataaagaccacatccttagcttttacagtatctttagtagtgtcagggatgatactttttataattcccacatgggagatctcattatttccttttagagctacaatgacattgtcaaacttgcttttagcacaatgatctacagcgatgaaaatacgattgttttcttttttctgtagagtctgtaagagcagggctggtgatgtcattgccatgtttgcaatttccttgcatgtttgatagcgacaaattgaagcaagctctgagcatgtgtaaaagtttaaacagcaaatggctccagaaaccatcaaaacaggaaacatgatgatgctttgagaagctccagacgctcttagaaacgtcatgtggttgttatctgataatttacggaaaagagagaatgctgagacaaaacaagagccagggagaataaagggaagaaggtaggggatttggtaagccattaaacgtaagactgtatcgtaaggaacgtctttagcaatgtaggcaacaatttcctgtagagagctaattatagaaatacaaattaagcttaaggtacagaaagctgctgtttttaagtaacggaaaatgagaactttccataaaataggcatggcttacctggtaattacaatttcttagatgccttgatagagtgaaagagtcacgatctgttttgaaaaatccctagcaacactattcttttcaatgatttttatataggcgtataaaatggtactaagctcagatttactccgtgatgataagcaattagatcttttttttgcttctttagatgtaaaaaaaagatatttgcttgctctttctggaggaagcgactctctttttcttttttatctacttaaagagcgaggggtttcctttactgcggtacatatagatcatggttggaggtctacctctgctcaagaagctaaagagttagaggaactttgcgctcgtgaaggtgttcccttcgttctatatactttgactgctgaagagcaaggagataaagatttagagaatcaggcaagaaagaaacggtatgcttttctttatgaatcctatcgacaattagatgcgggaggaattttcctcgctcatcatgccaatgatcaagcagaaacggtcttaaaacgtttgttagaaagcgcccatttgactaatctcaaagctatggcggaaagatcatacgttgaagatgtgttacttttacgacctttgttacatattcctaaaagctcgttgaaagaagctctagacgctcgcggtatttcttatttgcaagatccttcaaatgaagatgaaaggtatttaagagcgaggatgcggaaaaaacttttcccttggcttgaagaggtctttggaaaaaatattacctttcctttactaactttaggtgaagaatcagcagaactatccgagtatcttgagaagcaggcacaaccatttttttctgccgctacccatcaagattctcaaggagagcttccctgtccagactgcctcattcaacaagcgtttttatgcaaatgggttatgaagaaattttttaataatgctggaattgctgtttcaaggcattttttgcaaatggtttatgatcatttatctcggagttcttgcgcaactttgcgcatgaggaataagatagtaatcataaaacctggagtagtagtgatagattagaaagtatatactcattatcttctctatatgtgaaaaaaagagagaacactaggtcattgtattagtgcctgttcatattttttatttggctgttatagtttaaaatattttttctaaaacaaaataataaaaaatatgttatattgaataattatccgtctgattgattagcttagttgtgaagtttatgtcgaaagataagaaaatgaaacctgaaccgaaaaaaaatttccctacagtctttttttttcttttgtttggcgtggtttttggtgtagtcgcatttcaaaattttctagctggaaagaaggctagagtcggtttcagtcatcaaatcgagcaccttgttaacttacgtctgattgttccagaagatagccataagatagctcttaatgacaacttagtttcttttggcggacgttttcgtgatgtccaaactcaagaaggacaactacgttatcattatctagagcttattgatcagggccatcggttagaccttgatcttcaagagacgagcaagagtcttacgaccttagggaaagaggtcacgaattccatactttggttttctgcaatttctggatccccgattcctgaacaagggtatgccatttcttatccgagtgaagtcagcggctctgtattgacagaacctctcgttgttacaggacctgcaactccacagctaatcaatctccactctctgcaggagcgttatcctacactatcacgatctccagaagctttacgcacctatggatccgatctttatgagttaataggaaaatatctatctcctgttttaggaataggatctgagacgctaaaaagagaacttaaagatctctaccagcaagtggaagtctccttaactcaggagacggatacggaagcagcctacaccctttatgggcaggttcttagtactttgaacaggatctcttcttctttagtcgtgtctgagggaggagaacgtttttctcaactccgttctgtacgtctctatcgggaggagtggaataagtatcataaattggtggaagcgcgcgatctgaatcaagcgcaactagagaagctccgtggtgaattaagccagacagtttggtattttaataaccaagagctctcctcccgtagtttagagaaacaagatcctgaagtttttggccattggtttgccggggctaaggaagagtggactgcctttaaatttaaccactccctatcatttaaagctccagaccaaccaagaaatctcgttttagagaaaacatttaagagccaagagccttcgccacatnatttaggatatcttttcacantcttacctatcatcttagttctactctttgtctacttggtgttctctcgtcagatgagaggcatgagtggttctgcaatgtctttcgggaaatccccagcgcggatgctccttaagggacagaataaggttacctttgctgatgttgctggtatcgaggaagctaaagaagagctcatcgagattgttgacttcttgaaaaatcctaataagtttaccagtttaggggggcgtattcctaaaggagtcctcttgataggacctccaggaacaggaaagactttgatagctaaggctgtatctggagaggcggaccgtccctttttctccattgctggttctgattttgttgagatgttcgttggagtcggtgctagccgtatccgtgatatgtttgagcaagcaaaacgtaatgctccctgcattatctttattgatgaaattgatgctgtaggacgtcatcgtggtgccggtattggtggtggtcatgatgaaagagaacagacattaaaccagcttcttgtagaaatggatgggtttggcaccaatgaaggtgtcattcttatggctgcaacaaaccgtcctgatgtcctagataaggctctattgcgcccaggacgtttcgatcgacgtgttgtaatgaaccttcctgatattaagggacgttttgagattcttatggtacatgccaagagaatcaagttagatcctactgtagatcttatggccgtggctagaagtaccccaggagcttctggagcagatttagagaatttattaaatgaggctgccttattagcagcacgtaaggatcgaactgcagtgactgctgttgatgtcgctgaagctcgtgataaagttctctatggtaaagagcgtagaagcttagagatggatgccgaagagagaaaaactacagcgtatcatgagtctggtcatgccgttgtagggctttgtgtacagcatggagatcctgtagataaagttacaatcattccaagagggctctctttaggagctactcatttcctaccagagaaaaacaagctcagctattggaaaaaagaactttacgaccagctcgcagtgttgatgggaggtcgtgctgctgaggagattttcctcggagacatttctagcggtgctcagcaagatatatctcaggctacaaagttagtgcgtagtatggtttgtgaatggggaatgagtcctcagctaggaaatgtgacttatgatgagcgttccgatggcttgacaggctacggtggttatcatgaaaagagctattcagaagaaacagcaaaaactatcgatacagaattgagaatgcttctagatgcggcataccaacgtgcgttagatattattaatgagcataaggcagaaatagagcttatgactcagatgctcattgaattcgaaactcttgattctaaagatgtgaaagaaattatggaccatacttgggatcctgagaagaagagagcacgtctaaaagaagaagggatgctatttaaaaagtcttccgacgatcttcctcctcctcctcccaaggaagacactctacctggtttggggtttaatgctacgtaggtaggaatacctcaagatgcattctgatccgaaaagaacctaggaaatcctcctaggttctttttttgtctcaattgaatcagattagagttagatgtaatcataaaaaaagctagtctttctaagaagactagcttttcatgttaagcgtatagaatagaatgtatgtgaaagattattctagagttgctttatggctcaacttaagttgacctttttcattgatgcttaagagttttacatcaatgatatcgccttccttaacaacatcacttatattttctattcgctgtctagaacactcagagatgtggcagagtccttcttttccggggagaacttcaacaaaggctccaaacgcaactacggaagttacgcgacctctgtaggtttttccaacttcaacttctccaactaaaccttcaatgatttctttagctttattgatagctgatgctgaggacgcagagatgctaacaactcctaagtcgttaacatcaatttggacgccagtctcttcaatgatctgacggatttgcttgcctcccggcccaattactgaagcaatttttgttggtttaatttgcattgtttcaatacgaggcgcgtattgagataggtctgctttgggagctgaaagggcttcgttcataatatttaaaatatcattacacccttgcttcgcttgggaaagagctttcttcatgatagctggagtgattccttcaactttgatatccatttggaaggctgtaattcctttaccactccctgctattttaaagtccatgtctccaaggtgatcttcaagaccggaaatatcagaaaggataatcgctccttgatcatcaaggatcaatcccatagcaattcctgcaataggagaagaaatagggacgccagcgtccataagagcgaggcaaccgccacatacagaagccatggatgaagaaccattagattctgtaatattagattctatacggatggtatagggaaatgtagcgctatcaggaagagcatgacttaaagccttctctgccaatttgccatggccaatttctctccttcctggagagccgattcttcctacctctccaacagagaagggagggaagaagtattgtaagtaaaattttgaaagtccttcaccattcaaatcctcatagcgttgagccattgcctcactgcctaaagtacataccgcaagtgtctgagtctctccacgagtgaagaggcagcttccgtgagtacgaggaaggtaagaagtttcaatagtaataggacggactgtagttaaagaacgtccatctgcacggatctctctatctcttatgagagcacgcatcgtgtcagattttaaagttttacatgccgctttgatgttaaaagaagagaaaagatcatcatcttcgcgctgtaatttttctaaaatattttcttcaatctcatgcgcagtagctgcatgtacttttttatctttaatattaaagagttcagtaaacttgtcttgcgcacactctttcacagctgttaaaacttctgcaggaagaggatatacagcacttagatttttagattttccaacttcttcttgccacaactgtaatcttttacagatggtaacaatatgcttgtgaccaaattctatggcatcaagtacttgctcttcggtaaagaaatcgcaatgaccttctatcattagaatagcgttttctgttccagctaatacaagatctaaagtagaggatgctaactcagtttttgtaggattgatgacccattggttatcaatacatccaatccgtactccagcaacaatgttgctctgtggaatatctgaaattgctaaagcagcagatntgcgcagatagcaagaggatcaggtaaaacttgaccgtcatacgaccatacataagataaaacttgcacatcttgcatgagtcggtaggggaaggaaggacgtagagaccgatcaatcaatcgagaaactaaaatttctttttcagaggggcgtccttctctttttataaatccaccaagagttttccctgtggaagagaatttttcttggtagtccactcgtaaaggaagaaagtctactttgtcatcaagatctacagcgcatgcacttgcaaaaacacaggtttcccctgaacggacaagaacagctccgttagcttgacgagcaattttccctgtttcaaacaccaatattttacttcggtcagattaatagaaatagtttgaaaattcatgaaggtctcctgttagatatttgtaaagggaacgaaaaaactacttacgtagattcaatcttgtaattaaatttttgtacctttcggtatctgtagaattaagatactccaagagctttctcctttgaccaacaagcttaagcaatgctaagcgggagttttggtctttaggggatcttttaagatgttctttcaattccttgcganatgttccgtgagaatagcaatttgtacatctgccgatcctgtatccttttcatgaagttgaaacttctttgtgatttcttccttagttcctttatccaaagacatcggatgtctccttaaaataattgccgcaaaagctgattatacttgagaacatggttaatgtacaccttttggtagggtaagacttttttttctataaacaaagaaaaaattaggggctgtggaaaggtctgagattgcttcataaaagcgttttattgatattgtatattgttattttttttgtttttagaactcataatggaataaataatattatttagaattgggtggagagaagcttatcaatatggaaaaagatattttttttatgcaacaagccttcaaagaagcgcgtaaggcatatgatcaggatgaagttcctgtgggctgtgtgattgtcaaagacgataagatcattgctcgtgcgcataattcagtggagaagcttaaggatgctacagcccatgctgaaattttatgtatagggtctgcggcccaagatttagataattggcgtttgttggataccgtcctttactgtacgttagagccgtgtttgatgtgtgcgggtgcgattcaattggctagaattcctagaattgtctgggcagctccagacgtgcgtttaggagcaggaggaagttgggtcaatatctttactgaagagcatcctttccatacggtttcttgtactgggggcgtgtgtagcgaggaggcagagcatctaatgaaaaaattttttgtagaaaagcgcagagagaaaagtgaaaaataaaattgttacattattagatcagctctacgaggatcaggagtcacgacttcagaagttaggagaggaaattgttcctaacctcactcctgaagatttattgcaacctatggattttnctcaattggaagggaatccggcatttcgttttgaagagggtgtcttatcaggaattggtgaggtgcgagctgcgatttttaacggcgctctctcaagagaactagaatctcaaagaagtagtataggggttggggatcttttcttttttacaaaataggatagccagaacgatcgcaagcatcgatgcgaggagtagaaggaaggcccctgagaaaataagaatgcaacagtagaaccctaagacgaacaagaatccccactttattgagacggataggggagtgggtcctatggtaaagcgcttttctggatctaagaagatctgtactgtcaaaacaccacagataatactttccggaccgaagaaagattgggagctgtgatgagagccatgaatccccagagaacagctcctataatgagtgcctggcctgagattacaacgagaacactgaaggctcccaatttgcggatgaggtgttggatagctttatagaaaagaaaaaaatccaagacattgcgcaaaagaagtctttgggtgatttcgaagctttgatctttatttagggatagggaatctgctgtgattagggggtaggtgagaaactgccaaaaatggtgtttctgtatccctttaacagagagggctagaatttcgaggagcccaggaattccaaaaaatttatttatgatataagagaaaaacggggcgatacacgaagtaactaatataactgaaggaagtttttttaaaagcttggataggttggggaagttattatgtttatcggggaaaatcaccctcatggaggctttacctgcaatctgacggtcaggcccccatagtagaggatgaattgttttattagaagtctattgtcatagtttagtcagagggtgagttcgttagatttgccttgattgttagttcctttagggtagagagcatggagctggtggcttgtagaatttgcatggattctatggttgttgagtttacagacttttggtttgcctgtgctctttgttgtgccgaggagagctcctgttgtatcatttgacgatttgctgagatctgttggtttgagctttggtaggcttggatttcattttggttcttatattcgtcatcgcttccatcttttttctgtagatcgggtactttaagtaaggggaggttaatgagctctttcactctttgctgttggactattgtattatcttctagtacggctaagattgatttgccgtactctgttgtggattcagagagccgaagcatgacggagatgcaaaagtagaatgcagactgtttgttaattgtgatggagtcagaaattacttttgtagaatcaggaatcactttatcggctttagttgttgtattagagacgggttgtatcgacatgagttcctctatacttagatgttagcaattaggcttacaatttgagagaaggtctggataagagcctgtcctacctgtaaggattgttggatgatgttattatttgtgttcaagttactggagattacctgagccgcgtttcctaaactggaaatttggttttggatagcttgccgagaagctcctatcgcttggttatcggattggatgttttgtagatagctagaggagttatcgttcagtttatttttaggaatactgacgtattggtataaggcttcttggttatttaggtaggtttgagctgaagagtttgcttggagttcttgggcaatgatggagaggttatcttgagcaactaatacggattgatagacgtagtaaacagtaacaatcagagggtttgagtctttggagaattttgcaatgatatcgtcagcagttgctgtattaggtcctcctgtaattggagtgccaggaacatttatggctgcttgtagaggttnttttgctgatagagggtctatgatccacatattcaacctaactggttttcgattttaaaatgtttacggatggttttaattccttatcctaggggtttattcagttggtttacggtgcttcctatggagtttgttgttttgataaatgaggagtcttgtgaggattgctgttggatgatgttaatgtttgtagaggcgtgtgagaggataatttgaccgttttgtcttgttgttacgagttcgtcttggatattagatctttgtgctgagtagttttggttctgattttgtactctagtgatctcgtcttcttttgctccagcacttactattgcatacttgatttgattagtttcttggtttaattgttgttgaatattagtattgtcgtttaattgttgtgattgagtcagaactgtttgttgtcgaatttcaattgcttgtaaaagaagctcgtaaatgctaaaaagcacagcacctattttaggtgtatttagaggctcaaggggaggacgagaactgtttatagtattaactgtgggaagagtccctaaggtggttatagacataataaaaaaattcacttttgtttagttttattctaacaagaagaaaaacgtttattaaaataaaatttttatgatttttctttattagttgttattaagtgttttgtttttttataattaataagaaattttggcggcccagagaatattgggtactagattggagtaagaagagcttaatatgggtcctaatggaggcatttgtagactccctagttgtggtataaatctttagctggagaggagaaggacgtgtctgggaatgagtgcaatgactatccagaagtttttaaagatgacgtaagtgcttacgtattggtaacttgtggtcagatgtcttctgaaggcaaaatccaggtggagatgacttatgaaggagatccagctgtgatcagctatttattaacaaaagcacgagactctttagatgagtcttaaactattcatttattgggatgttgaaaccgatgtacgtgcttagcaaacgtctttatcgatgggtaaatcaactaattaaattaggggatttggtaaagaactcacgatcattttctgtggaatgggtttttatcagcgctctgttgttgatttttggatgtttaggctgcgcatctgttgttaaagtttctttagttccctttctattactattttcgtttttagcgtttcctctgattttatgttttcgtgggaagggctatgctttgcttctgggggtttttgtaactctttatgtcgctaagtatgttgttggagagaccttatatgtctctttttggttatctggcttaggagtctcctttttgcttgcttttgggcttttcctccaaggagtgtggcttgctcaagaagaagagatggtaaaggggaaggagcaactcaggctttctgaggatttggatgcacaacgtagtgcttatgaagatttgctgctgacaaagagtcaggagaaggagtttttagatgctcgtgctcagggtttagatcgggaacttactgagtgtcaggagcttttgaaagcggcttatcagaaacaagagtatttaactatagatttgaaaattctagcggaccaaaagaacagttggttagaggattacgcggaactccataataagtatatcgagttggtttccaagaatggggatgttgtatttccttgggtagcagagccttcagtaggtgaaagtcagggctcagagagggtggatgtttctagatgggtatcggctttacaggagaaggaagagagtttagagcgtctacgaaatgagattttagtagagaagcagcgttgttctgattatgaacaccgttgtcaagagttgggccttttgttgcaaaatttcactgctcttgaaaggagatgtgaggagcttcaaaaccttttaaatcagaaagaaacgcagataaatgagctccaccaattggtctgtaaatctgaagagaaggtctctgtggaaccttctgcacatgctgaaacgagttgtgtggaagaaaaacagtataaagggttgtattctcagcttcaggagcagtttctagaaaagagtgagactctttctttagtaagaaagaagctttttgcggttcaggagaagtatttgactttgaagaagaaggaagaactcacaaagcaagacatatcttttgatgatatctctatgattcaagggctcttagagcgcatagagattttggaagaagaagtcagtcatttagaagagttagtatctcgtagcctgtctctgtaattgctatagtgtgttcccattgtgcgctgggttgattatcgcatgtgcgtgcttcccattgatttttggggtctacaacgccttctttttttcctacattaatcataggctctatagtgaagatcatccctggtgctagaggaatcatggagcggtttctataatgtggcacgtaggggttttcgtgaaactcaattccaacgccatgtcctacaaattggtctactacagaaaatccataggtgtctgcacgtgcttctatagcttctccaatttcacagaggggaataccaggttttaaaatggctatagaatcgttaagacattccaaagctgcttggcatatcttctttttaatttctggcacctctccgatcatgaccatgcggctacagtctccatagtagccatccacaatgcaggacacatctatattcatgatatcaccgtcttttagtgggatatcgttaggaatcccgtgacagatcacttcgtttaatgatgtgcagattgtttttggaaatggtggtgagccgtaatggaatggagcggcaatcgcgtcatatttcttatggagctcttgggagagctcatccaactcatttgtagtgacgcccttttgagatgctttgcatagctcatctagaattcttgctgtaatttggcaggcgttatagatttttgctttctgttctggggttttgagtaggatattatattgcgaggcgtagtgttgttttaaggcttctggagacatttttgggggttgagggtagtggcactgtttccatttacgtccactgccgcaccagcaagggtcgtttcttttcataaggatcacccgatgtaaaagcctatattaaacgctattgagatccctttcaacataaggtttaccgacataagtagtaaagcaataccgaagagtctctcgagtgcgaggagtccgaaatttccagaaaggcggtcaaagaagctagagcatagcagagtaaataaagaaaatgcccaggcgataatcatagcagtaaaaataatttccctagagtagattccctcttccatgtagctaaggagtgctgtaatcacagcagggcctgtgattactgggaaagctaaggggaaaaatataggttctgttttggaagtatcatctttagctttttctggcatgggtgccagcatcatttttatagagactgtaaagaggagaaagccgcctatgatctgaaaagcgtagagagaaatatccaagaattggaagaagcttcttccaaaagtaacgaagaggatgagggctccgagagcaaaaaggcattctcttaggatcacccgttgttgtttctttctagaaaagtttttgagcaaagcaacaaagacaggaatggagcctggagaatcgaacaggacataaaatagtaggctaagattgagtaagatgagcataacttattctataaaaatgcttgttgtaatcctgagactaggagttgggtacccacaattgttacaaaaagtcctaaaacggtttgtgtagctaggagtactttgttccctttgcagaagatctgaagagaaaaggtggctagggtaatgagtagccagctgagaattaggatttggaaattgatcagagtattgtgatttctcgctatgagtgtacagcaagctgctaaccagagggtccaaacattaaagggagagctattggagaaatgcacggagaatatgagggggacatattgaatttataagggatccaggattcttcttttcccaatcgcaaaacagctcggactcctgctagtgttaccgcaattcctccgacaacttctatagcgcatacgggggtattcaatactttcaggcctccgagagcgagtccgtaaagagcaaacatagcgatgaatgcgaagaagctttctctcagtagaacaagcattcgctgttttactgaataattcgcgaggagatggtgtagcgctaggatattagttaaagagtctgaggctagcagcagaatgcatgtttggggcaagaaaaaagaaaactgtatcatggggtaattttttaacctcatttcctattattttcaagggaatcctctagaggatacttcggaattgggagagtttatcgaggtttgtataaattttatttataggtaatattttttagaacagggtgtgagttacacactctgttcttctggtagtgacggattgtagaggtcgtttagagaaaacttcgcgacttctgaagcaagttcgggataccgtttaatgattgtttcgaggagtttgtctacaaggtctttgcttaagggatcttgggactgagctaggagggggaaagtttcctcccattggagatactcctgatagagatttttaggtatgcttttagtttctttagcgtagagtttaaaagcatcttcggggtggtcttttgagaatatgatgctttcttgaagagctttttggaaagcttcaacaatttcgggttcgctagctttcgttccctttttagtaaagacaatcaactgggggcctgtgggaagatcacaggtatcggagagaaagcatttcacgggcatgcctaaagtttgtaattttactccttcaatattgtagaaagcgccgtagaggaaatcaattttgtttaataacatcggagagatgagatcagaacttacatttttgacttcagagggaaccacaccgttacgatttaaggtttcaagtagacgatttagatctctggagttgtttaagcagaaacctaagactttgccatttaggtcttcaaatttgtagatggggtcctgacttctgtagagaaatcttgcagggaactgtctatcaatctccctacgatttgtattggcatgccttttatggaggtcttcatgatgccgagagcatggtaaagggccatatctacttgttcaaatagaacgtggggaacagcagaacttgagtctgtatttttttgaagttgtagatccaaaccgtgttgtttgaagtatcctttggctactcctgcatagaggggaatatggttaggattgggggtccaatcgagtaaaagtgttagtgaagtaagattttttttgtcaggaggagatttagagtttcctttccagggaataagcattataggaattaaggcgagtacggataaagcttttttagctacggatttgtgcttaaggctcatccgttttactcggaatagtgaaaaaatcaatttttcaattaacaaggtgatttggaagaggctgagggtgagaattgagagagtcgcgagtcctgcgaatgctaattccatttcataatttctgcggctttcgagcataaggatgccgagacccgattgggaggctacccattctcctgcaatggcagcaaatcctgcagatcctatagcaatttttaatcccgagaatatgtgggggagagcgtggggaatccggagtttgatcaggagttggaattttgtactccgcaaaggacgaattgctctataagttcttctggtgttgataagatgccctgatagatagtcagggtgagcggaaagaatatggtgagtgctgtagggacgattacagcaccgattccccagccaaaccaaagtacaatcagtggagccagagcaaacataggagtgcactgtagcaggatgaaaagaggttgtaggagatctttagctgatttataagacaacataattgttgctagaacaatggagagagtaatcgcaaggaagaaccctcctagaatcgcttttaaggtgtgccaagcagatgttaacaagagtggaagggattggagagtactagaggcaatgctcgaggggggagggcagaaaaaggaaaacgtgggtcggtggcgtgacgtcatctcccaaagaaatagcagggaaaaaacgataacaaagtagaaaataaatttttttttcatttttgaagtaattaacgagaaaatagcctaaatcataggggaaatatagatatgcgacaagaaaaggatagtttaggaatcgtagaagttcctgaggataagttatatggagctcaaactatgcgttctaggaattttttttcttggggacctgagttgatgccttatgaggtaatacgagctctcgtatggattaaaaaatgtgctgctcaggcgaatcaagatttaggatttttggattccaagcattgcgatatgattgttgctgctgccgatgagattttagagggaggttttgaagagcatttccctttaaaagtttggcagacagggagcggcacacaatctaatatgaatgtgaatgaggtgattgcgaatcttgccattcgtcatcacggaggggtgttaggcagtaaggatcctatccatcctaatgatcatgtgaataagtcccaatcgtccaatgatgttttccctacagcaatgcatatcgctgctgtgattagtttaaaaaataagttaattccagctttagatcatatgattcgggtgttagatgctaaagtggaagaatttcgtcatgatgtaaagataggacggacccatcttatggatgcggtgcctatgacgttgggtcaggaattttctggttatagcagtcaattgcgtcactgcttagagagtatagcattttctttagctcatttatatgaacttgcgattggagctactgctgtagggactgggttgaatgttcctgaagggttcgtggaaaagatcatccattatttaaggaagganacagatgaaccgtttattccagctnccaattatttttcagcactgtcttgtcacgatgctttagtagatgcccatgggtctttagcaactttagcatgtgctttaactaagatagctacggatttgagctttttaggttcaggacccaggtgtgggttgggtgagttatttttccctgaaaatgaaccaggatcttctatcatgcctggtaaagtcaatcctacgcagtgtgaagctctccaaatggtttgtgctcaagttcttgggaataatcaaacagtgattattggaggaagtcgaggaaattttgagcttaatgtgatgaagcctgtgatcatctataatttcctgcagtctgtggatctcctttctgaggggatgagggctttctctgaattctttgtgaaaggattaaaagtaaataaagctcgtttacaagataatatcaataattctttgatgttggttacagctttagctcctgtattaggttacgacaagtgttcgaaagcagcactgaaagcatttcatgaatctatatctttgaaggaggcgtgtctagctttgggatatctttctgagaaggaatttgatcgtttagtggttcctgagaatatggtgggaaaccattagaattttttaaagagagcgaacgctgagtgtattgtaaagtaccgtagcgtacgttttctcttcccttgttatgaaaatctttaaggttgcttttctaggatttagactaaatgacgagttgaagttttgctctctagatttgttagagcttgggcaaataggagagcacttttaatatttgagaagatatggtccaccccaatcagttcatctagatgataacgtttcaggtcagcaaggggagttttcttaactccagcgaggagaagtagggtcccttgacgatcacattccaagaaaaattcttcgagagcatgcatagctgaggcatctattgtggggactcgcgtcatgcatagaataaagattttagggggtttttctatatcattaagaagattctttaatctatctgcaattccgaagaagaaaggaccattaatttcgtagatctctgtgttttgaggaacttcagctttgcttaaaaagtctgaatccttatcgaagtatttggctgtggagatcacatcggaaagatcactcatttgtttcataaataagaatgccgctagcatcattcccacttgtacagctgctgtaatcgttgtcattaccgtgaggatgaagacagtgaggagaaccacaatatcttttttaggagcggtaaagagatggataaagtggtggatttcgctcatattccatgcaatcaaaatcaaaacggcagcgaggcaggtgagaggaattttgacagtgagtggggccagaagaagtaaaataaagcaaataaagatggagtgaacgattcctgctatgggagttgttgcttcagacttgatgctggctgctgtgcgagatagcgaccctgtgacggggattcctgaaaataatgaggttccgatgtttgctaccccttgggcgacaagctgacagttggattggtgacgccatcctgtcattccgtccgcgaccacggcagatagtaaagtctccaatcccgataagactgcaatggtcagagcgtctggcatcagttgaagaattttggtgatgctcagttgtgggattttaggtaaaggaatcgcggtaggtagagttccgtaacgactgccgatggtaggaatatcgattttaagtaaccaaacgagggtggtcgccgttacaattgcaatcatgactccaggatagcgaggcttgtagtttcggaagtagatcatgatcaatagggtaaagagacccaccgcgaaggacttactgtcccaagtccataaatgatcccagtaagctatccatttagggaggaaatctgcaggaatattagctcccatttgcagacccaggaaatctttaatttgcgaggagaatataatgatcgcaagtcctgtgggtgagtcctgtgacaacgggatagggcatgtatttaatgaacgtgcctaagccagtgagtccgaaggcgataagaaagacgccggccagcaatgtgacggtaaaaagcgcctcagccccgtattttgcagataagcagtataaaatagaaataaaggcactggatggccctgaaatcagaacgttacttcctcccatagccgaagcgagaaggcctccgataatagaagctaacagtccctgaattggggagactccgacaccaatggctatggcaatagcaaaaggaaaggctaggattcctacagtaattcctgcttggaaatcctttttaaaagtattaaacgaatagccttctttgatacttgtgtagagtttagggatgaagtttttaaatgcccaagggactttcacgatgcaataacctaaagtagaagccagtgcttaccattttttcgattcctttgaatctttgtcaaatggttcgtgcaattttttaatcttttttcttcatattctctgtctagggatccgtaaaagaataattacaaaaatttttccttctttacctctgtaagagttaggagtaaagtagatcacgaaatcattttagaggtgaccatgctgaaactacaattgtgtgcgctatttttattcggatatctcgcaattgtctttgaacatattgttagagtgaataaatctgcaattgccttagctatgggaggactgatgtggttagtatgcttctcccacattcccatggcggatcatatgattttagtcgaagaaattgcggacatgtcccaagtcatcttcttcttgttctcagcaatggctattgtcgagcttattgatgcgcataaaggattttctgtgatcgttaagttctgtcgtattcagtcgcgaaccctgcttctctgggctcttatcgggctttctttcttcttatccgcggccttagacaatcttacatctatcattatcattatctcgattttgaagcgtttagtgaaggctagggaagatcgcttgttattaggagctatttgtgtcattgcagtaaatgcaggtggtgcatggactcctctaggtgatgtaactacaacaatgttatggattaacaacaagattacttcttggggcattatacgtgctttatttgtgccgagtttggtctgtgtgttggtcgctggtttttgtggtcaatttttccttcgtaaacgagggagtactctcattgccaaggatgtagagttacaatctgcgcctcctaagagtctttggattatttttataggtttaggttccttactcatggttcctgtgtggaaggcatgtttaggattgcctccttttatgggagcgttgttaggtttaggtcttgtctggttaaccagtgactggattcactctcctcatggtgaggatcgttaccatttgcgagttcctcatattttgactaaaatcgatatctcttcgattacgttctttattggaattttgcttgctgttaacgcgctatcttttgccaatttgcttacagatttttctctatggatggataagatcttttctaggaacgtggttgcaatcgttatcggattgctctctagcgtattagataacgtacctttagtagctgntaccatggggatgtacactcttcctcttgatgatactttgtggaaattgattgcttatgctgcagnaacgggaggaagcattctgatcattggttctgcagctggtgttgcctttatggggctcgagaaagtagactttttatggtacttcaaaaggatttcttggattgctttagccagttatttcggcggattgttttcttattttgttttagagagcctcaattttttcatttaattttttatagggaaacaacagagactgtgcgttcggtttttctatgattttgtgtattttttcagataatgtttttaaaaaaatgttttaaaaccctaaaatcctacctccttgtaaccattctcggtagaaaagagaggtatttatgaaaaaagggaaattaggagccatagtttttggccttctatttacaagtagtgttgctggtttttctaaggatttgactaaagacaacgcttatcaagatttaaatgtcatagagcatttaatatcgttaaaatatgctcctttaccatggaaggaactattatttggttgggatttatctcagcaaacacagcaagctcgcttgcaactggtcttagaagaaaaaccaacaaccaactactgccagaaggtactctctaactacgtgagatcattaaacgattatcatgcagggattacgttttatcgtactgaaagtgcgtatatcccttacgtattgaagttaagtgaagatggtcatgtctttgtagtcgacgtacagactagccaaggggatatttacttaggggatgaaatccttgaagtagatggaatggggattcgtgaggctatcgaaagccttcgctttggacgagggagtgccacagactattctgctgcagttcgttccttgacatcgcgttccgccgcttttggagatgcggttccttcaggaattgccatgttgaaacttcgccgacccagtggtttgatccgttcgacaccggtccgttggcgttatactccagagcatatcggagatttttctttagttgctcctttgattcctgaacataaacctcaattacctacacaaagttgtgtgctattccgttccggggtaaattcacagtcttctagtagctctttattcagttcctacatggtgccttatttctgggaagaattgcgggttcaaaataagcagcgttttgacagtaatcaccatatagggagccgtaatggatttttacctacgtttggtcctattctttgggaacaagacaaggggccctatcgttcctatatctttaaagcaaaagattctcagggcaatccccatcgcataggatttttaagaatttcttcttatgtttggactgatttagaaggacttgaagaggatcataaggatagtccttgggagctctttggagagatcatcgatcatttggaaaaagagactgatgctttgattattgatcagacccataatcctggaggcagtgttttctatctctattcgttactatctatgttaacagatcatcctttagatactcctaaacatagaatgattttcactcaggatgaagtcagctcggctttgcactggcaagatctactagaagatgtcttcacagatgagcaggcagttgccgtgctaggggaaactatggaaggatattgcatggatatgcatgctgtagcctctcttcaaaacttctctcagagtgtcctttcttcctgggtttcaggtgatattaacctttcaaaacctatgcctttgctaggatttgcacaggttcgacctcatcctaaacatcaatatactaaacctttgtttatgttgatagacgaggatgacttctcttgtggagatttagcgcctgcaattttgaaggataatggccgcgctactctcattggaaagccaacagcaggagctggaggttttgtattccaagtcactttccctaaccgttctggaattaaaggtctttctttaacaggatctttagctgttaggaaagatggtgagtttattgaaaacttaggagtggctcctcatattgatttaggatttacctccagggatttgcaaacttccaggtttactgattacgttgaggcagtgaaaactatagttttaacttctttgtctgagaacgctaagaagagtgaagagcagacttctccgcaagagacgcctgaagttattcgagtctcttatcccacaacgacttctgctttgtaaacgggacgtaatagaataatttttattattgctttaatatgcgcgcttccaatataagcattgtgaagcgcgtttcatatgtcttttatctttaggtaattattatgagaaaacttattttatgcaatcctagaggattttgctctggagttgtgcgcgctattcaagttgtagaggttgctttagaaaagtggggagctcctatctatgtaaaacatgagattgttcacaatcgccatgttgttaatgctttacgagccaagggagcgatctttgttgaagaacttgttgatgttcctgaaggtgagagagtcatttattcagctcatggaattcctccttcagttagagctgaagcaaaagcccgtaagcttattgatattgatgctacctgtggtttggttactaaggtgcattctgctgcgaagttatacgcaagtaaaggatacaaaatcatactgatcggccataagaagcacgttgaggtgattggtattgttggagaagttcctgaacacattactgttgtcgagaaggttgctgacgtcgaggccttaccttttagttctgatacacctttattttatattactcaaacgacgttgagtttggatgatgttcaggagatctcatcggctttgctaaagcgatatccctctatcattactctgcctagttcttcgatttgttatgcaaccacgaaccgtcaaaaagcattgcgttctgttttatctcgcgtgaattacgtctatgtggttggagatgtcaacagctcgaattccaatcgtcttcgcgaagtggctttgagaaggggagttcccgctgatttgatcaacaatcccgaggatattgatacgaacatcgtaaatcattctggagatatagcaatgactgcaggagcctcaactcccgaagacgtagttcaagcttgcattcgaaagctatcatcacttatccctggtttacaagtggaaaatgatatatttgctgtagaggatgtcgtatttcaattaccaaaagaactccgttgttcttaggtctttaggcttacttgccaagtttttctcgagattgctttatagagtcttcttctcgttcagagagggtatttacctttttagttctctgtatttgaaatatcctagattatttttttatgatcttggtaagtatgtctattctttaaggcattgcccttatgcaaagctcggtcgcttgccaggagcctctttattgaaagaaggaaacgtctacggagagactccatggtctgttcttgcaaagatctgtcaggcttttgatattacttctcaagacattctctatgatttgggatgcggcctaggaaaggtatgtttttggttctctcatgttgtgcggtgccaagttatagggattgataatcaaccccacttcattcgtttttcttcaaacatgcaccgcaagctctcttcaggattcgcgttattcgatactgaagagtttaagaacgtagttctctcacaagcttcttatgtctatttttatggttcttcgttttcacgacgcctgttaaatgagatcattcttaaattatcggagatggctccaggaagtgtagtcattagtatttccttccctttagactctttctcaagggggaaggaatgtttctttactgaaaagagctgctcggtgcgcttcccttggggaaagacaatagcatataaaaatattcgaaaaggctcttaattctactgatacagactgcgagcagcgtcatgttctgtttggagaatgttcagaaggaaattgtccatacttttccagttgtctttgacttcctcaatggtacgtgtgacttcatcctgtctcattctgaagacttcttttctgtactcagcaacagctcgtacagcactctctgataactcatgtactttagaagcggcttcagtaagttgtgatagagaggtgaaaacttttcctattcctttaaagaaggttttcgcagtcgcatctttgaatcttccagaaatcctttggacaaaccctaaaatgctatctccggaaatttctccaaccataggagcaatcgctcctaaaatacctaacgttgctgtcgcgatccctagccagcgggcgtatttagcttgacgtgaataactcgccgccaattcatgagcttccctttccatgagctctctttcttcaagacgtgtcattgtgtcgttagctctacttttgagcatcaacttcattagctctgtacatattctaaggacatcaaggttggtcacacgctttcctgcaagcacgcttagctgtgattcagacaaagcaaactccacaataggatcaggaataataggagtataagactcgtacacctggttcgaacttgaagtctgttgtagagattccacagtgcaccatggtgtctttttcttgccttcttcttgctcttgttcttgctcgtatccttcttgttgcctttgatctcgatgttcttcatctttttgttggctttttgtagaggatagtgcttgaggtacttccttatgtaaggtgctatagagtgacatcggactaagagtcgcatcagacttagtttgtgtgtgtttttgtgtctctgccgacttggtgctttgtgagactttttctttagcactatgttcttttatggtgctgctagaataggaccttacatgaaattgtgcttggctttgagaagcgcttgcttcttgttgctcttgtgcttttggtgtttggacagacactgtgaacgttttgtccacactggagtctccttcaggagctttgcatgagaaaaacggaaaggaagacgaggttgtttctgttgatgctttccctgtggaattcgaagatgtggattctgcgctaagggatttctatgtgaagctaagctagtctgctgcgattgtcctggttttaggttcggcagagatgttgatcgcattaatatgccattttttactagaaattgctcttcttgtaatggttttttccttgggaggcagtgcttgtgtcaaagcacattccgattgtgtnaaaatcccaaaacatagctcggaagttgctctcagcatcgcatattgctctcctgcagggagagctacttgtacttctgcagcaacaacagcttcttcagtggcatttccatctacaaaaatatcaaactctccttcaggaggaggagtcgatatggattggtaagatacagtcataatatntcttctgtggatttatcctcttaaggagtggagatacacttgatctagttcacgcatgtaatttaagattcttgaaagggcttcgaaagaactctccatgttatctaaaagttcttgagaacgttcgtaatgatcgtccctatcaaaacttttcaattcaatgtcgagttggattttagtgagttttcctttgagtttatagatttctgcttgagaaaacagtatagcgcatcttaaagcagccatcgtagattctatcgcgggttggattcctttaatagctccttctataataggggaaaaacctaaattttctacttttaatgtgcatatggagagaatgacaggggttaaatagacgacccactggattatggttataatttttcgtcttagttcttcattatttataggcagatgtttttctagccaatcccagaactttagtttctctaaacacttgataacaagagaaattagccctgcaaaaaaacctgcaaaagcaaagataccgcctccactcaagatagcaacaatgccgatccctatagaaacaaacggagctagccaaccgataatgtcagaaagagatccccataatctttctcgtttttctttctcgatgctgaccttgatagtctcgattctcttttcatgtagagcatcgagctctcgttgtgtcgactccacggaatctttgtggcatccatacgaagaaaagtctgaaagaatcccttgttttgtgagtagatagctcaatgtaaacactcctatgcttggaggaggaattacaggaacagcttgtgctgctttggctattctatttttacgtgatgtatcttgttggaaaggggatttcttttgtttttgattggaatcctgatcctgagaaaagaggtctttacagagatcttttatctgaactttggtttctatttttttctcagaactctgctggtttgcataggtttcactgcgctcttctcttcgtgattggaggagttcttgctgttcactatctaggctttgagaatatagcgagtcaacggttccaaacaacttgagatgttgttgtaggtgcagcgtatcaaaatttttgcaagagccttcttgtttagaactcaggtttttatctagagccttctctgaagttttctccggagattttggcatagtcagttcttgcatcagagctttacttgcttctgtgctatttttttgagaaaaaagattccaaggagatgaagtttgagcttgcgatgtgttgtgaagttgagattcgaaagagctgccgaaacgcaagattctctctcttggtgttgcaataatgaatgttttatgatgggtgataggaggctcagacttacattgtgactgaaatttctgagtgaaaaacttgggaagagacttttgagcttcttgaggcgctacagtgatagaatagctaatcttaggaaccgaagattcttgtgacctaggagcatcagggatataaggatcttgattgagaagaacctcacttgcttgagataaccaagaggacatagttgagtttccacattatttatgttttcgaatatctagaatttcttctttcaattcattatagaggggcttgtgttgtgcacgtacccacgccatttctaaagctttttcagcttcttcatgttcatttgtaagagtatagcatatgtaggcatagtaatgaggatagggatctttatctcgaaggactgcagtgactccataggcatgcaaagcttgtgaatattgttcggacatatgtagagaggcacctaaagaaaaccaaaacttagagacaaaaggattgaagaaaactaaccagcgaaaaacggtgatgcttttagcatagtctttgtcgagataggcgtgataaccctctttatatactttttcaagatcctcggaggatatcttgaagatcttttggtaggtatctaaagctatatttttatccgggacatatccttccaaatagctttccaaatcatctgggaaagggaagtcttccttggaagatgcagcgattttttctagtaaataatttaaatgtgacattaggggcgtaggttgtaaatgaaggtgtccataagttctttcaataacttcaatacattagagcgcgcttgatgacattgagaaatctcttggaggtgcctttgcatgtccgtcctttccatttgagtgattttctccatattctctttgcgcatttggacattctcttttagaagtcttttttcctcttctgtccaagtatatttttctttgtctatagtgactccaatctctttagctcgatttaaaagagctttcatctcttcattttcactccaatcaatgtctttcttttcattattgatcttagagataaggactgtgagtgtgtctacatcatcggtacgttgtttgactcgcatgtagagttcattagcttcggcttcggcttggcctaagattcttgccatgagcttcatgaaccttaagaacacattttctacttttggagtttgtataggcncgtgtattgaagagcctacagataacggattcttactagggatgaatctgctaaacacagacattggagaaggtagcttctttttgaatgtcgtttctttnttagaagtttcttcagcaggaggtcgcatttgatctgagaagattaaagcggcaatatctagattttctccgggttcctcagcgactgcctctacaccgagaccacgtttcttctttttctttttagattcagcgtcttcttcctgatcgtgctttctgtcgtgctgctctctttgttggcgatcttgatcgcgttctttatagagttcatgagattttgaggtcgtcagggcctctttttgtttctctgcagagaactgggatagaggagagaaggagcttgctttttgttgttctaatagtgttctttctggcgcactttcttgcggaggtaaggatctctgagaacttgagcttgcctgagataaggaagcgcgagcttgtgtctcaggtgacggtcttcgctgtgttttcttacagcagagtcttttggtgtttgaagagcttgctgttgtttagaatcagaaatttcaggttttaaggagcgtggggagagagcagattgtttactgctgctttgttgagggagggtctgctcactcctactttgcgtttgtgtttcttgtggttcacttgtgattgtctctgcatgttccaattgcactagcaagtcaacaacttggatttctaattctacaacttcaggagggaggaagaggagttgatgaacatttgtgctttgtaagagcagttcttgttgggtcgcaagaatgatttgtcctaaagctaagctaattaaagcatctgtagaagagcttccttctagcgctgtacaagagactaagacttcacctgttgcagtctttaatattccagaggctgtggaaactgttgagctgtcttcttttagagttatatttgcagagggaactgcagaaggaacaggcatattcatgatttgtaatttgagtgcgtagaaaaaaaaggaaaattagctaaaacatcattttcctgcaagtttgattgtaagcggtttagagggaaagagaaaataaaacaaaaatccaagggtttttgtttgcaaaaaacactctaactatagagaataaatgggtcagtttcatgtctttgacaaagatgctctgcccaggtggtgaaattggtagacacgctggatttaggatccagtgctttcgggcatgtaggttcaagtcctatcctgggcatctccttttctaatctctttaaatccacctaaaatttgctattcgtagtaaaataaaatctaagggttagatttttttagagatctttattatgaagaaagtcgtaacactatccattatatttttcgcaacgtattgtgcatcagagcttagtgctgtaactgtagtggctgtgcctttatcagaggctccagggaagattcaagttcgtcccgtcgttggtctgcaatttcaagaagaacagggttctgtgccctatagtttttattatccttatgactatgggtattactatccagagacttatggctatactaaaaatacaggtcaagaaagtcgcgaatgttatacccgatttgaagatggcacaattttttatgaatgcgattagagattcctggggtgatgggcaagaaacttctcgattagagaatccgcggctacgtgagtatacacttctgtagaggcgatgcgtgcgtgacctaacatctcttgaatgacgcgtaggtctgccttattgtctaatagatgtgtagcaaaggcgtgtcgtaaggagtggggagatacgggctttgaggtcacttgctttgcgtaattgtgaatacggcgccacacacaagagcgttcgagcttgtgtccccgggtagagaggaaaagatgatcttcgtgaggattctttttctggtattggtctcggaaaggacaaaggtacgcatcgatagcttctcttgctcgagatcccagaggcaccagtcgggttttagaacctttcccggtgacgcggatgcaatcatcagagacatggcctaaacgtaggtcacaaagttcagaaacccggacaccagttgaatatagtgtgtggagaatggctgtatcacgaaaggctaggtgtcgggggtttttctccatttggagaggaaccgcaagtagagcatcgacttcttgaggagtcagtactgaaggaaggcgtttccatatttttgggtgctctattattgggggatagggaagaagttgctgatcttttaagaagagaaaaaatacttttaaagcaatgagcctacgcgctaacgtagtctctgcttctttacgtctatatagttcttcagcaaagatatatacgctgttttgtgaaatatcttggggggagctaatggcacttatggtaaggaaggaagagatgtcttggcggtaagccgctatagattgttggcaaaggccgcgatctacagataaaaacaatgagaattgttctagaatcgttgtgtgaaactgagtcgagggcatagtcatactcgctaacgaatgtaactttagtatagggagcggagaattttcaagctacagagagaaaaccatggaaagaaaaagatttatagattgcgattcaacaaagatactccaagagcttgctttaaatcccctagacctaacagctcccggggttttatctgcagagaggatcaagaagttttctttgctaggagggggatttacctttagctttgctaccgagcgtttggacgatgctattttagctgcattgatctcattagcagaagaaaggggattgcatgagtctatgttagcgatgcagcaggggcaggtcgtgaactatattgaagggtttccaagtgaaatgcgacctgctctgcacactgcaactcgggcatgggtaaccgacagttcatttacaggagaagctgaagatatcgccgtaagatctcgggtggaggcgcaacggcttaaggattttttaaccaaagtgcgcagccagttcacgaccatagtgcagataggaatcggagggtcggagctaggccctaaggcactctatcgggcccttcgtgcgtactgccctacagataagcacgtacatttcatatccaatatagatcctgacaatggcgccgaggtgttagataccatagattgtgctaaggctttggtagttgtagtatcgaagtcagggactacaatagagactgcagtgaatgaggccttttttgcagattatttcgcgaagaagggcttgtcatttaaggatcattttatagcagtcacttgtgaaggcagtcctatggatgatacgggtaagtatctagaggtctttcacctttgggagagcatcggaggaagattttcctctacctctatggttggaggtgttgttttaggttttgcttatggctttgaggtttttttgcaattacttcaaggagcctcagctatggatcaaattgctttgcaaccgaacgctagggagaatctccctatgctttcagctttgattagcatttggaatcgaaatttcttaggctatcccacagaagctgtcattccttattcttcaggtttggagtttttcccagcgcatttgcagcagtgttgcatggaatctaacgggaaaagcattgtccaagatggtagaagggtaggattttctacgagccctgtcatttggggtgagccgggaaccaacggacagcattcttttttccaatgccttcatcagggtacagacattattcctgtagagtttataggttttgaaaagagccaaaagggtgaggatatctcatttcaaggaactacatcttcacaaaagctttttgccaatatgattgctcaggcgattgccttagcatgtggctctgaaaatacaaatccgaataagaattttgatggaaaccgtccttcttcggttttagtgtctagccagctgaatccgtattctcttggggaattactttcttactatgagaataaaatcgtatttcaagggttctgttgggggattaattcttttgatcaggaaggggtctccttgggtaaggcattggcaaaccgtgttttagagttgcttgagggggcggatgcttccaatttccctgaagctgcatcgttgttaacgctttttaacatcaagtttaggtaaaaattacactatcctttcataagtctacctcagagagaggtttttcttaaggttctttattgtccgtctgtgatataatgctcctttggatttggaaaaatttgtgaggataggatgtttttcattgcagtacgctctcgtggatttttagatattcatggtattttagccgctcgtaagggtaagcaagtagtgaaatctactgcgggcgcatggatagggtctcgtggcgccgtattctacagcctggtttcgtaattttaaataaaatattccgtatctttgttgaaatatgccaggttctgtgtcatcacctcctttgtctcctgtaattgtccgtgaaagggtcccatcctcttcaggatccgacctcatacagcctcatgctgttttaaagatctccatcctaatttttgcgcttgtgacaattttaggaattgttcttgtagtgtctagtgctttaggagctcttcctagtttagttttgacggtttctggttgtattgcaatagctgtaggcctgattggtttagggattcttgtgacacggctgattctctctacgatcagaaaagtagatgccatgggttatgatgctgcggtcaaagaagagcagtatttgtcacgtatcagagaattagagtctgaaaatagagagattagagatagaaatcgtgctgtcgaagatcagtgtgcccatttatccgaagagaacaaggaccttagggatcccgaatatctacatggaatgactgaaaggctcattgcgagcttagaaatagagaatcaagctctcgtagctgagaacattcttctcaaagactggaatgcaagcctatctagagatttccgcgcatataagcaaaaatttcctcttggggcattagaaccctggaaagaagatattgcatgtatcatggaacaaaatctctttttaaaaccggaatgtatcgcgatggttaagtctcttccattagagacgcaacggctgtttttatatccaaaaggatttcagtctttagttaatcgatttgctccgcggtctcgctttttccagactccaaagtatgaatataacagtaggaatgaaaatgaggacggaaaggtagccgcagtgtgcgcccgtttgaaaaaagaattcttcagtgctgttttaggagcctgtagttacgaagaactagggggcatttgtgaaagagcagtagcacttaaagagacgttgccattgcctgaagctgtctatgataccctagttcaggagttcccaaatcttcttactgctgagagtttatggaaagaatggtgcttctattcctatccctaccttcgtccctatctttctgtggattactgtaagaggttatttgtacaactttttgaggaactctgcctaaagctttttacaacgggatctccagaagaccaagctttggttcgccttttctcttactataggaatcatattcccgcagtcttggcctcatttggtttgcccccgcctgagacaggggggtctgtatttgtattgctaccaaaacaagaaaaccttctttggagtcaaattgaggtgctggctacaaggtatctcaaagataccttcgtgagaaactcagaatggacgggctctttcgagatgatgttttcttataacgagatgtgtaaggagatctccgaaggaaggattcgttttgctgaagactatgaaacgaggcattccgaagaattccctccttcccctctctctgaagaaggagagggcgaagaattccttcctccttgctctgaagaagaggtttcggttcttgagcgcccagatctagatgtagactctatgtgggtctggcatccgtccggtccctaagggacctctttaatcacctagagttctattttcagaatcttcatagtagtaattttcctaagatataaggtcttaaatgagttctagaggttttaggatctttttggagagcttgntgtgggtttaaaatcttgataagaagatatcctagtgtttagaaacccaaaaatttagggtttgatgaattggagtctcgaaacgacttttttttcaatttcttgttttgtttctacttaaagactatagtgattttttttgaagggggtgcgtatggcattcaaagaggtcgttcgtgttgctgtcacaggaggcaaagggcagattgcgtataattttttatttgcattagcccatggagatgtttttggagtggatcgtggtgtagatttacggatctatgatgtgccgggtacagagagagctctctcaggggtgcgtatggagctcgatgacggtgcatatcctctttnacatcgtctgcgtgtgacgacatcgttaaacgacgcttttgatggtatcgatgcggcgtttctgataggtgctgtgcctcgtggacccggtatggagcgaggagatcttttaaagcaaaatggtcagatcttttcgttacagggggccgctttaaatacagcagcaaaaagagatgctaagatttttgttgtagggaaccctgtcaatacgaattgctggattgctatgaaacatgctcccagattgcatcggaaaaatttccatgcgatgttacgcttggatcagaatcgcatgcatagcatgctcgctcatcgtgctgaggttcctctagaggaggtctcccgtgttgtcatctggggaaatcattctgcaaagcaggttcctgacttcacacaagcacgtatctcagggaaacccgcagccgaggttatcggagatcgagattggttggaaaacattttagtacactccgtgcagaatcgtggaagcgctgtaattgaagcaagagggaaatcttcggcagcatccgcatctcgagcacttgccgaggccgcgcgatctattttttgtcctaaaagtgacgagtggttttcttctggagtgtgttcggatcataatccttatggtattcctgaagacttgatttttggttttccatgtcgtatgttgccttctggagattatgaaatcattcctggattgccttgggagccttttatcagaaataagattcaaatttccctggatgaaattgctcaggaaaaagctagcgtgtcttcgttataagcacaatgttgtggggagtaagtatgagacaatcattcgatgaattaagtcaaaatgcatttaaaaatatttttaataaacagaggttctgctttattttctgcagtctctgttgctttggttttgtgtttgcattgtttctgaagctctgctcacggctggctcctgaaatttctttgtcgacattaggtttgggagcttttttctgtgcctttagtgtgatttgcgcttcagcgattatcgtgcaatttttattgcataaggagtctcaaggagaaacgagtaagctctgctgtgctattaagaacacctggtcttccttatggctttctcttcttgtatcgatgccgttcttcattgctatggtcgccgtagtcactgtagctatgctctcttcttttttaggatctcttccttgggtgggtaagttattccatacagtgttgattttcattccttatctatcggcaacggcactgattttactttttttaggttcttttagctgtttgtttttctgcattccggttctccataatcaagagtctatagactataggaaattgcctagagtgttttcgtgggaatatccttcggcagtttataggggtggtgattgctttggttccnttagccctatgcagttggttagctttagattctttttatttgatgacacatcttgttgaaattgcagatatacatacctggtcatttctagctcagatgtttgtgcttattgttcctattgctttgattttaactcctgcggtttccttcttctttaacttttcttttagcttttaccttgcaaagcaagaagaagagaaagcccttgttaaatagtaaatagaaattctttagcaatataagctgtagattttcgtagaactgcctgagcgagcatgtctcctgtaatcccgtgatacaggagtcctttcgacccgagtcctcctaagaaccagagtttttccctaatcctagagatgacaggaagacgtgatttgctagaagagcgcatgccagcataacagtgcaggacttgagcatctttaagtcctggaaatagcgagagcacaggaggcatgatttcctgataggcaatagcgggatcaggagtctcttcgggttggttgtgttcgaaagtcgcccctaaaatgcaggtattcttttgtgtattggcgaccatatatttatgagcattgatactgaatgagagcatggcaagatctttaggccaactgatctccagcaactgtccttttactttatttaccggcatgtctttaagttcaggaagaatcgaggcgttggctcctggagtcactatgatatgatcatagaactcttcaatatcggcaaggtcctcaatgagctcatcatagaattgtgtccctaatttcatgcaggcgtcagccaatccctgaatatagagatcattatttagagttaccccactctttatgaatagtgctccgagatttggggggatgaccatactgggaatggagatttcgcaacgagccntctcccaccattcgacttctttggggaattcttcaacacgctccgtgaatagctgagcttgatcctcgtcaattgccggtcttaagatcccttgagaaatcacaataggtacgttgagggctttactagcgcantgtgattaacgcgtgtgtagcattgattccttgatcctaccaggggaggcttgagagcttttttccccgtgaaagcatggaggagtcctgaagacattccagaggctccttctcctaagggaataggatcaaagagatcgatagttgcagtcccctgggagtggagaagcagatgccaagttacagagagtcctgcatatcctgctcctaaaacggctatacgcataaagtgtaccttaaatcaagtatcgttacatagaccttgtcttgagaataagagaataagggataaaagaacaggggggaatctctctgattgggagataaaaatgtagaagatgaaaacctgattcttaagggtgaattttttactatagagaagagaattagggagacccccacggcataagccgtggggaaggatgaaagtttaattaaattttgattcttcctgttgagaataggaagatcgctgtcagtgcaagaaggcctatgaaagtcattcctacaatttcttttttagcaaagaatgtcttagcatttttcttctttttccctgcgtctatatagaaggggatgccaagagctaaaagaactaaggccataaagaggtattttagacctcctgcatagataagccatagagagtaaaccactcccaggataccagttatcattgccaaaggggctttaatagacccttttttaggatatgttttgcttttgctaagtttaaagagaaaggcagcactcgctagatacgcagggagaaccatgacccccgtgatgctgagcatagtattccaagcattcgaagaaaagtaaacaaggagcatggcgagctgcatcacagagctcgtaatgtatagggagacgctgggagatttctctttattttctatagtgaagatctcagggaaggtgccatttttagctgctgagaaggggatttctgcaacgatgatcgtccaggataaccagctagataaaacagcaataatcaggccgacattcatgagcacttctccccatttccctacgaggatgtcgaggacaccagctgtagagggattggggatgttcgctagttgatgttggaagagcgagccaaaaggtaataaagaaaataagatgtagattgttaggcaacctaaaaatcctaagactgtagcttgccctacagagagaggattttttgctcgtccagacatcaccacggcaccttcgattcctataaatgcccatagggtgaccaacatagtccctttaagttgtgaacttacggatcctaaactcggttgggcttttgttacggcatgtccccaaaaatctgttttgaaaacagcgagcttgaagaagaacgcagtcaggataatgaagatgattagagggatgattttaaatatagttccgatgacgttgattatcgatgcttgacggattcctttcagaactatgaagttgaacacccagataagaatggagcctcctaaaatagcaggtagggtatttcctccttggaagtagggagggaagaagtagtttagagcatccatagtaattacggcatatcccacattaccgaagatttgacaaagccaatatccccagccgatggtgaatcctatgtaggggccgaaaccttctctactgtacatgtagatcccttccttaaggtcgggacgtattgtagagaggatcctaaacgtatttgcgataaagaacatgccgaagccagtgagtatccaagataggattacggcaccagctcctgctgtcgctgccatgttttgggggaggctgaaaatccctcccccaattatggaactgactaccatacccgcaagggctatggtccctaaattttttgaggatttagtccttgaggtcatgaaagtctccttaatttaccttagctggttcagcattttcgaaatttaggaatcctaatgcagttaagcaaaaaccgaatttttgtttgatgttgatgtaattatggaagaattggaattcgctatgctttgctatagagcgtaggtcaagttcgtgttgtagggattttttcaaccacattttagcatgggtttctgcaatttcgtcatttatccatgtagggaagaattcaacatattctgctgcccatccgccaataagctctccatttttatctttaccccagcaaatgccgattccggtggcgatcgcatgggttccgtcagagagagcagcaccacgacccgccatgattacttcaaggacagcgccgtgtttgaaagattttacacaggtatctacaggaacgatattcccaaagagctctttaggaagtacagatgtataagggacgatattaaaattttcgatttttgcttgtagaagagcagaatcgtagcagaaagtttcaaagggttgtgggggcataccgtcatcagattcaccaatgccccctgtatggaatgctagcgtgggataacgagttccgtaagccataagttactcctaaataatattggtgtggttttgttataaggaaagatttgcacgcaggccatacacttgagaggttctcctctctgggcgtaacgctgggtggatatagagttggaaatctggagttagagatatataaggtccaaagccaatagtagcgaaagcttccataacagactcataacgtcgtagcttgttcacattggaaatcgctttagcatttaccttatttgtagcaaatcctatgccaagaagatcttgagagtggcggtttaagggattctcagagacaagacctaaaacatacgaacggtttatggggagtgctgttcccgtagctccgttgattcttccgaatagatagagcttttcatgaatatgttgagcagcattcagggaccatcctgtgacctgggagttttgctcaggaactttgcgtgtgctatagagcaatacagagtactgtccatctccacacgaaggttttggagtccaggaggcgtagccgtaaaagttgtatgttgctttttgtcagattataaatcgaaaagttggttccatcaatattataggaatcttgaaaacctagttgaaccttgatttcagaatttggagtgaactgcagataagcacctgtacttcccaatgagtaggtagcacttgcgttttgtgataaggcgtagctaataaacccagagtactgatcattatcgtaaagcgtgccgtctatagcatagaggctgtattgtcctatagctagggtcaaaaagtctccagggaaagtctgagagaaggtaagctgtgctaggttattttctctattagagtaatcattcatactggaagcggttcccgcggcttgattggcgtcaacaccgttagtttgccagtaatgtatcaacgtatagctaaagtctacgattccttgacctgctgttggagaatcataaagagtccaggtagtgctaggactgaagtagaactgccacgaaggaatctctagggcttgcgtttggccaagagctttgtgagggtaaaaccactggggaagaatactgaagtccaaggatatctgagtatttgtcgctttttctacagatgttaataggttggatacggaaatgccatccttccaaggatgtgaacagaagatattagtaactggagagagaaggctgttatgatgtggagtttccgaaggggcgctttcttttatggactcgggatgttttttttgaattcttgctttataacgatggtagtggcccgtcgtttctttaggagtttcggcataagaggaaattccaagagcgcagagtcctgaaagtaaaagaaancgaaaggntatcatgaattccccgtagaagaaggcatagtgtttttttttgactctaaaaaaaagaattgtttttatgtagcaaaaattttcttctgaggagaggaatgctatggaatccacagtatcagtcgttaagaattctcctgagtagtcttttttcttattattctaaaattattttttattgagatcgagaacccacaaaagtaaacgtcagggagtgcttatctttaagaaggattattcgtgcatttggtggcgcagaagaagagccgccgcttcattgctgagtaattttttagagtagttgtactgtacttgtgcaatgttatcaaaatagatcggggggtgaagttcctgagctttataggtgattccgaaataagcaattccatatttttggcatagatcaccgatgcgaaggacattttctttttggttatcaatatagataatcttagcgggtaagggggtgcatatttccaagaagagatcgagtcccggtcctttgtggtagtctccagaaaaaagaattcccgatgtgtagagaaggttcttgggtaggggagcttgaggttgtggagcagtatcttctaaggagacgttgagcatatgaagttgctttagggtaagatctttagctgttttaggacgttccgtgtagacaaaggttgtctttccttgcttctggattttctcaatgagtagaaaaatagcagattctataggctgaacggttcccatttcttgaatttcaatccagaaaggaactacagcctcccaagcttcttgttctggggttccctgtttctgtaacccctggattgctttgcttttccatatagaatgagagagagcctctcctccttgaagaagcgtatcatcaagatctaagatcagccagaagttctcttcatcatagaggatatcaccagcaacttcatgaatggacctgacctcggcataacgacaagaagcatagaacgacgagcaggagaataagaaagtgaagaacaaccaggttttcataacgtaccttgcaatcttttggacaaggatagagtaagacaagtattttttatacttttgccatgaagttttttacatagtttcggaaagagtcacaagactctggagttaggaaatctgggaaccaaagagcaaattgtagcagggcttgttctatgaacatttcgtagccatggataatgagagagccatgtttttgagcacgttcaaggtagggagagggatgcggtttggtattgatgtccatgactataggagggaatctccaagggaaggtcacttccggagggagacagttgatgattatgtctatagttttaaaattctctaaggagcctaagggataggctttgcctttacagcaagtagctaaagcagctgctgaagaaagagttctattgaagatgtggagattagcaccttgcatcgccagtgttgcagcgattgctttagcagcacctccagcacctacaatggcaatgtgtttgttgttaacagagatattcttttgttttaggagtttggctactccctcaccgtctgtattgtaacctagaattttctgatttcggaagaccagggtgtttatagactcgcagagttgcgccgatgcatcaagagcatcgacatggtcgaagattgcggtttttagtggcatagtgacactaagtcctgaaaaaggaagatctcggatcgcagagaaaaaggtgacgacttcccctatagtaacagggaatttgatatatgttgcattgagagaaagcttagagagtaagaagttgtgggagaggtgactgatgctacggtctacaggatctccgatgagtccgtaaatgtgtgatttttcagatagcttcgagtagttataggagagcagctcctcaagtttaggttgtcccggggctacttgaggcgcactgattccagcagcgtaattcatagcgttgctgatcagtggggagagaactctagaggggagcccatgggttcccatacaaaggactgtagatggttttggtaacaggcgagctttttttatataattcagagcttcactggagttctctggggagagtacgattttgtagatctcagcgggagttgcaagcatctcattatagattgcatcgaggtcttcatttttgtctgtatgataggaaaggatgagctttattttaggatggctcttgcggatggtttgaagggcggtcttaggaagactcacatcgatatccatccacttgggttcaagttttgctagggaatatagtttttgaatccatagcgctgtcgacatctctttgtgttgtctaaaggtgaggatggggttttgggctgtggtaatgagggtatgcagttcttgatcatcaagttcgtttatgagatcgagtcgtagttctataatatctacaaggtgtagagactttagaatttgttgttttgcttcacaaaatgagggaccgctaacagtggcgcataacatgacactcactccatagtatatcatagagaatctccatatttggagatgcacaataggtaccattaaagggagctgcacgacctagatgctctatcatgatcatttttagttcgtgttgagaaagattttttttatcgtatcctaaagtgtagatgatattttcaggactatacaagctgttgtggagatgttccggaacaatagattgtaaatctttcaaagtagaagggagattaaatcgttttaggagtctttcaagttggtctatgagttgtggggttttcataactccttcagcaagagatattcttgtttctatcatcataccgacacttacggcttggccatgatttaccgttccttttgccagggtttctatagcgtgggctatggagtgaccgaagtttaggatttttctcagacttcggtcatagggatcttcagcgacaatcgccgctttgatttggcagtttcttttgatgaactcgtggaggatctgcgatgaagaaaatagcattttactatggctatttagaaattcccagagataagcatccgcgatgaatccatgttttattgcttctgcaattccatgataccattcttctcttgggagtgtagagaggaactgaggacacatccatacttccttgggtaagtagaatgtccccagtcgatttttgattcctcgtaagttgattccatttttccccccgatactcgtatctaccattgcggtgatcgtcgtgggaattagatatagagggagccctcgacaatatgtagcagctaaaaatcctgtcatatctaaaacagtcccccctccaattccaataattgaagatttcggagagatattctgatctacaagctgatattgtagagatatgaatgtttcccaggttttgttaggttctccaggaggaaaggttaggacaatgacttgatatcctaacattttaatatggtctaagataggacctaggagatgctgttgtactgaaacgtctgtaataatgactaagggatacgctgtggatatagaagagaacaacttcttctggaagaagttggatatgagtttcactacatggggagtcgtaattattgtctctgacatgatagtttggagcatcgttggtataatacaagatctgcaagaacaaggtttatcatagcctcaacaacagggacagcgcgtatggcgacacaaggatcatgacgtcctgtttgaggtgtcctataggtagtttctttttttgtctttgtcactgtagcacagggtcgctttatcgaagaggtaggtttaaatgctatgcgcccttctataggaactcctatagttatgcctcctagtgtgcctccacagttgttagacttcaaggtaatgttttctccttccatgacgaagggatcagtatattgtgaacctctcatttgagcagaggcaaacccttttcctatttcgaatcctttagcggcggggatgctcattaaagcacttgctaagagggcgtgcactttcccaaagaggggttcccctagaaagtcgtggattggagacgttatgaaagaaatcaccccacctagagaatcagagtcgtcgtgtagagaagtaaggatctcttggattttctcattaggtaacggtgaatagaatggcgaggtgtgaatcttgtggatgagctcgggggagatcttcaggtagtgagggagggttagagatcctaacgaggagaggtaggctaaagtaaaaatgttttgattcgcgaggaatttctctgcaactacgccagcagcgacgcgacatgccgtctctcgagctgaggagcgacctcctccgttaggatctacaattccgaatttcttttcataggtatattgggagtggccaggacggtagagcctttcactgttttcataaggggagctatctacgtcagtattgaggatttgcagggataggggagtgcctgtggtctttcctttataaactccagagaggatttgcacgatatcgttttctttgcgcgatgaggttcctggatttcctggacgacggcgcttcatggcaggaacaaaatctgattcatggagctcgagtcctgcgggacaaccatcgattacaactccgattgagggaccgtgggattctccccatgttgtaaaagaaaacaaagagccaaagctatttttcatgactttaacaaggtaatgagatcttgagacgcttgttctaaggagctcttcgaggaatgatctacgtgatccacgggaaaaatgtaatcagcaatttctttcattctgtcgatgcgctcagttaaaatctcgcttagaggttttgttttcatggcttctttcagccgttctggtaaccctcgtttctcgagtctttcataaattaaaggtagttctacagagagaaatacaagagctcccctagtttgaatcgctcggtaagaggcttcatacatcaaggtccctccaccaagggagatcaaggcatcttctggaggtaaagtttcaagaatacgagcttcacattcactgaatttctgatccccataagctttatagatctctgcagatgaggagtatagtgcactgctgtagttgcttacaattaaatcatcaagatcataaaaaggaaggtttagaaatttagccaaagctttcccgagcgaagactttccgcttgtgggtagaccacatagaataattgtcatgacattcctcaattcgagcttccattatatttagagtctgaacgaagttaggaaaggttttcctaacgcacgcagtgttgtgaatacgactatcgccagaagcatatagagctgctatggtcaaggccatggcaattctatgatcatcgtgagagtccaaaacagcaccgtagaggggactgggattcaccagtaagccatcatgagttggctgtatgcatgctcccattttctgtagttcttcggtgattgcaagaatgcgatcgctttccttgtctttagaactgcgtgcattgtagaggtgcgaaggggaatctgcaaaacaacaaaggactgtgagaatgggaagagcatcgatacaaccatccatatctatagagccaccagagaacgacgaagggaatactaagatctcttcgttgtcgtactgtatagaggctcctaagttttgcatgagagaaaaaaagattttgtctccttggatatctaagatgtccaagttacgaagacgtatcggttggagtgattttgaaagtagagcagctgcagcaatgaaagctgcgctgctgaaatcaccagttacgtggtaagagaaaccttgaggatgtgaacttcccgggaaagaataggtagtatcagaacaagaatagggaagatggagtttctctaaccaccagagactaagatcaaaccatggacgctctttcggttctatgatagtaaaggaacagggaccttcggctaacgaacatgctacggctagtgctgaggcaaattgagaatcactaccttcaacatcgctataagcagagcgtaacggtcctgacattgtgaaaggtagaacgcttttatctgaagagaaatgaaacgaagctccaaagtttctcaaggcttgaagtagaggggccataggacgccgttgcaactgtgacgatcctgtgacggtgatttctttagagaagacacaggcaagggcagtcataaaacgcaacacgataccagaatttccagcgtctatgagagtatattttggaaatatagccaagggattgcccacaatttccaaaatttgagggaatttctttatagaagctcccatctgcttgcaagcacaaatcatagcctcagtatcaggagaatctaaataattataaattgtagattttccctcggcaacagaagcccatagaatggctcttagagtatgggactttgaggaaggaatgaaggcgttcccatacacagaagaaggtgaaactttataagtaagcattgtaaagcaaacttatctctttttttttaggtaatttgcctgacttctgatttgtcgtctaagaaaaattctagaactttgtaaaagtcgaggaaggatcgaagatcatttgttctaatctctctacaaactgcaagcaaagctccccttcgaattggcaagcatagcctaagagttccctccccgtgggggagatctttaagttcacgttccatctcttgcagatggccttgctcttctaagataatggattttaccgttattttactttgagcttctttcagaatatcgtgatacagaggataaagttcagaagcacgaagttcgattgcgtaggtaactaaaatatacgctgcagtttttaacgtttgtcccgatagggagtattcattttccagtactcggcacgtccttaaatctagaagatggaggtaatattttgtaagtaagcctcccagaagatttttagatgtatagtcagggagagaagtctctgagattctagaaatctgagtttttagatagtgaccatgacgaaattcttcagcagcatgttttaaaacttcttcctttacctccgtaggatgttcacttgcggagattttttttgctccactattttctaaaaaggacagggtatttatccattgtgcatgccaatagttggaagctacgatctctttgagaacgggctcccaacgagaggctgtgtggataaagtgttttactgtggttgtagacatagggcatcctgtaggtgagaataaataatccggagatcttcttcttggatacagtaggggggcagcacatacagtgtgttccctaaaggacgaagaaggactccacgttctaagaaaaagcgattgagatggtctctatattgtgaaaaatatcctgtagcttctgcagggtaatctagagcgagtaccgtgcccagaacctcacaccgttgccatagggaaccatgagcttcttgaaactcttgatgacaccgttctatcatttgcctttgttgtaggcattctggagatagggtgagatccaaagaagcgagggcagcactacagcctaaaggatttcctgtgaaggtatggccatgaagcagtgccttcatccgatcttgggagacaaaggcatcatgaatttctttagtggttactgtcaaggctagagggagatagcctcctgtaagacctttagaaagacagataatgtcaggaggaatgtctgtaaattcagaagcaaacagtggacccgtacggccaaagccagtaagaatttcatcagcaatacagagaaccccgtaatgcttggcaagcttgagaatctcctttaggccttcgggattatacattaacatccctccagcaccttgcaatagcggctcatagataaacgctgcgatattgctttcagaaaagactgtttttgcttgggcaatggcaagctcttccttgccataatagggagcagcaattgtactggaaggaagaaaaagatcatgaaagggaactgtagtagggctcgtgccagctatcgacatagctccaaatgtatctccgtgataggcattgctgagtccaacaaaatggctcttagccttgttttgattgtagtaatattgcacagcaattttcattgctatttcgatagacgttgatccgttgtcagagaaaaagaaacgttctagaccttcaggaaggaggggagcgagtttcgatacgagctctagagccggttcatgggtgaaatttgcgaagatcacatgttctaacttctgtgcttgctcacataatttttttgtaatgtagggatgcccatgaccgtggaggttgcaccaccatgaagatatcgcatcaagatatcttgttcctgattccgcatagaggtaagcaccttctccccttacaatctttatgggtgtagaatctaatgcagattgagtgaaggggtgccagatacaccctgaattccctgatgattgcttgtccatacttccttccattgttcggcataacagcttatgattgtctttgtgatttctttttccttggcaagagtcccgattataggaagcttgatttcttgagttagccagtgctcttcgtcctctggatacccatttaccaccatacctaagatattgaggtttcgtgagcgcattgcttctaccgttaaacaggtgtgattgatacttccgagatatgcttggctcactaaaatccaagaacatgaccaagaagaaaacacatctccctgaagtctttttgatgtgcagggggataaaaatcctcctgaagtctcaataatcagattcgaagttgtttttggcgcacaaatatgactctcttcgatacttacattatcgatttgcgctgccttgtgtggagacaagggcttatgcaatcgataagcttcgggatgacagtaggctcccgatagctcatgaacaatattgctatctgaattttctagattccctgcttgtataggtttccagtattctgcgttaagtgctctagcaaggatagcactgacaatggtttttcctacgccagtgtcgattcctacaatgatgatacgttgcataaaaaaatttgctctaaagtatgtaaaaggtgatctatttcattttttgtattgaaggcatgaaggcaaatacgtaacagttcttctctttgttttactgttgggctcacgatagggcgaacatcgtaccctgagttttgtatttgcaatgcggcttgccgagcacgatggctccctgaaacacaaatagattgtataggtgtagtagtattgtctttcattagctgaagtcccaagttttgagctttttcgcgaaaatgatgaatgagagcagaaagatgttcacgttgattaaaagcacgttggttatgctcataagcgagctctatagctgtgagcgcatggggaggttgggctgtggtgtatatgaaaggtctacaaaaattaattaggtagtctttgagtatagaacttcctgcaatagcagcgccatgagtgcctagagcttttccaaaagtatagacggtggctaggactttatcttgaagacctaatgcagagacaaggccttcgccctgatctccaaaaactccgactgcatgggcttcgtcaacgatcaggtaagcggaatatctttcacagagttcactgatagcttgtaaaggagccacggagccatgaagcgagtatacggattccacgcaaacaaaggttcttcctagatgggagcttgctaaacgtttttctaagtgattcagatcattgtgattaaagggaaagctttgagctttgcttaatcggatgccatcataaatagaagcatggatataaaggtcgtgaagaatacgatcctggtcggtggcaagagcatagagcaagcctaagtttgctgtgtaacctgtattgaagatcaaacagctttcaaaattatgataagcggctagttgttcttctatacgctgacagagttgcgagtgccctgtgagaagccgagaccctgtagctccaagcgattctatcgcatggagcttggtaatgtattctttccttaattctggagaagaggcaaatccaagataatcattagaggtaaaatcaatgagatgagagtttaagcttagcgagcggtaggtatgtttggacttacgtcttgccaaagcctcaattaggaattgttggcataacatgggttacctctttctattccaaatgaagggcgagggattaagcctaaaagtttgatcatttcagcatcttcatctatatcattgttttctacagtcaacagtttatctccatagaatatggagttggcaccggctagaaaacataaggtttgttgttctactgtgaggaaagcgcgtcctgcagcaagtcgtaccatggatctggggaaaacaacccgtgccgttgctatggttcgcaagacttcccagaaagaaatcggaggctggtcttgcaaaggcgtgccgtcaatcggccaaagtaaatttacaggtacggattctgggatatgatctcttgttgcaagaacatgaagaagctttatacggtcttcttcagattctcccatacctacaataccaccgcagcatgtactaatgccagatttatttactacatcaagagtgttgaggcgatcttcataagaacgtgttgtgattatagtttcatagaattccggagaagagtctaaattatgattgtaggcataaagtcctgcatcatacagttttttagcttgctcttcggagagcatgcctaaagcacaacaaacctcggctccgagatctgtgatacttttcaccatagcgaggactctatcaaagtatcgatcgtccttagcattgcgccaggcagccccaagacacacacgagtggcgcctagctctacagcacgttttgccctttccacaacgtctacaattttcatcataggttctggtgtgacgtgggtatgatagcgggaagattgggcacagtaggcgcaatcttcaacgcatccaccagttttaatcgaaatcagatagcaagtctgcagttctgaatggaggaaattactacgcaatatggcattggctttgtgaatcagctcaaatacgggagtgtgataaatttcgcggatgtcttctaatgaccaggatacagtttcttcacgcatgtgttttgcctagggggtaaattcaacgaccgagcctaagatatttacatggaatttagagaaagtcaataggaaccaatttttggttcctatnttttatggtatgatttgagaattattctaataaaataagagaaattacgttttttaataaagcagctctatttttaaaaaattagaaataatcatgaattatttcttgttgtctaaggttgatttatcagaggaactgtatttgcaattttagtagaaggcatccctaaaaacttgcggattgtattcacagcgagataaaagagcggtgtcgtgagaacacaaaaagtaattttataaatgtaagagtagaacataatatttagggtttgggggaaagaaagccccatgccgaaatataaaatacaggtgtcgacaatgaaagtatctggnatttgtgagatccatgtagacccattgctacgtagccatagagatgaattgggagttcgatttttaaaaaaagtgtaaaggacgatgtctaattgctgagagacaatgaaagcnagtagtgaagctagaaaacggagaggacttaaatcaaacaagcagtgccaggcagtttgcatctcaggagaggctactgggaagaacataaaaatttgtacaattgaagaagctaagaggttggcgataaaagctgaaaatatcatgacacgagcttttttagggccaaagatttcgttaacaacgtctgagatgagaaacgtcaggggataaagaatgagtcccccaggaataatgaagttaaaaaaagtcgttggaatgagcttcgaagagaggacaagattggagagaacaagaagcaaagtaaaggttgaagacaagtaggaaaatactaatgtttttctgtgggatgtattcattggcaaagtacctcaaaaccagaaagatatttctcttgattgtaaaggggaattgattctaacagaccttggtcgagcatccattctaattttgaagtgagttctaccagttcatcaaaatgtcttattgaaaataaagtctcttgtggagttgatgtattgaagggaagacgaataatctgatccaattctaaagggagaacacgtacgttatcaatgaaagcgtgtccaagttcctgaggagaactgataagaacggctccatatgcttttcttccttcatggttttcaataagtccgctttcaacagtaaaccaaaagcagcgtacaatagcgatcagattgctttgtagggtttgtatgcgttgttttttactaggaagagcttgtactttttctatgactttagtgaagagtcttcccatgtttatgaaaaattcagaaaatgagggatgtagaagccaaggcacgtgccctaaaaggtcatggatgagatcaggagttaaggagaaattatctttatcgagagttcgcattacagaggcaatgggaaagtaacggtcctgcaacagagacaagtattgatggggagctacaaatcctgaaacgggataataggaaaaatgtgtttctaattcgaagaatttaatgactgcttgatggtctaagaaatcagaaaggagaccgaaagcttctaagtaatcaagaaaaatcttggacaatagcttttccatagagaaaaccgtgaggaaaggagtcgataccataaattccgattaaaaaagggagtgcttacaacagccatatcagtggagcaaccttccctttgattctttgataatgacagaagatgaacaaagagtaagtttttgaaaaattctaaaatagaaatgcatttgtgtcgagctaaagcttgcttctctttattttccttttgtagaatgattcggtagtaggaatatggggtcgagtatgcacgttggagtgattggctgttctggaagaacagggaaagtgattgtctcagctttagagcaatcttcagaatatactttgggtccagggttctctcgcagtagtgcactcactctttttcaagtgattgcacataacgatgttcttgttgatttttcccaccccttactaactaaagaagtcgttgcccatctcttaatctctcctaaacccctcattatcggaactacagggttccctgggaagtgtaaagaagctcatgacagtctcgaagagctgactcacatcgttcctgtagtggtttgtccaaatgcaagtctaggagcttatatacacaagcggcttgtaatgttgctatcgcaattatgtaacccacagtttgatattcgcattcgcgagactcatcatagatataagaaggactctctctcaggaacagctcaagatttacttgatactatacagcaagtaaaacaagaggattggggagaggagtatgaggtaggccagcgagattcttctaagaagacgatagaagtgcaatcttcacgagttggagatatccctggagaacatgaggtcgcttttatcagttctggagagcaaattttggttcgccacacagtattttctcgcaatgtttttggtcggggaatcctttctattttagattggctaaaaacattgaatccccaacctggtttgtatagtcttggggatactttggagctagtcttacgaaatgaacattgcttgcttaaaaagacaacggatcattaatatgcagatataaagatcttttgcgtcgtaaaatcctgatcttcaaattaggaatgtagggtgccgcaattacacaacttcgtgtacaaaattttaagcgaggactgttttgatttttagcatcgataggaccatcggttaaattaggaagtgttgacaggcaattcaaaaggaatcattgcatgtctgtaaacactagagatagggttatcgtgcattccaatctgaagtaaataattgagatggagaaaggaaaggaatgcgaatcgctgttttaggcgttactggacttgttggccagaaattcgtagctttgcttcataagtggtatcgtgattgggtcattgctgaagtcgtagcttcaaatagtaaatatgggcaatcgtatggagatgcctgtatttggcaggagcaatcggccctatgcctgagatggtacgtgatttgcctatacgtaagatcgaggaagtgcagtccgacatcgttgtttcttttttgccttctagtgctgagtccatggaggcgtattgcctctctcaaggaaaagttgtcttttctaatgcctcaacatatcgcatgcattcttcagttcctattatcatccctgaagtcaactcagatcattttcaacttttagaagagcaaccttatcctgggaaaataatcacaagtcccaattgttgtgtctctggaattactttggctctagcacccttaagaaagttctccttagatcacgtacacattgtcaccttacaatcagcaagtggtgcaggctatccaggagtcccgtcgctagatcttcttgccaatacagttcctcatatcgttggagaagaagaaaaaattcttagagagactgtgaagattttaggaagttctaagcaacctttaccttgtaagctctctgtgacagtccatcgagttcccgtagcctacggtcatacgctctctctgcatgttaccttttctaaagatgtagatcttgacgagattctgtactcttaccaagaaaaaaataaagaattccccaatacctaccaactctatgataacccttggtctcctcaggctcgaaagcatctttctcacgacgatatgcgcgtacacctaggacccattacctacggaggagattttcgcaccataaagatgaatgttttaatacataatttggtgcgaggtgctgcagggactttactcgcaagtatggagaattattttttcgactatcttaagagggaaatgtgtctaagatagtttataaatttggtggcactagcttagcaactgctgagaatatctgtttggtttgtgatatcatttgcaaagataagccttcttttgttgttgtaagcgcaatcgccggtgtgacggacctccttgtagacttctgctcgtcttctttaagagaacgagaggaggtcttaagaaaaatagagggaaaacatgaggagattgtaaaaaacctagcgattccttttcctgtctctacatggacgtctcgactccttccctatctacaacatctggagatctcagatctcgattttgctcgtattttgtctttaggagaagatatttcagcttccctagttcgtgctgtttgtagcacccgtggttgggatttaggatttctcgaggcacgtagtgtcatcttaacagacgatagctaccgacgtgcctctccaaacctagatcttatgaaagcacattggcatcagctcgaactaaatcagccttcgtatattatccaggggttcatcggatctaatggtttgggagaaacagttcttcttgggcgcggaggcagtgattattcagcaactttgatcgcagagcttgcaagagcaacagaagtgcgtatttataccgatgttaatgggatctataccatggatcctaaagtgatttccgatgcacagcgcattcctgagctcagtttcgaagagatgcagaatttagcaagttttggtgctaaagtcctttatcctcctatgctctttccttgtatgcgtgcgggaattcctatttttgtgacatcaacatttgaccctgaaaaaggaggaacatgggtctatgctgtcgataagtctgtgagttatgaaccaagaataaaagctttatccttaagtcaataccaaagcttctgttctgtagactatactgtcctaggatgtgggggattagaagagattttaggcattttagaatcccatgggatagatcctgaattgatgatagcacaaaacaacgtcgttggatttgtaatggatgatgatatcatttctcaagaagctcaagagcaccttgtagatgttttatcgctatctagtgtcacacgcttgcatcatagtgttgcattgattaccatgatcggagataatctttcttctccaaaagttgtctcaacaattacggagaaactcagaggttttcaaggacctgtattttgtttttgccaaagttcaatggcattaagctttgttgttgcctcagagttggcagagggtattatagaagaattacataatgattatgtaaaacaaaaagctatagtcgccacgtagggagaatcatgcatttacttacagcaactgttacaccttttttccctaatggcactatagattttgctagcttagaacgtcttttatcttttcaagatgcagttgggaatggagtggttcttttagggagcactggagaaggcctttcgctaacaaaaaaggaaaaacaagcactgatttgctttgcttgtgatctacagcttaaagttcctctttttgttgggacttcgggaacccttctagaggaagtcttagattggattcatttttgcaatgacttgcctatctcgggattcttaatgacaactcccatctatacgaagcctaaactatgcggtcaaatcttatggttcgaagcagtactcaatgctgcaaaacatcccgcgattctttataacattccatctcgtgcagccacgcccttatatttagatactgtaaaagccttggctcatcatccacaatttttgggaatcaaagattctggaggctctgtagaagagttccagagttataagagcatcgctcctcatatccaactttattgtggagacgatgttttttggagcgagatggcggcatgtggagcccatggtttaatctctgtcttatcgaatgcttggcctgaagaagcccgagagtatgtgctgaaccctcaagaacaagactatcgttctttatggatggagacgtgtcggtgggtatataccacaacaaatcctattggaattaaagcgatccttgcctacaaaaaagctattactcacgctcactgcgcttgcccttgtctatagaagattttgatttggagaatgtatctcctgctgtagaaagtatgcttgcctggccgaagttacgtacctctgtgttctcctattcttaatgcagcaaaaccttatcttctgcatctatcttgttctaacttattactttacaaataaaatttttgcagaggttttttctagagaatagtgcttttgttctggatttttaacaagatgcgtcgcatttttttcttctttttacatcgcttatgattttttatgactccgaaatcgattcaacaattgcacttaataaagactattgatccagtaagaaaaatttctcctgtaacaacaaaaaaatcttcgttctttagacagtctcttcttagatttttagaactattttggatgtttctttactgtatacgctctattagattccattgtgttcatatcgccacctttatctgtcgaggtcttattctttttctgactaccttgttcttatctatgatatgcatcttgcatttcattactcttccttggatctgtaaggaagaccctcggattataagaaaaaataaataatcttgtttcatcaccaagaatcaggtcattttgtcttcatagtttctgattttttttccatttttgtcgccatattcaagattttcaaaatcgtgcttcagctatactgaggagtttattttgaataatttttcattcaaaaaatgaaatataattcaagagaaaaaataaaaagcgctttacggatttgctcttcatattgtatcactgtctttcgaaataatttcagtttaagttgttatgataaaattttctattcgttgtcttgttatgttttcaatggcccaaacagtattgggcgctgccgaagtttttgtttcttcagaggaaaaaaaactgaagtagaaactaaagaagtgaaaatcaaagatgagattcgtccttcattggaaggaaatgatcctgtaaaagttgcggagtcattccctaaaagaagagcagctcttgagtctttaagttctcaaagttccatcggcaatctttgtgcaattagtaatttcttagattctcaaatgttatctagaaatttctcaaaagagatctggggatctacaatcttcacacgatctaaatctacatgtgatgccgaaggatctgagcctttccgttatactgcatgtggatacctagctggtcttagatctaaactagcaggttcttatgaattaggtgtaactgcaggattgctacagggacgccttaaagatgtttcagatagccatagaactcgtgcgacatcttcaatattgtccgtgcatggtagtatggttacaagaccgttgagttgtacgaagtatatcgtaggaaaagcgcgtcctttacttttcttcttcagattaacatcggatgtaagaagagatttgaaaaaaaagttcagacttgaattttgcaaagattgatcacaatcatctctaccttacatgtttgggagatcttggtgtagcttgtcctatactttctacagattgtctacctaattatagcgagaaagcatctcatgaggttcttgtttatagtaaatttagatgcatttctggagagccatctcgacttgcaacttcaggaaatgacacatattattctatagtaagtttacctataggactccgttacgagtgacttcaccatcaggacgtcatgatttcaatattgatatgcatgtagctccaaagataggtgcagtactctctcatggaacacgagaggctaaagagatcccaggatcttcaaaagactatgcattttttagcttgactgctagagaaagtttaatgatttctgaaaagcttgcgatgactttccaagttagcgaagttattcagaattgttattcacaatgtactaaagtaacgaaaactaatttaaaagaacagtataggcacttatcccacaatacagggtttgagttaagcgtcaagtctgcattctaaaaatagttcttgttctcttggacttgaaaaagccattcctatttgaaaaaatgggaatggctttttttataataggtcgaaccaaagaggaacttgtttcattaaaattacttaaaaagtgatatcgttttctaaatacaaagataaaaatactcaccaatatactcgcacaaccttgacaaaggaagttttcttgaagatctttttcggtttttataagaaaattcttctttagaaggaagatgaatctctttgaataaaatactatatattagtagcttagtgggtttaatttatgtgtttgatcgcgatggcaccacagattcataatgcaagtacttctatctccgcagctacccccccccccaacactctgtagggtcgatttcttctccatctaaacttcgcgttttagcgattacttttttagtttttggtatgctcttactgatttcaggagctctctttctgacgttagggattccaggattgagtgcagcaatttcttttggattaggcatcggtctctccgcattaggaggagtgctgatgatttcgggactactatgtcttttagtaaaacgagagattccgacagtacgaccagaagaaattcctgaaggggtttcgctggctccttctgaggagccagctctacaggcagctcagaagactttagctcagctgcctaaggaattggatcagttagatacagatattcaggaagtgttcgcatgtttaagaaagctgaaagattctaagtatgaaagtcgaagttttttaaacgatgctaagaaggagcttcgagtttttgactttgtggttgaggataccctctcggagattttcgagttgcggcagattgtggctcaagagggatgggatttaaactttttgatcaatgggggacgaagcctcatgatgactgcagaatctgaatcgcttgatttgtttcatgtatcgaagcggctagggtatttaccttctggggatgttcgaggggaggggttaaagaaatctgcgaaggagatagtcgctcgtttgatgagcttgcattgcgagattcacaaggtggcggtagcgtttgataggaattcctatgcgatggcagaaaaggcgtttgcgaaagcgttgggagctttagaagagagtgtgtatcggagtctgacgcagagttatagagataaatttttggagagtgagagggcgaagatcccatggaatgggcatataacctggttaagagatgatgccaagagtgggtgtgctgaaaagaagcttcgggatgccgaggaacgttggaagaaatttaggaaagcagtcttttgggtagaagaagacgggggctttgacatcaataatctccttggagactgggggacagtgcttgatccttatagacaagagagaatggacgagataacgttccatgagttgtatgaaaaaactacgtttttgaaaagactgcacagaaagtgtgcgttagcgaaaacaacctttgaaaagaanagatctaaaaagaatttgcaggcagtcnaggaggcgaatgcacgtaggttgaaatatgtaagggattggtatgatcaggantttcagaaagcaggggagagattagagaaactgcatgctttgtatcctgaggtttcagtctctataagagagaacaaaatacaagagacgcgctctaatttanagaaagcctatgaggctatcgaanagaactatcgttgctgtgtccgagagcaagaggactactggaaagaagaagagaaaagggaagcggantttagggagaggggaaacnagattctttctcctgaggagctggaaanttctttggagcaattcgaccatggtttgaaaaatttttctgagaaattaatggaattggaagggcatatcttaaaacttcagaaagaagccacagcagaggtggagaataaaatactttcagatgcagagagccgccttgagattgtatttgaagatgtcaaggagatgccctgtcgaattgaggagatagagaagacgctgcgtatggcgganctgcccctacttcctacgaagaaggcgtttgagaaggcctgctcacaatataatagctgcgcagagatgttggagaaggtgaagccttactgcaaggagagcctcgcctatgtgactagcaaagagcgtttagtgagcttggatgaagatttacgacgagcctacacagagtgtcagaagagattccagggggattcgggtttggagtcggaagtaagagcctgtcgagagcaactgcgagagcggatccaagagtttgaaactcaagggctggacttggtggaaaaagagttgctttgtgtgagtagtagattaagaaatacagagtgcgattgtgtatctggtgttaagaaagaagcacctcctggtaagaagttttatgcccagtattatgatgagatttatcgagttagagttcaatcccgatggatgacgatgtctgagagattgagagagggagttcaagcatgcaacaagatgttgaaggcaggcctaagcgaagaagataaggttcttaaagaagaagagtattggttgtatcgagaggagagaaagaataaagagaaacgtttggttggtactaagatagtagcaacgcagcagcgagttgcagcatttgaatccatagaagttcctgagattcctgaggccccagaggagaaaccgagtttgctggataaagcgcgttctttatttactcgcgaggaccatacctagcataactccaagagttgtgtttctttaaaaattctttgaataaaatactatatgttagtagcttagtgggtttaacttatgtgtttgagcatgatggcgccacagattcataatgcaagtacctctatcaccacagctaccccccccccccccagaccactctgtaggggcttttttttgtctgtctaaatttcgtgttttagcaatcacttttttagttcttggtgtgcttttcttgatttcaggagctctctttctgacgttggggatttcaggattgagtgcagcaatttcttttggattaggcataggtctctctgcgttaggaggagtgcttgttgtctcaggacttctatgtcttttagcaaaacgagaggttccgacagtacgaccagaagaaattcctgaaggggtttctgtggctccttctgaagagccagctctacaggcaactcagaagactttagctcagctgcctaaggaattggatcagttagataggtatattcaggaagtggtctcatgtttaggaaagctaaaagatcttaggtgtgaagatcaaggtcttttaaaagatgctaaggagaaacttcaagtttttgactttgtctggaaagacatgatgaccgagtttgtagagctacaacagatcatggatcaagaggggtggtatctaaagtgcctgattcaggagatgcgggatataggaagcacactttttatgagtcaggttagtttatttaaattatgggaatggcttgggtatttaccttctggggatgttcgaggggagcggttaaagaaatctgctcgtgaggttgtggatcgctttatgagaaggatttgcgatacgcggaaggtggccatgacttttgataggaatgcctatggagtggcgaagacggcctttgaaaaggcttttggagctctggaaacgtgtgtatataagagtatgacagagagttatagagaggccttttgtgagtataagaagacgaagatccttagggatgaggagaagatattaaggatatgttatctcgagttgaggagatagagatgatgcttcgtgtcatagagcttccactacttcctataaagcaagcgttggagaaggcttttgtacaatataatagctacaaagcgaagttaaccaaggtagaaccttgctttagagagagccctgcctatataactagcgaagagcgactcnagagtttggatcagactttagaacgtgcgtacaaagagtaccagaagagattccaggagccttcacgtttggaatcggaagtaagtggatgtagagagcatcttagagagcaggtaaaacaatttgaaactcaaggactagacttgatcaaagaagagcttatttttgttagtgatgtgttattccgaaaaatggtcagttgtctagtgtcgacagtgcatgttccctttatggagttttattatgagtattttgagttgcatagattgaggttgcgggcccaatggatggcgaatgccgagatttatagcaaagttagaaaagcattcccagagatgttgaaggagaccttagaaaaagctaaggctcccagagaagaagagtattggttactttgcgaggagagaaagagtaaggagaagcgtttgattctcaacaagatagaggcagctcagcagcgggtaaaagatttagaacctcctcctattaaagagacagggaaacagaaacggaagaaagaatattcgtttttcattcgattaaaatcgtgattcgaggcaaccctgcattctatagattttttctcagagttctagtgatctaagtacgaagaggaagaaagacttttgtattttttgcatcctagaattttttgttttgcatagtattcgttatagaagtgttttaattattactaactattttatttataaaatggttagctcttctgttcatcataagaattgtaaaatgtgtattaaaagacgagaattttatttaaaataaattatacacttttacttttttaattttgctatgcctgagcctctatatacgaataagctaatcacagagaaatctccatatttgcttctttatgctcatacccctgttaattggtatccttggggagctgaggcatttcatattgcagctatcgagaataagcccgtcttcttgtctataggatgcaagcattctcgatggtgtcaggtgatgttgcaggagagctacacgaatcctgaaattgctgctatgctcaatgaatacttcgtgaatgtaaaagtagataaggaagaacttccctatgtagccaagctgtatggtgatcttgctcagatgcttgccgtttccggagatcaccaagaaactgtctcctggcctttaaacgtctttcttactcccgatctcgttccttttttctctgtaaactatttggggaacgagggaaaactcggtcttccctcattcccacaaattattgataagcttcattttatgtgggaggatgctgaggaaagagaagctctcgtcgaacaggcaatgagatttctggaaatcgcgtcgtttttagaggggtgtgtaagaaaagagatcttagacgagagctctctaaagcgaaccgtagccgcgttataccaagatatcgatccccattatggaggagtgaaagcatttcctaaacgattgccaggtttgctcttacaatttttcctccgatacagcctcgaatatcaggagagccgaggcttattttttgtagatcgctctttgagtatggtggctttgggaggagttcgagatcacattggcgggggagtttattcatacactatcgacgataagtggttgatccccgcttttgaaaaacggctgattgataatgccttaatggctttaaattatttagaagcttgggcatgtctgggcaaagaagaataccgtggtataggaaaacagatactttcctatatcttgagtgaattatactctccagaggtgggtgccttttatagctctgagcaagcagaaaattggggagcaggaggacaaaatttttatacatggtctgtcgaagaaatctccaatgctttgggagaagatgctgagattttctgtgattactacgggatttctagggagggcttcttcaatggcaggaatatactccatattcctgtacatagagaaatagaagagctgtcagaaaaatatcatcgttctatagaggctattgaagatatcgtagatagatctcgagatattttaaaggggattagagcccaacgttcccatcgttctaaagatgatctatctttaacttttaacaatggctggatgatttatacttttgcctacgcaggccgacttcttggagaggttgagtatattgagattgagaaaaagtgtggggaatttgtccgaaattccctctataaacaccatgaactttaccggagatggagagagggagaggcaaaatatcgagcgagtttagaagattatggtgctcttattttaggggtgctagctctttatgaatcaggatgtggatctttctggttaagctttgctgaagagctgatgcaagaagtcgtcctttccttccgttcagaagaaggaggtttttatagtgatgatggtcgggatagcaccttgctgatcaagcaatctcccctttctgatggagagacgatctcaggaaacgctctaatctgtcaatgcttgctctcactgcacctaatcacagaaaaaaaacactacctgacttatgctgaagacatcttgcagatagctcaagcatgtgctcatacccataagttctcttccttaggattgctgattgcatcacagaactatttttctagaaaacatgtaaaagttttaatccctttaggggatcaagaagatcgcagtcctgttttgaaatgtctctcaggtttattccttccttatctatctctaatttggatgactcaggagaaccaagaacatttagagactgtgcttccagaatatgagcactgtcttatccctaaaagggggattgcacagctacgacaatttatgttttagaagtcgatcaatgcaaaagatttaaagacttagaattgtttcgtcgttatctaatctctctatagaacgctatactagttattgataaagtgttttttactaattaaaatttattctttttaggaaagaaaacaccttctctcagtggtcaaaattaccacaattccttatagtaaagtcccctgggcaggtcaaaatctatagggtaggaagtcatgaaattatatcagaccttgcgaggtattgttttagtaagtacgggatgcatattcttaggaatgcacggaggatatgccgctgaggttccagtgacttcatctgggtatgagaatcttttagaatctaaggaacaggatccttcaggtctagcgatccacgatcgcattttgtttaaggtagatgaagagaatgtagtgactgccttagatgtgatccataaattaaacttactattttataattcgtatcctcatcttatagattctttccctgcacgatcccagtactatactgcgatgtggcctgtggttcttgaatctgtgattgatgagtttttgatggtggcagatgccaaggcaaagagaatcgctacagatcccaccgcagtgaatcaagaaatcgaagagatgttcggaagagatctctctcctttgtatgcgcattttgaaatgagtcccaacgatatttttaatgtgatcgatcgcactttgacagcacaaagggtgatgggtatgatggtgcgctctaaggtaatgttgaaggtgactccagggaaaattcgagaatattaccgaaagctagaagaagaagcctctaggaaagtcatctggaagtatcgtgtgttgacgattaaagccaacacagaatccttggctagccagattgctgataaagtgcgtgctcgtctaaatgaagcgaaaacctgggataaagatcgtttaactgctcttgtgatctctcagggagggcaactcgtctgctccgaagagttttctcgagagaatagtgagctctcccaaagccataagcaagagctggacttgattggctatcctaaagagctctgtgggttgcctaaggcacataagtcaggatataaactctatatgttgttagacaaaacctcaggttctatagagcctttagatgttatggagtccaagatcaaacagcatctttttgctttagaagctgagagtgtagagaaacaatataaagacagattacgcaagcgctacggctatgatgcttctatgattgcgaaacttctttctgaagaagctccacctctattttccttattataggggattgagtgacaagaagttctcctgcacaactctcccggtttctttctgaaattcaaaataagccgaagaaaagcctctctcaaaatttcttagtggatcagaatattgtcaaaaaaattgtggcaacctctgaggtgattcctcaagattgggtgttggagatcggcccaggatttggagcccttacagaagaactcatagctgcaggagctcaggtcattgctattgaaaaagacccgatgtttgcgccatctttagaagagctccctatccgcttagaaattatcgatgcctgtaaatacccgttagatcagcttcaggaatataagactttgggaaaaggtcgagtagtagcaaatcttccctaccatattaccactccattgcttaccaagttgtttctggaagccccagatttctggaaaacagtgacggttatggtccaagatgaagtggcccggcgtattgtagcccagccagggggtagggattatgggtctctaacgatctttttgcagttttttgctgatatacactatgcttttaaagtttctgcttcatgcttctatccaaaaccgcaagtgcaatctgcagtcattcatatgaaagtcaaagaaacacttcctctatcagacgaggagattcctgtattttttactttaacaagaactgcatttcaacagcgtcgaaaagtactcgctaatactctaaaaggcctctatcctaaagagcaagtggaacaagctttgaaggaattaggattacttctaaatgtgcgtcctgaagtattgagtcttaatgattatcttgctctcttccataagatgcaagcgggttaaaggtactttcccttctaaggaaattacaatctctagggataattaaactctgacgtctccaacagtctgcttttttgatctgaagttgaaatgagtgagaatgcggttggtcatactactctcatcaaggcctatagattttgtgagggcttccttactcccatgggataggaatgtatcggggattgcaaaatttaagatatcgaccttaaaattgaacgtagctacaaaattattaaactcggacgctaatcctcctcgaatggagtgctcttctatggtaatcaccttagagtgactcatcagtaaaagactgaaaagatcgttatcaaaaggttttataaagatcgggtctacaacagttgcggagatgccataagcaagcaactgatgttttatagatagggccgtgaagcagagggttccaagagctatgatgagaacgtcctcaccttgtgagagggtctcagcattgcctggggatcttaggaaatttggatctccagtgagtgggtctccatgaggagctgggatattggggtagcggatagcagaaggagaggaccagtgtagagaagaatacagtagctgttggaataccacctggctacgtggctgacagataatcatctggggcatcgcacgtaggaaactcatatcatagatgccgtgatgactacgtccatcaccataggcaagtcctgcacgatctatagcaaaaatcacgggaagatcttgcatgcaaacatcgtggaaaacattatcgagagcacggtgtaaaaatgtagaatatatagaacagatcacaggattgccggcttttgcaatgcctgcactgaaagtcactgcatggccttcagcaatccctacatcaaagaagcgttctgggaacttctgtttgaaaccttccaaacgagatcctatagacattgcaggagtcaccacatggagacgtgaggaaacctctccaagttcacatagcgtttggccaaatatatcagggaaagaaggcttaggcttaatcgcaggaagatgttttgcggattctcgcttattgaagtttgctctgactccgtgatactttgcagggttattttgggcttggtctaggcccttccccttagttgtacagacgtggacaagaataggaaaagggaggttacgaacggactgaaggatggggatcagttttttaacattatgaccgtctatagggccgacatacgctaatccgaattgttcaaataaaggagtgggacagaagagatttttaacacattgtgaaagtctccgactgtgctttgctaagctatccccatagcgtggaattttagcgagccatttttccacttgcttagtgagtttattggttgcagggtggtgtagccatcgggaaaagattcgagacatggctcctacgtttttagagatcgacatattgttgtcattcaaaataacaacaaacttcgataaatctgttgaaatattgttcaacgcttctaaggtaagaccacaagagaatgcagcatctccaaggatgggaatgacgtgtgtgcgtgattctaaaggggttgtttgagccattcctagagctaaagacaatgccgtccctgcatgtccagagaaaaataaatcgtggtcactctccgtagggttggtaaaaccactgaggccgttgtcattgcgtatatggtcaaatccttcattatttcttcctgtcagtagtttatgaggataggtctgatgtcctacatcaaaaataaatttatcttttggggaagagaacacgtaatgtaaggctatagtaagctctacgattccaagatttgaagataagtggcctcctgtttgtgataatacagagatgatgcgataacggatttcttcagctaaaccaggaagctgagaaatagagagtttctttaaatctgcaggagacaatatcaggtctaaaagggggcaagaagacgaagtcatgaccttagtgatgtggatgtataggaaacgtttgtactatagggtctccagaaggacttttgaggagttctcctttggagttaacagaaagaagataacatagttgatcttttcttaatgctttatttaatccttcatagatcaaagaaaacatggcctcatatgtagctacaatatcactcaaagagtttaaggtttctaaagattgttgtaaggcgaataacttttttaatgaggggtctttgtgatggatttctaccataagactaccgaactacagcttgttcctcaaagagagaactttcatgacgcttttctgccaactcacggactctttgctctacttgtcgaatacgagattcacaaatacgcattaaggcatcagcttcttcatatagggctagagatgcatccaaagaagtcgtgggttgattcataaggtcaacaatttcttctagtcgttgcattgcattttcgaaggggacctcttccatgatttagccttttataagtttacaaatttcaatatttgtgacagttaaaatggcctcgccatcttgcaactgaatccttacacgagcattttcttgtaagctgtctacggaaatcatagcggaattttcattaaagtcaaagagcattgcatacccgcgttttaaaacatttttcggatttaaagagtgaagttgttcttttagcgcagagtagcgggcaacagaattttcgtaacgacgttctagaattgttgctaaagtttccttgacatttgcataggcgattttttggttttgtagatttagctcgcatcctctcgatagacgtctgcctaatagttccagtttctgcacatggctacggagctgttgctctaagacattgtgagcatgcttgagtcgtgtgtgtttatgaaaatattcttctttttggtagtggaggcgtcgtgaaattagggtgtctagctgttgacgccaaggggataatttctgtgatgcctgttggatttggcgaggataggtaaggcttttctttagttggtggcaacgtacttggagagaaagtgctttatgggatagggcttgtgaaagcatttttttcaaactttgcagtcggcaggtcatgcgggaaacaagatctccttggagccaccgcgagatgttgtcatagcgttgtttgctttcgtgaattttcccttggacacctttttgaatagcgatctcaatagagtcgagttgctgttgtgctgtagtatagaattctgcgcgatctaaaaagcgtctccagggaagcaattgctgtttttttgatgtgaggagttggcgagagtgtgagagtagatggcggaggtatccctcgaacacctgaacttgctcttcgctacttttacagacgatctctgcggctgcagaaggagtgggagcacgcacatcagaagcaaagtcacataaagtgtaatcagtttcatggccgacagcagagacaatagggattgtgcttgcatgaatggctttaactaagatttcttcgttaaaggcccagagatcttcaatacttcctcctccccgagcaataataagaacgtcagcgaggttctcagcgttcatcacttcaatagccttggagatttcatgagctgcagagttcccttggacagtgacgggataaactaaaattttatagttgcgagcacgccgggagagtacacgtaagatatcttggatcacagctcctgttgggctagtaatgacgccaatgcattgaggagcaaaggggaggggcttctttttttcagttgcgaaatacccttcagcagtcagacgtctttttgtttcttcaaatttttgtaggagatcgccctctccagcgtaaaccaaagcatgggctacaatttggtactgtcctctaggagcatagaccgcaagcttcccatgaataataactgcatccccatctttgggtttgcggtcatagtacttacttttaaaatgaaaaaaggcaccattaagaaacgcttggctatccttaatcccaaaatagagatgaccacttggttgtagggagacgttgctaagctcgcccttcactatgatctgacaaaaattggactcaagaagagtcttaatgcgttcagttagggatgcaacagcctgtggaggcgatgacataacaggaaagcctctctagagaattcagtgactttagagtaagtgattttctg

SEQ ID NO: 2 - protein, 251 aa, Chlamydia pneumoniae
  SITE 1...251: Xaa=unknown or other
MRIKFRENKERKMTRQSYVLGNWKMHKTIQEAKEYVQTLASXLQGEPLSCTIGIASPFTSLRAIHEMINTTGAFLWLGAQNVHPELSGAFTGEISLPMLKEVGVEFVLVGHSERRHIFGESDAFIASKVKSVAQAGLVPVLCVGESLEVREEGKAHQVIKKQLLLGLEQMDNGSEFLIAYEPVWAIGTGKVAEASDVQDIHMFCREVVAERFSEATAEEISILYGGSVKVDNAQRFGQCSDVDGLLVGGXL

SEQ ID NO: 3 - protein, 119 aa, Chlamydia pneumoniae
  SITE 1...119: Xaa=unknown or other
SMSLNKEIGMTVLFYAFLFIFLFLCVILCGLILVQESKSMGLGSSFGVDSGDSVFGVSTPDILKKVTSXCAVAFCIGCLLLSFSTNLLGKKLDAKEFLLPAAEESDTQASSESVEADES

SEQ ID NO: 4 - protein, 204 aa, Chlamydia pneumoniae
VLVVRDFFTELCQAHVQTMIRRLEYYGSPILRKKSSPIAEITDEIRNLVSDMCDTMEAHRGVGLAAPQVGKNVSLFVMCVDRETEDGELIFSESPRVFINPVLSDPSETPIIGKEGCLSIPGLRGEVFRPQKITVTAMDLNGKIFTEHLEGFTARIIMHETDHLNGVLYIDLMEEPKDPKKFKASLEKIKRRYNTHLSKEELVS

SEQ ID NO: 5 - protein, 301 aa, Chlamydia pneumoniae
MSCMPPPFVVTLTTSAQNNLRDQLKEKNFIFSQPQNTVFQARSNTVTCTLYPSGKLVIQGKGSEEFIEFFLEPEILHTFTHARVEQDLRPRLGVDESGKGDFFGPLCIAAVYASNAEILKKLYENKVQDSKNLKDTKIASLARIIRSLCVCDVIILYPEKYNELYGKFQNLNTLLAWAHATVINNLAPKPAGDVFAISDQFAASEYTLLKALQKKETDITLIQKPRAEQDVVVAAASILARDAFVQSIQKLEEQYQVQLPKGAGFNVKAAGREIAKQRGKELLAKISKTHFKTFDEICSGK

SEQ ID NO: 6 - protein, 143 aa, Chlamydia pneumoniae
MQEHIHKELLHLGEIFRSSRESQSLSLKDVEAATSIRYSCLEAIEQGCLGKLISPVYAQGFIKKYATYLGLDGDSILQEHPYVMKIFKEFSDHNMEMLLDLESMGGRNSPERAIHSWSNLWWAGLIIIGGIMVWWLGSLFSIF

SEQ ID NO: 7 - protein, 460 aa, Chlamydia pneumoniae
RRSLMTFPCGNCNCYYRETPPPNPGGEDIPLQEGGQSGSQGGRVITQQPGTGGREMGISLGSDNVLGMVEQAGSLLNNLLDSARMQRLGHYCYRTGTPWCREHCPGFLQWIWGGCCACCLETVDDPDNPSAQFLQQLIQQYGPICVGMSFQQLPHCTQKIEQGEPLGDGDKQEVENGCKLHRELLKAAQPRCMGESLVKLLQNNGLGEDMQQTPPWSLILQAVSEGALSFVTSSDNPPTCWILQPEQQPCPPPPTDEEQLQGAVGGAPAPQQKKHPAQECRVTCKLNFRTLLQKLSRLEVLSLESGYKGPLGQAAKQIVDLIKKSLKRLVASDLATFLGPGIGLSLESQVFEVLVLLCLLSKGYLPLDPLHPEQTVLDPRVQGPWQRILRKVLVTTTAGENIWRQTQGEAPRQAPPPPDPWDDDEIERDGIVTGGGFGIPCQCLRCWRKLPTEKRPNRWL

SEQ ID NO: 8 - protein, 484 aa, Chlamydia pneumoniae
KGTTMVCPNNSWFRMCGNFNCEWVEVTTTEETTRQSASDISEEAGSSGGAAPITTQPTKITKVEKRVQFNTAQGDESTIHMIQEAGELVDSILSHRRTQGCTEYCYDSYATGCGQRCGSFGRLICGTYKACCLDREDNQVAGLVHECEQTHGPIAVALAAKTMGLNLMELVEKNTILSEEQKNEFRQHCSEAKTQLYGTMQSLSQNFFLEGVNSIRERGLDDSLVQAVLSFIATRSWEKTIESEEASGTSSASNSTRIPACYILNTSPLTTSRLSCGSRDARRPSSVGAEPQYVAKKYNDNGMARQLGKIQVTNLKTGDFSALGPFGLLIVKMLNSFLLSASQSTSSILKHTGGEICYTCPNFRDIVVLLMLAIGYCPANTDETSVVDIHMIDDPIMTIFYRLQYSYRTGKTSASFLKKKPSLVRQESLDCPTPAESVPLMSSLEEEDENEDDDEDGNLAYQQRILECSGHLQTLFLGIKINKE

SEQ ID NO: 9 - protein, 304 aa, Chlamydia pneumoniae
KKDYILHANWCCWKQMLKIQKKRMCVSVVITVGAIVGFFNSADAAPKKKKIPIQILYSFTKVSSYLKNEDASTIFCVDVDRGLLQHRYLGSPGWQETRRRQLFKSLENQSYGNERLGEETLAIDIFRNKECLESEIPEQMEAILANSSALVLGISSFGITGIPATLHSLLRQNLSFQKRSIASESFLLKIDSAPSDASVFYKGVLFRGETAIVDALSQLFAQLDLSPKKIIFLGEDPEVVQAVGSACIGWGMNFLGLVYYPAQESLFSYVHPYSTATELQEAQGLQVISDEVAQLTLNALPKMN

SEQ ID NO: 10 - protein, 277 aa, Chlamydia pneumoniae
RIFMRRYLFMVLALCLYRAAPLEAVVIKITDAQAVLKFAREKTLVCFNIEDTVVFPKQMVGQSAWLYNRELDLKTTLSEEQAREQAFLEWMGISFLVDYELVSANLRNVLTGLSLKRSWVLGISQRPVHLIKNTLRILRSFNIDFTSCPAICEDGWLSHPTKDTTFDQAMAIEKNILFVGSLKNGQPMDAALEVLLSGISSPPSQIIYVDQDAERLRSIGAFCKKANIYFIGMLYTPAKQRVESYNPKLTAIQWSQIRKNLSDEYYESLLSYVKSKG

SEQ ID NO: 11 - protein, 109 aa, Chlamydia pneumoniae
KRLKDEIKYTSLRRKAMLGKIIRGLSSLIVILCALNVGLIGITHNKLNIIAKLCGGVSTPATQITYIIIGIAGVICLLSFCPFCSKKSRHSHGDSCSSGGCHSHHSDKN

SEQ ID NO: 12 - protein, 102 aa, Chlamydia pneumoniae
HMEQFHLDREEILLLAKASALQLSEELIQEYQTSLSAVITSMKEALAIEIDDADSCESLFMHVVNVEDLREDSVTSDFNREEFLRNVPESLGGLVKVPAVIK

SEQ ID NO: 13 - protein, 494 aa, Chlamydia pneumoniae
KIMYRYSALELAKAVTLGELTATGVTQHFFHRIEEAEGQVGAFISLCKEQALEQAELIDKKRSRGEPLGKLAGVPVGIKDNIHVTGLKTTCASRVLENYQPPFDATVVERIKKEDGIILGKLNMDEFAMGSTTLYSAFHPTHNPWDLSRVPGGSSGGSAAAVSARFCPVALGSDTGGSIRQPAAFCGVVGFKPSYGAVSRYGLVAFASSLDQIGPLANTVEDVALMMDVFSGRDPKDATSREFFRDSFMSKLSTEVPKVIGVPRTFLEGLRDDIRENFFSSLAIFEGEGTHLVDVELDILSHAVSIYYILASAEAATNLARFDGVRYGYRSPQAHTISQLYDLSRGEGFGKEVMRRILLGNYVLSAERQNVYYKKATAVRAKIVKAFRTAFEKCEILAMPVCSSPAFEIGEILDPVTLYLQDIYTVAMNLAYLPAIAVPSGFSKEGLPLGLQIIGQQGQDQQVCQVGYSFQEHAQIKQLFSKRYAKSVVLGGQS

SEQ ID NO: 14 - protein, 500 aa, Chlamydia pneumoniae
EICQKCCSRRSIMSAVYADWESVIGLEVHVELNTASKLFSSALNRFGDEPNTNISTVCTGLPGSLPVLNQSAVEKAVLFGCAVEGEISLLSRFDRKSYFYPDSPRNFQITQFEHPIIRGGRIKAIVQGEERYFELAQTHIEDDAGMLKHFGEFAGVDYNRAGVPLIEIVSKPCMFCPEDGCCYATSLVSLLDYIGISDCNMEEGSIRFDVNVSVRPKGSPELRNKVEIKNMNSFAFMAQALEAEKQRQIDEYLNQPNKDPKLVIPAATYRWDPEKKKTVLMRLKESAEDYKYFPEPDLPTLQLTESYIERIRKTLPELPYDKYHRYIQEYGLSEDIASILISDKNIATFFEVACKDCKNFRSLSNWVTVEFGGRCKTLGVKLPSSGIFPEGVAQLVNAIDQGVITGKIAKEIADLMMESPGKNPEEILKEKPELLPMSDEGELQKIIAEVVLANPESIVDYKNGKTKALGFLVGQIMKRTAGKAPPKRVNELLLLELDKG

SEQ ID NO: 15 - protein, 922 aa, Chlamydia pneumoniae
  SITE 1...922: Xaa=unknown or other
MRFSLCGFPLVFSFTLLSVFDTSLSATTISLTPEDSFHGDSQNAERSYNVQAGDVYSLTGDVSISNVDNSALNKACFXVTSGSVTFAGNHHGXYFNNISSGTTKEGAVLCCQDPQATARFSGFSTLSFNQSPGDIKEQGCLYSKNALMLLNNYVVRFEQNQSKTKGGAISGANVTIVGNYDSVSFYQNAATFGGAIHSSGPLQIAVNQAEIRFAQNTAKNGSGGALYSDGDIDIDQNAYVLFRENEALTTAIGKGGAVCCLPTSGSSTPVPIVTFSDNKQLVFERNHSIMGGGAIYARKLSISSGGPTLFINNISYANSQNLGGAIAIDTGGEISLSAEKGTITFQGNRTSLPFLNGIHLLQNAKFLKLQARNGYSIEFYDPITSEADGSTQLNINGDPKNKEYTGTILFSGEKSLANDPRDFKSTIPQNVNLSAGYLVIKEGAEVTVSKFTQSPGSHLVLDLGTKLIASKEDIAITGLAIDIDSLSSSSTAAVIKANTANKQISVTDSIELISPTGNAYEDLRMRNSQTFPLLSLEPGAGGSVTVTAGDFLPVSPHYGFQGNWKLAWTGTGNKVGEFFWDKINYKPRPEKEGNLVPNILWGNAVDVRSLMQVQETHASSLQTDRGLWIDGIGNLFHVSASEDNIRYRHNSGGYVLSVNNEITPKHYTSMAFSQLFSRDKDYAVSNNEYRMYLGSYLYQYTTSLGNIFRYASRNPNVNVGILSRRFLQNPLMIFHFLCAYGHATNDMKTDYANFPMVKNSWRNNCWAIECGGSMPLLVFENGRLFQGAIPFMKLQLVYAYQGDFKETTADGRRFSNGSLTSISVPLGIRFEKLALSQDVLYDFSFSYIPDIFRKDPSCEAALVISGDSWLVPAAHVSRHAFVGSGTGRYHFNDYTELLCRGSIECRPHARNYNINCGSKFRF

SEQ ID NO: 16 - protein, 90 aa, Chlamydia pneumoniae
ALPVGEISSIESVTDICLFAVFALITAAVEDELKLSISIARPVMAMSSLEAISLVPKSKTKCDPGDCVNFETVTSAPSLITKYPADRLTF

SEQ ID NO: 17 - protein, 1003 aa, Chlamydia pneumoniae
  SITE 1...1003: Xaa=unknown or other
KSFRYNLSLIFSFLVVIPLTDSTTSSLSTSLLDEGNPQSMRKLRILAIVLIALSIILIAGGVVLLTVAIPGLSSVISSPAGMGACALGCVMLALGIDVLLKKREVPIVLASVTTTPGTGSPRSGISISGADSTIRSLPTYLLDEGHPQSMRKLRILAIVLIVFSIILIASGVVLLTVAIPGLSSVISSPAGMGACALGCVMLALGIDVLLKKREVPIVLASVTTTPGTGSPRSGISISGADSTIRSLPTYPLDEGHPQSMRKLRILAIVLIVFSIILIASGVVLLTVAIPGLSSIISSPAEMGACALGCVMLALGIDVLLKKREVPIVVPAPIPEEVVIDDIDEESIRLQQEAEAALARLPEEMSAFEGYIKVVESHLENMKSLPYDGHGLEEKTKHQIRVVRSSLKAMVPEFLDIRRIFEEEEFFFLSARKRLIDLATTLVERKILTEQLERNNLRKAFSYLYQDSIFKKIIDNFEKLAWKFMILSKSICRFTIIFENHEHGVAKSLLHKNAVLLEKVIYRSLQKSYRDIGMSSAKMKILHGNPFFSLEDNKKTIMKEHAEMLESLSSYRKVFLALSDENVVDTPSDPKKWDLSGIPCRDALSEISRDEQWQKKAHLKHQESLYTQARDRLTDQSSKENQKELEKAEQEYISSWERVKKFEIERVQERIQAIQKLYPNILEREEETTGQETVTPTVQGTTASSDLTDILGRIEVSSREDNQNQESCVKVLRSHEVEMSWEVKQEYGPKKKEFQDQMGSLERFFTEHIEELEVLQKDYSKHLSYFKKVNNKKEVQYAKFRLKVLESDLEGILAQTESAESLLTQEELPILATRGALEKAVFKGSLCCALASKAKPYFEEDPRFQDSDTQLRALTLRLQEAKASLEEEIKRFSNLENDIAEERRLLKESKQTFERAGLGVLREIAVESTYDLRSLTNTWEGTPESEKVYFSMYLNYYNEEKRRXKTRLVEMTQRYRDFKMALEAMQFNEEALLQEELSIQAPSE

SEQ ID NO: 18 - protein, 302 aa, Chlamydia pneumoniae
CKYSYLLNYPPPPRRSLGVSCSKLRSLSITLLVLGVLLLTLGIPGLTAGISFGAGLGFSALGGVLVISGLLFLLVRREVPTVRSEEIPRGVSVTPSEEPALEKAQKEPETKKILDRLPKELDQLDTYIQEVFACLERLKDPKYEDRGLLTEAKEKLRVFDVVEKDMMSEFLDIQRVLNEEAYYVEHCQDPLENIAYEIFSSQELRDYYCAGVCGYLPSGDARADRLKRSVKEVMDRFMRVTWKSWEASVMLDHSYGVARELFKKAVGVLEESVYKILFKSYRDAFYECEKAKIQRDGRFKWL

SEQ ID NO: 19 - protein, 477 aa, Chlamydia pneumoniae
DTSAHAEQRFRDINGCWEDLKQTIFWVGEHDCTDIETVRKSCMWLDRYADKFILREKEEKMERHELFHATMVRKASGHAYAKAKAAFEKERSNENQRKVKDVEKWLSKGLAEFRNQESRRARERLRELQTLYPEVSVEERVLERQRTKKVNLENLYADIEKKYHHCVREQEHYWKEVENKEAEYRENGEKVLSAEEVSECLQRLEDCLETWSKKLTKAEESVFEMKFDATEKLGNKVLSDVTNRLEILCEDAEEMIFRIEEIEMTLRMVELPLLFMKNTFEKASLQYNSCKEMLAKVEPQCKESPTYRSSQERLERLNQDLQTAYTNCQERLQGFSDLESKVRTCRDHLREQMKHFEVQGLNFINEELLWVGAELFTQARLDLVATVPYMEFYLQYHNIKREKVRSQWMAKTERYREIRQAFQGVMKEDLLAEDTILKEEDYWLLRDDWLLRDERKNRQRRLICNKIAAAQQRVKGF

SEQ ID NO: 20 - protein, 810 aa, Chlamydia pneumoniae
CKYFYLRSYPPPQHSVGSISSPSKLRVLAITFLVFGMLLLISGALFLTLGIPGLSAAISFGLGIGLSALGGVLMISGLLCLLVKREIPTVRPEEIPEGVSLAPSEEPALQAAQKTLAQLPKELDQLDTDIQEVFACLRKLKDSKYESRSFLNDAKKELRVFDFVVEDTLSEIFELRQIVAQEGWDLNFLINGGRSLMMTAESESLDLFHVSKRLGYLPSGDVRGEGLKKSAKEIVARLMSLHCEIHKVAVAFDRNSYAMAEKAFAKALGALEESVYRSLTQSYRDKFLESERAKIPWNGHITWLRDDAKSGCAEKKLRDAEERWKKFRKAVFWVEEDGGFDINNLLGDWGTVLDPYRQERMDEITFHELYEKTTFLKRLHRKCALAKTTFEKKRSKKNLQAVEEANARRLKYVRDWYDQEFQKAGERLEKLHALYPEVSVSIRENKIQETRSNLEKAYEAIEENYRCCVREQEDYWKEEEKREAEFRERGNKILSPEELESSLEQFDHGLKNFSEKLMELEGHILKLQKEATAEVENKILSDAESRLEIVFEDVKEMPCRIEEIEKTLRMAELPLLPTKKAFEKACSQYNSCAEMLEKVKPYCKESLAYVTSKERLVSLDEDLRRAYTECQKRFQGDSGLESEVRACREQLRERIQEFETQGLDLVEKELLCVSSRLRNTECDCVSGVKKEAPPGKKFYAQYYDEIYRVRVQSRWMTMSERLREGVQACNKMLKAGLSEEDKVLKEEEYWLYREERKNKEKRLVGTKIVATQQRVAAFESIEVPEIPEAPEEKPSLLDKARSLFTREDHS

SEQ ID NO: 21 - protein, 83 aa, Chlamydia pneumoniae
EWSSRVNKERALSSKLGFSSGASGISGTSMDSNAATRCCVATILVPTKRFSLFFLSSRYNQYSSSLRTLSSSLRPAFNILLHA

SEQ ID NO: 22 - protein, 246 aa, Chlamydia pneumoniae
FWYSIMTAAPAILHVSPTPPEETKFVIPKDSKSRALGITLLVVGILLVVCGAIVLSGVISGLSALIVCGLGISTISLGVVLFVLGLILLLRKRELTLEQIEAKQIAETFADELKELEMYIQSTEKSLEKIEGSRYSDQGFLNRATQKILDLESSLSSITSEFRDLRQLFDEEKIELLSGERLLEFIAANLFKQGRDVYLNLGNLADIRAYMGPNNYKVAMVIEKAKAVVHEFIVLTTMARELEFFF

SEQ ID NO: 23 - protein, 265 aa, Chlamydia pneumoniae
GIRVFFLKNKYGLLKGMYQENLRLLERLLYNSVQKSYADRLFSYEKTKMVHDTPLIPWEEDKEKCAEAEKAFLEQQKILLDYGKSIFWLNENDEINLNDPWSWGLNTVRTRKVFQEVDDSERWNHKVLIQKLEDDYEKLLEESSKESTEANKKLLSDLVDRLEDAKTKFFLKKQEEVETRVKDLRARYGGTVDPKQDTEAKKKVELEASLETFLDSIESELVQCLEDQDIYWKEQDVKDLARTQELEEQDIEAKREEAAEDLRKS

SEQ ID NO: 24 - protein, 277 aa, Chlamydia pneumoniae
ESLNERLKKSKTMLDRAKWHIENAEDSITWWTSQIEMKDMKARLKILKEDITSVLPEIDEIETCLSLEELPLLTTRELLTKSYLKFKICSETLLKMTSVFENNIYVQEYEVQLQNLGFKLQGISQRFGKKQDDFANLEEQVALQKKRLRELTQNFEIQGFNFMKEDFKAAAKDLYIRSTAEQKMNFDVPCMELFRRYHEEVNKPLLELMYNCADSYRDAKKKLCSLRLDEKELLQKEIKKEEFYQKKQQRHADRSRHTRYQKLRIAEELALELKKKI

SEQ ID NO: 25 - protein, 202 aa, Chlamydia pneumoniae
LLSLSNLLYWKESPLREKKVVMKIPLRFLLISLVPTLSMSNLLGAATTEELSASNSFDGTTSTTSFSSKTSSATDGTNYVFKDSVVIENVPKTGETQSTSCFKNDAAAGDLNFLGGGFSFTFSNIDATTASGAAIGSEAANKTVTLSGFSALSFLKSPASTVTNGLGAINVKGNLSLLDNDKVLIQDNFSTGDGGQLIVQAP

SEQ ID NO: 26 - protein, 199 aa, Chlamydia pneumoniae
GIDSGQFLNRRWRTINCAGSLKIANNKSLSFIGNSSSTRGGAIHTKNLTLSSGGETLFQGNTAPTAAGKGGAIAIADSGTLSISGDSGDIIFEGNTIGATGTVSHSAIDLGTSAKITALRAAQGHTIYFYDPITVTGSTSVADALNINSPDTGDNKEYTGTIVFSGEKLTEAEAKDEKNRTSKLLQNVAFKNGTVVLKR

SEQ ID NO: 27 - protein, 483 aa, Chlamydia pneumoniae
KGDVVLSANGFSQDANSKLIMDLGTSLVANTESIELTNLEINIDSLRNGKKIKLSAATAQKDIRIDRPVVLAISDESFYQNGFLNEDHSYDGILELDAGKDIVISADSRSIDAVQSPYGYQGKWTINWSTDDKKATVSWAKQSFNPTAEQEAPLVPNLLWGSFIDVRSFQNFIELGTEGAPYEKRFWVAGISNVLHRSGRENQRKFRHVSGGAVVGASTRMPGGDTLSLGFAQLFARDKDYFMNTNFAKTYAGSLRLQHDASLYSVVSILLGEGGLREILLPYVSKTLPCSFYGQLSYGHTDHRMKTESLPPPPPTLSTDHTSWGGYVWAGELGTRVAVENTSGRGFFQEYTPFVKVQAVYARQDSFVELGAISRDFSDSHLYNLAIPLGIKLEKRFAEQYYHVVAMYSPDVCRSNPKCTTTLLSNQGSWKTKGSNLARQAGIVQASGFRSLGAAAELFGNFGFEWRGSSRSYNVDAGSKIKF

SEQ ID NO: 28 - protein, 177 aa, Chlamydia pneumoniae
MKSSFPKFVFSTFAIFPLSMIATETVLDSSASFDGNKNGNFSVRESQEDAGTTYLFKGNVTLENIPGTGTAITKSCFNNTKGDLTFTGNGNSLLFQTVDAGTVAGAAVNSSVVDKSTTFIGFSSLSFIASPGSSITTGKGAVSCSTGSLSLTKMSVCSSAKTFQRIMAVLSPQKLFH

SEQ ID NO: 29 - protein, 597 aa, Chlamydia pneumoniae
LEFDKNVSLLFSKNFSTDNGGAITAKTLSLTGTTMSALFSENTSSKKGGAIQTSDALTITGNQGEVSFSDNTSSDSGAAIFTEASVTISNNAKVSFIDNKVTGASSSTTGDMSGGAICAYKTSTDTKVTLTGNQMLLFSNNTSTTAGGAIYVKKLELASGGLTLFSRNSVNGGTAPKGGAIAIEDSGELSLSADSGDIVFLGNTVTSTTPGTNRSSIDLGTSAKMTALRSAAGRAIYFYDPITTGSSTTVTDVLKVNETPADSALQYTGNIIFTGEKLSETEAADSKNLTSKLLQPVTLSGGTLSLKHGVTLQTQAFTQQADSRLEMDVGTTLEPADTSTINNLVINISSIDGAKKAKIETKATSKNLTLSGTITLLDPTGTFYENHSLRNPQSYDILELKASGTVTSTAVTPDPIMGEKFHYGYQGTWGPIVWGTGASTTATFNWTKTGYIPNPERIGSLVPNSLWNAFIDISSLHYLMETANEGLQGDRAFWCAGLSNFFHKDSTKTRRGFRHLSGGYVIGGNLHTCSDKILSAAFCQLFGRDRDYFVAKNQRYSLRRNSLLPAQRNLYLSSLQTTALFVVLCSYRDSCSLFRKP

SEQ ID NO: 30 - protein, 230 aa, Chlamydia pneumoniae
LRIKGTVYGGTLYYQHNETYISLPCKLRPCSLSYVPTEIPVLFSGNLSYTHTDNDLKTKYTTYPTVKGSWGNDSFALEFGGRAPICLDESALFEQYMPFMKLQFVYAHQEGFKEQGTEAREFGSSRLVNLALPIGIRFDKESDCQDATYNLTLGYTVDLVRSNPDCTTTLRISGDSWKTFGTNLARQALVLRAGNHFCFNSNFEAFSQFSFELRGSSRNYNVDLGAKYQF

SEQ ID NO: 31 - protein, 427 aa, Chlamydia pneumoniae
MRSSFSLLLISSSLAFPLLMSVSADAADLTLGSRDSYNGDTSTTEFTPKAATSDASGTTYILDGDVSISQAGKQTSLTTSCFSNTAGNLTFLGNGFSLHFDNIISSTVAGVVVSNTAASGITKFSGFSTLRMLAAPRTTGKGAIKITDGLVFESIGNLDLNENASSENGGAINTKTLSLTGSTRFVAFLGNSSSQQGGAIYASGDSVISENAGILSFGNNSATTSGGAISAEGNLVISNNQNIFFDGCKATTNGGAIDCNKAGANPDPILTLSGNESLHFLNNTAGNSGGAIYTKKLVLSSGRGGVLFSNNKAANATPKGGAIAILDSGEISISADLGNIIFEGNTTSTTGSPASVTRNAIDLASNAKFLNLRATRGNKVIFYDPITSSGATDKLSLNKADAGSGNTYEGYIVFSGEKLSEVRNLTI

SEQ ID NO: 32 - protein, 507 aa, Chlamydia pneumoniae
RLHRFLWRETLRSKKPDNLKSTFTQAVELAAGALVLKDGVTVVANTITQVEGSKVVMDGGTTFEASAEGVTLNGLAINIDSLDGTNKAIIKATAASKDVALSGPIMLVDAQGNYYEHHNLSQQQVFALIELSAQGTMTTTDIPDTPILNTTNHYGIKGTGIIVWVDDATAKTKNATLTWTKTGYKPNPERQGPLVPNSLWGSFVDVRSIQSLMDRSTSSLSSSTNLWVSGIADFLHEDQKGNQRSYRHSSAGYALGGGFFTASENFFNFAFCQLFGYDKDHLVAKNHTHVYAGAMSYRHLGESKTLAKILSGNSDSLPFVFNARFAYGHTDNNMTTKYTGYSPVKGSWGNDAFGIECGGAIPVVASGRRSWVDTHTPFLNLEMIYAHQNDFKENGTEGRSFQSEDLFNLAVPVGIKFEKFSDKSTYDLSIAYVPDVIRNDPGCTTTLMVSGDSWSTCGTSLSRQALLVRAGNHHAFASNFEVFSQFEVELRGSSRSYAIDLGGRFGF

SEQ ID NO: 33 - protein, 494 aa, Chlamydia pneumoniae
MKTSVSMLLALLCSGASSIVLHAATTPLNPEDGFIGEGNTNTFSPKSTTDAAGTTYSLTGEVLYIDPGKGGSITGTCFVETAGDLTFLGNGNTLKFLSVDAGANIAVAHVQGSKNLSFTDFLSLVITESPKSAVTTGKGSLVSLGAVQLQDINTLVLTSNASVEDGGVIKGNSCLIQGIKNSAIFGQNTSSKKGGAISTTQGLTIENNLGTLKFNENKAVTSGGALDLGAASTFTANHELIFSQNKTSGNAANGGAINCSGDLTFTDNTSLLLQENSTMQDGGALCSTGTISITGSDSINVIGNTSGQKGGAISAASLKILGGQGGALFSNNVVTHATPLGGAIFINTGGSLQLFTQGGDIVFEGNQVTTTAPNATTKRNVIHLESTAKWTGLAASQGNAIYFYDPITTNDTGASDNLRINEVSANQKLSGSIVFSGERLSTAEAIAENLTSRINQPVTLVEGSLVLKQGVTLITQGFSQEPESTLLLDLGTSL

SEQ ID NO: 34 - protein, 86 aa, Chlamydia pneumoniae
MVSAFIDKFVMTISSVEAYNEVPRSKRSVDSGSCENPCVIKVTPCLSTKLPSTKVTGWLILEVRFSAIASAVDNLSPENTIDPESF

SEQ ID NO: 35 - protein, 450 aa, Chlamydia pneumoniae
ASTEDIVITNLSINADTIYGKNPINIVASAANKNITLTGTLALVNADGAFYENHTLQDSQDYSFVKLSPGAGGTIITQDASQKPLEVAPSRPHYGYQGHWNVQVIPGTGTQPSQANLEWVRTGYLPNPERQGSLVPNSLWGSFVDQRAIQEIMVNSSQILCQERGVWGAGIANFLHRDKINEHRYRHSGVGYLVGVGTHAFSDATINAAFCQLFSRDKDYVVSKNHGTSYSGVVFLEDTLEFRSPQGFYTDSSSEACCNQVVTIDMQLSYSHRNNDMKTKYTTYPEAQGSWANDVFGLEFGATTYYYPNSTFLFDYYSPFLRLQCTYAHQEDFKETGGEVRHFTSGDLFNLAVPIGVKFERFSDCKRGSYELTFAYVPDVIRKDPKSTATLASGATWSTHGNNLSRQGLQLRLGNHCLINPGIEVFSHGAIELRGSSRNYNINLGGKYRF

SEQ ID NO: 36 - protein, 661 aa, Chlamydia pneumoniae
KLWSNPNLRLMKRCFLFLASFVLMGSSADALTHQEAVKKKNSYLSHFKSVSGIVTIEDGVLNIHNNLRIQANKVYVENTVGQSLKLVAHGNVMVNYRAKTLVCDYLEYYEDTDSCLLTNGRFAMYPWFLGGSMITLTPETIVIRKGYISTSEGPKKDLCLSGDYLEYSSDSLLSIGKTTLRVCRIPILFLPPFSIMPMEIPKPPINFRGGTGGFLGSYLGMSYSPISRKHFSSTFFLDSFFKHGVGMGFNLHCSQKQVPENVFNMKSYYAHRLAIDMAEAHDRYRLHGDFCFTHKHVNFSGEYHLSDSWETVADIFPNNFMLKNTGPTRVDCTWNDNYFEGYLTSSVKVNSFQNANQELPYLTLRQYPISIYNTGVYLENIVECGYLNFAFSDHIVGENFSSLRLAARPKLHKTVPLPIGTLSSTLGSSLIYYSDVPEISSRHSQLSAKLQLDYRFLLHKSYIQRRHIIEPFVTFITETRPLAKNEDHYIFSIQDAFHSLNLLKAGIDTSVLSKTNPRFPRIHAKLWTTHILSNTESKPTFPKTACELSLPFGKKNTVSLDAEWIWKKHCWDHMNIRWEWIGNDNVAMTLESLHRSKYSLIKCDRENFILDVSRPIDQLLDSPLSDHRNLILGKLFVRPHPCWNYRLSLRYGWHRRTLRTT

SEQ ID NO: 37 - protein, 245 aa, Chlamydia pneumoniae
EQRSKLNVALALLELGCDTPKLLEYITERLVQPHYNETLALSFSKGRTLQNWKRVNIIVPQDPQERERLLSTTRGLEEQILTFLFRLPKEAYLPCIYKLLASQKTQLATTAISFLSHTSHQEALDLLFQAAKLPGEPIIRAYADLAIYNLTKDPEKKRSLHDYAKKLIQETLLFVDTENQRPHPSMPYLRYQVTPESRTKLMLDILETLATSKSSEDIRLLIQLMTEGDAKNFPVLAGLLIKIVE

SEQ ID NO: 38 - protein, 348 aa, Chlamydia pneumoniae
CSRSPYPNIEILARGVEHRSMGLFHLTLFGLLLCSLPISLVAKFPESVGHKILYISTQSTQQALATYLEALDAYGDHDFFVLRKIGEDYLKQSIHSSDPQTRKSTIIGAGLAGSSEALDVLSQAMETADPLQQLLVLSAVSGHLGKTSDDLLFKALASPYPVIRLEAAYRLANLKNTKVIDHLHSFIHKLPEEIQCLSAAIFLRLETEESDAYIRDLLAAKKSAIRSATALQIGEYQQKRFLPTLRNLLTSASPQDQEAILYALGKLKDGQSYYNIKKQLQKPDVDVTLAAAQALIALGKEEDALPVIKKQALEERPRALYALRHLPSEIGIPIALPIFLKTKNSEAS

SEQ ID NO: 39 - protein, 196 aa, Chlamydia pneumoniae
  SITE 1...196: Xaa=unknown or other
MSLPLVLGSSSPRRKFILEKFRVPFTVIPSNFDESKVSYSGDPIAYTQELAAQKAYAVSELHSPCDCIILTGDTIVSYDGRIFTKPQXKAXAIQMLKTLRNQTHDVVTSIAVLHKGKLLTGSETSQISLTMIPDHRIESYIDTVGTLNNCGAYDVCHGGLILKKVHGCVYNVQGLPIQTLKYLLEELNIDLWDYSI

SEQ ID NO: 40 - protein, 127 aa, Chlamydia pneumoniae
  SITE 1...127: Xaa=unknown or other
VXRNRKTGINDQEIRSVLGKMLFGGDDAFKQIQALSGGETARLLMAGMMLENHNVLILDEANNHLDLESVSALSWAINDYKGTAIFVSHDRGLIQDCATKLLIFDKDKITFFDGTMVDYTAGHKQLL

SEQ ID NO: 41 - protein, 432 aa, Chlamydia pneumoniae
  SITE 1...432: Xaa=unknown or other
LYSKQHFVMLSAMSIVLDKIGKSLGTRILFDDVSVVFNPGNCYGLTGPNGAGKSTLLKIIMGMIEPTRGSISLPKKVGILRQNIDSFHDTTVLDCVIMGNTRLWEALQRRDNLYLQEFTDAIGMELGEIEEIIGEENGYRADSEAEELLTGIGIPNEMFDKKMAMIPIDLQFRVLLCQALFGHPEALLLDEPTNHLDLYSINWLGNFLKDYEGTVIVVSHDRHFLNTITTHIADIDYDTIIIYPGNYDDMVEMKTASREQEKADIKSKEKKISQLKEFVAKFGAGSRASQVQSRLREIKKLQPQELKKSNIQRPYIRFPLSDKSSGKVVLSLEAITKDYGDHQVIHPFSLEIYQGDKLGIIGNNGLGKTTLMKLLAGVEAPSSGSIKLGHQAICSYFPQNHSDVLADCGQETLFEXYAIAKPELTIKKSAVC

SEQ ID NO: 42 - protein, 131 aa, Chlamydia pneumoniae
  SITE 1...131: Xaa=unknown or other
REVMIASIYSFLDYLKMVKSASPHTLRNYCLDLNGLKIFLXERGNLAPSSPLQLATEKRKVSELPFSLFTKEHVRMYIAKLIENGKAKRTIKRCLSSIKSFAHYCVIQKILLENLRKLSTDLVFLRSCLPR

SEQ ID NO: 43 - protein, 307 aa, Chlamydia pneumoniae
MSSRELIILGCSSQQPTRTRNQGAYLFRWNGEGLLFDPGEGTQRQFIFANIAPTTVNRIFVSHFHGDHCLGLGSMLMRLNLDKVSHPIHCYYPASGKKYFDRLRYGTIYHETIQVVEHPISEEGIVEDFGSFRIEAQRLQHQVDTLGWRITEPDTIKFLPKELESRGIRGLIIQDLIRDQEISIGGSTVYLSDVSYVRKGDSIAIIADTLPCQAAIDLAKNSCMMLCESTYLEQHRHLAESHFHMTAKQAATLAKRAATQKLILTHFSARYLNLDDFYKEASAVFPNVSVAQEYRSYPFPKNPLLNK

SEQ ID NO: 44 - protein, 440 aa, Chlamydia pneumoniae
AFQRIKRKYHLSCRPSRSWENKHRAHIAKVLHRKFFRFSVGGMRDEAEIKGHRRTYIGAMPGKMVQALKQSQAMNPVIMIDEVDKIGASYHGDPASALLEVLDPEQNKDFLDHYLDVRVDLSNVLFILTANVLDTIPDPLLDRMEILRLSGYILEEKLQIAKKYLVPKARKEIGLTASEVNFQPEALKYMINNYAREAGVRTLNGNIKKVLRKVALKIVQNQEKPKSKKITFKISSKNLQTYLGKPIFSSDRFYESTPVGVATGLAWTSLGGATLYIESVQVSSLKTDMHLTGQAGEVMKESSQIAWTYLHSALHRYAPGYTFFPKSQVHIHIPEGATPKDGPSAGITMVTSLLSLLLETPVVNNLGMTGEITLTGRVLGVGGIREKLIAARRSRLNILIFPEDNRRDYEELPAYLKTGLKIHFVSHYDDVLKVAFPKLK

SEQ ID NO: 45 - protein, 424 aa, Chlamydia pneumoniae
  SITE 1...424: Xaa=unknown or other
PSIRTIVDSTTNSDSPILDPNPEDVEKLLDESEEESEDQSTERLLPSELFILPLNKRPFFPGMAAPILIESGPYYEVLKVLAKSSQKYIGLVLTKKENADILKVSFNQLHKTGVAARILRIMPIEGGSAQVLLSIEERIRIIEPIKDKYLKARVSYHADNKELTEELKAYSISIVSVIKDLLKLNPLFKEELQIFLGHSDFTEPGKLADFSVALTTATREELQEVLETTNMHDRIDKALILLKKELDLSRLQSSINQKIEATITKSQKEFFLKEQLKTXKKELGLEKEDRAIDIEKFSERLRKRHVPDYAMEVIQDEIEKLQTLETSSAEYTVCRNYLDWLTIIPWGIQSKEYHDLKKAEIVLNKDHYGLDEIKQRILELISVGKLSKGLKGSIICLVGPPGVGKTSIGRTLLKSCIESSSVSQ

SEQ ID NO: 46 - protein, 122 aa, Chlamydia pneumoniae
  SITE 1...122: Xaa=unknown or other
RMFLQFFHPIVFSDQSLSFLPYLGKSSGIIEKCSNIVEHYLHLGGDTSVIITGVSGATFLSVDHALPISKSEKIIKILSYILILPLILALFIKIVLRIILFXKYRGLIXDVKKEDLEKNTYT

SEQ ID NO: 47 - protein, 150 aa, Chlamydia pneumoniae
SNKNERNENIYCFNLFRYIRFFAALNIRTNDGLRFCYSYILLRPMLLDSSLLRKGGQELLKKFQIKLRTTSIKSSLISLRQQLGKREATQSDILYGTSRFQYLNSFEIEDPRIPPTMAAQLQEIIWSRSVMELKIKFYVYLNSERNKTKP

SEQ ID NO: 48 - protein, 392 aa, Chlamydia pneumoniae
MDYYSILGISKTASAEEIKKAYRKLAVKYHPDKNPGDAAAEKRFKEVSEAYEVLSDPQKRDSYDRFGKDGPFAGAGGFGGAGGMGNMEDALRTFMGAFGGEFGGGSFFDGLFGGLGEAFGMRSDPAGARQGASKKVHINLTFEEAAHGVEKELVVSGYKSCETCSGQGAVNPQGIKSCERCKGSGQVVQSRGFFSMASTCPECGGEGRIITDPCSSCRGQGRVKDKRSVHVHIPAGVDSGMRLKMEGYGDAGQNGAPSGDLYVFIDVESHPVFERRGDDLILELPIGFVDAALGMKKEIPTLLKTEGSCRLTVPEGIQSGTILKVRNQGFPNVHGKGRGDLLVRISVETPQNLSEEQKELLRTFASTEKAENFPKKRSFLDKIKGFFSDFTV

SEQ ID NO: 49 - protein, 258 aa, Chlamydia pneumoniae
MGVVQNQVISSIRDVLKLVWELRFAEHKMLLLSRQSGSGGTFQLSCAGHELAGVLAGKSLIPGKDWSFPYYRDQGFPIGLGCDLSEIFASFLARTTPNHSSARMMPYHYSHKKLRICCQSSVVGTQFLQAAGRAWAVKHSSADEVVYVSGGDGATSQGEFHEMLNFVALHQLPLITVIQNNHWAISVPFEDQCGADLASLGRCHQGLAVYEVDGGNYTSLTETFSHAVDQARQHSVPALILIDVVRLSSHSNSDNQEK

SEQ ID NO: 50 - protein, 410 aa, Chlamydia pneumoniae
MDKDPLILLEKEAINVFGLSPFEIEEIKAEAQEEVRKSCEIAEALPFPSKGSTSHEVFSPYTETLIDYENSESAQNLRNSEPKVMRDAISEALVEEMTRDSGVIVFGEDVAGDKGGVFGVTRNLTEKFGPQRCFNSPLAEATIIGTAIGMALDGIHKPVVEIQFADYIWPGINQLFSEASSIYYRSAGEWEVPLVIRAPSGGYIQGGPYHSQSIEGFLAHCPGIKVAYPSNAADAKALLKAAIRDPNPVVFLEHKALYQRRIFSACPVFSHDYVLPFRKAAIVHPGKDLTIVSWGMPLVLSLEVAQELASRGISIEVIDLRTMVPCDFATVLKSLEKTGRLLVIHEASEFCGFGSELVATMSEQGYAYLDAPIRRLGGLHAPVPYSKVLENEVLPHKESILQAAKSLAEF

SEQ ID NO: 51 - protein, 429 aa, Chlamydia pneumoniae
VNFLLPTTCRGILMAEISTPSLPDSSIVSQKTPPVPDPDSSPDHIPTIPTQAPFKPQRKKETPSSIVNAIAFAILAFLSCLGGVFAICLGCSLEITMPLFILTAVFIAFTLLYFIHYLEKPKIPEPLPTPPPSPTLRAPTLTPEIPAPAPGIPLPPTLPKVDRTKLTCNPDIHYPSTYDPKACFSLLKQLFSLDPETRPEDRKYSNKLASILLRSKEKSGFRFHCFKGHFSHDKILNKKSGAVVISSHSSMDFSTTLGRAFAVTTCLQRSCWEKIKNNIPTPEKHLPIGSCVSGPWDVEEGAQLYTSHLIVINPPTLETLIKEKMRRAITLKDFSMKEAFTNLVLAYLQCFDICIEHNLESVQLEVFGLNNLSADQEEFTTWESCCHLALLESVRILLASKEEYALSNVSVNSISQVPLQTACRALFLN

SEQ ID NO: 52 - protein, 524 aa, Chlamydia pneumoniae
  SITE 1...524: Xaa=unknown or other
TTLEEDAGSSLKPLPKTFPCATALYITHRRERKSEHQMWNRCQVFSSFFFRYPISSWLIRLRASCECFQQRHPIFLCGLYWLAGITSRGYPECSALILIFLGMFLPRNPKQWLPLASAWIISLMLTPAPFLHDGPISGTFVIHHAGGQGXTTEKLFVFRRPVGKRAHHLXCQILSESRLELKKVYELEGTLHHTSQIVFKSNACYKEIPRSRFYIMKEKCRESSCHFLNHRFPSSEVGPFASSLLLGTPLPQNLRDLFRQKGLSHLFAISGWHFSLCATTLWMLCALLPLKIKKILSFIVLTSLSCIFPMSLSVWRSWISVTLLCFSWCFSGSCSGLNRLGAGFILCSIFFSRFSPTFVLSFLATLGILLFFPKIFSFLYTPWTQFLSPFWLYPIRYLAMTLAISLSAQLFIVLPIMQYFGSLPLEGLLYNLIVPFTILPIIVFLIATIILPCCSPITEALIQGFLSHPWLHNPNILKTLSFAPVPPWMLTLASLILFFIGILRTNVSPYASTSATSYRFIETL

SEQ ID NO: 53 - protein, 276 aa, Chlamydia pneumoniae
AKSLWDSERKKMKKPDNDSTFDVRSFFPFDVLCIEQLRKEMSWEVVSAKIPRLPRGWYELMGLSKEDRIDFCLDFWCSVLGIEHKESPSICRFFSLLETIEVYIYRLEKEPYQLKMFYVFRDGRCGFQGEPPLLDFLGHHRLPPLGDRHYEKFFSIHNGFGKWEDEGIFPMRSLAKVQQKLRQQLVVMNKMQAEDNCYSLGIFPFYGYEEPFAYQSFFFDPEIRRDLPSPNVLLNEESLEHRSLETIELLHLSKSYYPSFLSWLENYLHSEEVYNE

SEQ ID NO: 54 - protein, 113 aa, Chlamydia pneumoniae
VRRCIMNEPTRTYLESEKDTQDQIEELQATCIVKNAAGIHVRPAGVIVRLFDGEPCDVHFTYAGKTINAKSIMSILMLGAPQGGEILVTIRSKEAHRILQKIQDAFSSGFGEL

SEQ ID NO: 55 - protein, 420 aa, Chlamydia pneumoniae
MDTQSSIGNEEWRIAGTSVVSGMALGKVFFLGTSPLHVRELTLPQEEVEHEIHRYYKALNRSKSDIVALEQEVTGQQGLQEVSSILQAHLEIMKDPLLTEEVVNTIRKDRKNAEYVFSSVMGKIEESLTAVRGMPSVVDRVQDIHDISNRVIGHLCCQHKSSLGESDQNLIIFSEELTPSEVASANSAYIRGFVSLVGAATSHTAIVSRAKSIPYLANISEELWNIAKRYNGKLVLIDGYRGELIFNPKPATLQSCYKKELSVVAHTSQRLVRKSLHPIVSSHAGSDKDVEDLLENFPQTSIGLFRSEFLAVILGRLPTLREQVDLYEKLARFPGDSPSVLRLFDFGEDKPCPGIKNKKERSIRWLLDYSVILEDQLQAIAKASLQGSIKVLIPGVSDVSEIIEVKKKWETIQTRFPKRP

SEQ ID NO: 56 - protein, 102 aa, Chlamydia pneumoniae
TSKCNFAPSSDPHDSPCTSSCEQNQVPVSICGEAAGQLSLTPLFIGLGVQELSVAMPVINRLRNHIALLELNSCLEITEALLQAKTCSEVEELLNRNNKITS

SEQ ID NO: 57 - protein, 98 aa, Chlamydia pneumoniae
ISMGSGYAKKKKEAKIMEQQFLEMEASLLEKRYEGQAGNGLVSVVINGKCDLISVKVQPTCLDPEDPEVIEDLFRAAFKLAKEQMDQEMSLMRSTMPF

SEQ ID NO: 58 - protein, 271 aa, Chlamydia pneumoniae
VVVKKCIFKGFLKKRSWRSYRLWLKMTILRRRKKHWRRSPVQHKEACVMQNLFMTYVISLFPKSLSPDTVAQALGFASQDSLRTLDNAILQRDYATALGIVTDFLNSGVAPVTFLHDLTLFYRNLLLTNSTTSKFSSQYKTEQLLEIIDFLGESAKHLQNTIFEQTFLETVIIHIIRIYQRPVLSELISSIKSRQFEGLRNIKEPTLTQQVSAPQPQPTYKEQSFLEKKNQPAAEGKIISVEVKSSASIKSAAVDTLLQFAVVEFSGILRQ

SEQ ID NO: 59 - protein, 233 aa, Chlamydia pneumoniae
MTLQPYQASSRKYRPQIFREILGQSSVVAVLKNALVFNRAAHAYLFSGIRGTGKTTLARILAKALNCVHLSEDGEPCNQCFSCKEIASGSSLDVLEIDGASHRGIEDIRQINETVLFTPVKAKFKIYIIDEVHMLTKEAFNALLKTLEEPPQHVKFFFATTEIHKIPGTILSRCQKMHLQRIPEKTILEKLSLMAQDDHIEASQEALAPIARAAQGSLRDAESLYDLRNIFIS

SEQ ID NO: 60 - protein, 346 aa, Chlamydia pneumoniae
CKYLYHHSYPPPQHSVGSISSRYKLRVLAITFLVLGVLLLISGALFLTLGIPGLTAGVSFGLGIGLSALGGVLVVSGLLCLLVKREVSKVCPEEIPAVQPEETPEGVPVTPFEKPALDEAQKEQKTQKILDQLPQELDQLDRYIQEVFACLGPLKDLKYEDQGFLQDVKEEFQVFDFVQKDMIAEFVELQQILCQEGRLLEFVINQTRYIGRDLFKREDSLYKLWEWLGYLPSGDVRGERLKKSAREVVDRFMRTTCNIRKIAMTFDRHVYSVAKTAFEKAFGALETCVYESMRESYREAFCEYEKAKLLGDEEKSAHAEQRFQDIKNRWEDVKDAFFWVKEDGED

SEQ ID NO: 61 - protein, 145 aa, Chlamydia pneumoniae
KKMGKIEIDDAIGNSCKWSERYEEHRITRARWYKVAEHQLFNATMRVKDSLREHNEARVAFEKERSKENQRQVQKKKEKRLRDLKELHDQELPRAQERLRELQALYPEIAVSVVEARREVASDLEKAHESIDKHYQSCVREQELY

SEQ ID NO: 62 - protein, 279 aa, Chlamydia pneumoniae
EEEEKQEAEFRENGTKIRSMEEVSEYLQQVENQLESCSKRLTKMETFALGVRLEAKEEIESIILSDVVNRFEVLCRDIEDMLSRVEEIERMLRMAELPVLPIKEALTKAFVQHNSCKEKLTKVEPYFKESPAYLTSENRLQSLNQTLQRAYKESQKVSGLESEVRACREQLKDQVRQFETQGVSLIKEEILFVTSTFRTKFSYHSFRLHVPCMRLYEEYYDDIDLERTRARWMAMSERYRDAFQAFQEMLKEGLVEEAQALRETEYWLYREERKSKKKH

SEQ ID NO: 63 - protein, 644 aa, Chlamydia pneumoniae
CKYLYHHSYPPPPPPPDQSVGASFCLSKFRVLAITFLVLGVLLLISGALFLTLGISGVSLGVGLGLSALGSVLVISGFLLLLERREVSGVGLEGIPTGIPVGPSAEPSSEEIQKKQKAKQILDQLPQELDQLDTDIQHVLSCLGKLKDLKCKDRGLLKDAKEKLQVFDFVWKDMMMEFVELQQVMDQESRYLEGLIHEVQSIAHKLFVDDVNIRSHLGESCGYLPSEDVRGELLKRFAKEVVARFMKVTRDIRKIAMAFNKNAYGAAKNAFDKAFGSLETCLYKSLTKSYRDTFCDYKRAKILPDENNSARAEQRFREVKDHWEDLNETVFWVKEDGRIDIEVLTAVGGWPDRYPEHLILEKRKDKVMSHQLWEATMRVKEAEVTYSVARVAFEKDGSQQNQKKFQEKTKERLRCLKDLRDQECHRAQERLEKLTALYPEVSVSVVETERERKFNLEKAYGNLEERYQSVVQDQEDYWTEQKNREAEFRAKGTKVRSMEEVAEHLQILENLLEDCYKRLSKAETFALGVEREATEEIEYTILSDAANRLKVLCEDIEDTLPRVEEIEMMLRMAERPLHPIKQAFTKAFVQYNRCKERLAKVEPYYKESPAYVNSEERLQSLDQASQCIQRVPKGFKFRNGSMYI

SEQ ID NO: 64 - protein, 114 aa, Chlamydia pneumoniae
SKICFAFCFFCISSEEGSAEGPTGIPVGIPSKPTPETSRLSKSNRNPEITSTLPNAESPKPTPRETPEIPNVRKRAPEISKSTPRTKKVIAKTRNLDRQKEAPTDWSGGGGGGG

SEQ ID NO: 65 - protein, 167 aa, Chlamydia pneumoniae
IAKSDCRVWIRLHSAYKESQKVSSLETEACTYREYLREQVQQFETQGVSLIKEELLFLSSTLKSKLSYDPLIANIPCMKFYYQYYDDIDKARAQSRWLEKSERYRNAKRRFQEIVKKGLFKEAKPLKKEEYRLLQEERSNKEKRLIYNKMAVARQRVQEFESMEIPE

SEQ ID NO: 66 - protein, 235 aa, Chlamydia pneumoniae
CKYTYHPPQLPPDHSVGATSWQPKLRILTITFLVLGVLLLISGALFLTLGVPGLAAGLSFGLGIGLSALGGVLVVSGLLFFLIRRGVSKVRPEEIPVTPSHEAQKILCQLPQELDQLDTSIQEVVSCLGKLKDLKYEDQGLLTEVQEKLRVFDFVRKDMVTEFLELQQVVAQEGQFLDYLINQVQSISHKLFVPDVNIGAHLAELCGYLPSGDVRVERLKRSARQVVDRFHEGDL

SEQ ID NO: 67 - protein, 526 aa, Chlamydia pneumoniae
RECCGVAKNAFDKAFGALEECVYKSLTESYREAFYEYEKAKILRNEDVEWLQDKNKSARAEQRFREVKDRWEDLKETVFWVKENGCIDLEVLTAVGGWPDRGPEHLIPEKRRNKVMSHKLWEATMRMKGAEGTYSVARVAFEKDGSRKNQKKFQEKTKEWLRCLKDLHDQECHRARERLAELEALYPEVSVSVVETERETKFKLETAYGNLEERYQSVVRDQEDYWKEEENKEAEFREKGTKVRSPEEVVEYLQILENLLEDCSKQLTIAEVVVLGVELEATAEFEYTILSDAANRLKVLCEDIEDILPRVEEIEIMLRIAELPFLPIKQAFTKAFLQYNSCKDKLAKVEPYCQESVDYRRNKERFQSLNQDLQNVYQECQKATGLESEVSAYRDHLREQITEFETQGLDVIKEELLFVSSTLKSKLSYDPLIADIPCMKFYEEYYDGIDKARVQSRWLEKSERYRKAKKGFQEMLKEGLFKEDQALKKAEYRLLREKRMNKEKLLICNKIEAAQQRVQEFGPSDS

SEQ ID NO: 68 - protein, 705 aa, Chlamydia pneumoniae
  SITE 1...705: Xaa=unknown or other
MKELRHESYNRALHKLSHQWVRYFLYTFVSCSFIVAIFTFAWLKVLYVPEXKAGEISRISLTAPMDFXLSWSAHKFYKRTAHISEAFGKVYHLTLSPGSLLSKEGNADENTDYWFKKAADFLLSTNFVDSSTQKCLKDLCIYPPLLGKEKKTLEININSNKGNVIAQCFCHLKIFLIQENCPQPCFDAIMDILKIANFEVAVDKEMSGCVKGELLGKRCIEKITKGTPILEKYQRIDDRDAKILKQLRAQLLSVHTLFSCRSLWGAIFVVLLILLWGYGALKALCPEMLKSPQRFMLYIAILTLSLLWCRGTEIFCAYWVSYLSYPPILPFTAVLLGYFLGLPIAGFSCTFLALLYTLGSDLWNNSWFLSINLLCSWRILVSLHRVSRLSSVFWACMKLGGVAMGSLLMFRIFTNTISREALYADGIESFVYSLITAISVVALIPVFEASFGASTNFSLLTYLSPENALLKRLFKEAPGTYQHSVLVGSLAEAAAQAIGADSLYCLVAAHYHDIGKLINPGFFSENQKILQQSGHSLSPLECAKMIMRHIPEGVNLARQXGLPESDIQVIEEHHGTSVIRSAYYSHMVENPSTGSFDEELFRYSGNKPSSKETTIIMIADSFEAASRSLKNASLPDLQRLIDQIIQGKLQDGQFSCSPITLDELALISKSMVQTLYGALHSRMKYPEISYQISMDSCPKPSIGGT

SEQ ID NO: 69 - protein, 224 aa, Chlamydia pneumoniae
  SITE 1...224: Xaa=unknown or other
VISCQGKRPLRYCFLEIQILAKAQVHECISFXRSWYPKLWFQLSTTETTGDREKKIPLHLVENSYFFTDGVDALVHKGVCDLAIHSAKDLPETPSLPVVAITRCLHPADLLVYADHYVHEPLPLSPRLGSSSLRRSAVLKQLFPQGQILDIRGTIEERLDQLHRGHYDAIVLAKAASLRLHLHHAYSIELPPPYHALQGSLAITAKDHAGKWKQLFTPIHCHSS

SEQ ID NO: 70 - protein, 334 aa, Chlamydia pneumoniae
RICNADVFESEALNISSPLIYLFPETNLDNIKQQIATLEPDILIIDSIQIIFNPTLNSAPGSVAQVREVTYELMQIAKSAQITTFIIGHVTKSGEIAGPRVLEHLVDTVLYFEGNSHANYRMIRSVKNRFGPTNELLILSMHADGLKEVSNPSGLFLQEKTGPTTGSMIIPIIEGSGALLIELQALVSSSPFANPVRKTAGFDPNRFSLLLAVLEKRAQVKLFTMDVFLSITGGLKIIEPAADLGALLAVASSLYNRLLPNNSIVIGEVGLGGEIRHVAHLERRIKEGKLMGFEGAILPEGQISSLPKEIRENFRLQGVKTIKRCYPSVTLTPV

SEQ ID NO: 71 - protein, 97 aa, Chlamydia pneumoniae
ETYVPLLPPREEILPLMSGNPKNLLQQFTQKQFRVLPVYQSTAVTDAQGNVSYQIQVLVNQEVWGEGNASSKKEAEKIAAQQALDTYGNKNQNTMDV

SEQ ID NO: 72 - protein, 168 aa, Chlamydia pneumoniae
IPNSKFKDGALLSMHPPIDITAIEAKLNFTFTQPKLLEIALTHPSYKNESAVQIEDSERLEFLGDAVLGLIVTEHLFLLFPSMDEGTLSTARASLVNAKACCRYTTMLGIGDYLLIGKGEKIQSERGRLSAYANLFESILGAVYLDGGLSPARKLTFPSFLLEKKFFL

SEQ ID NO: 73 - protein, 165 aa, Chlamydia pneumoniae
CFWICYLIRIRMRSALHLQHLRHFHNHGSILFENLLTIKDCFLLETKLQNFIAKASKTIDTVRWRENIFRSMPEIYTVVRKRRLDFFAAELVHRPKLSLVRDLWVFPGEEILEGEEDCMLFLLLSGDRAGSGIFFTGPYPSDLYELEKGTTGLLLAFSSVGIPVI

SEQ ID NO: 74 - protein, 595 aa, Chlamydia pneumoniae
EFLKLSLHRISLMKEVEQRIRSLYDAVTAENICRWLSNDCTQQDAKTILGWLDTDPAQLEDLFGATLTFGTGGLRSLMGIGTNRINLFTIRRTTQGLVQVLRAHLPHPGDPMRVVVGCDTRHNSIEFAQETAKVLAGNGCEVFLFQYPEPLALVSFTVRYERAIGGVMITASHNPPNYNGYKVYMASGGQVLPPLDQEIVAACSAVNEILSVPSIDHPNIHLIGKEYEALYRDTLKQLQLYPEANRISGRSLSISYSPLHGTGISLVPHVLKDWGFLSVHLVEKQAIGDGDFPTVQLPNPEDPEALTLGTEQMLANDDDLFIATDPDADRVGVVCLEDGQPYRFNGNQMASLLADHILGAWSKTRHLGEHDKLVKSLVTTEMLSAIAKHYHVDLINVGTGFKYIGEKIESWRNSTNKFVFGAEESYGCLYGTHVEDKDAIIASALIAEAALQQKLQGKTLCDALLSLYETYGYFANKTESVVFSAKTDEQEIRKKLSHLEEISSANFFSGKYQVEKFENYKQGIGFNLLSKDSYALTLPKTSMLCYYFSGGGRVIIRPSGTEPKIKFYFEMSTHYPERVTDKEIQKHVKQRVFNI

SEQ ID NO: 75 - protein, 214 aa, Chlamydia pneumoniae
ILKRYVVMSFVPYSLPELPYDYDALEPVISSEIMILHHQKHHQIYINNLNAALKRLDAAETQQNLNELIALEPALRFNGGGHINHSLFWETLAPIDQGGGQPPNHELLSLIERFWGTMDNFLKKLIEVAAGVQGSGWAWLGFCPAKQELVLQATANQDPLEPLTGKLPLLGVDVWEHAYYLQYKNVRMDYLKAFPQIINWGHIENRFSEIISSK

SEQ ID NO: 76 - protein, 255 aa, Chlamydia pneumoniae
  SITE 1...255: Xaa=unknown or other
IRWLVRLFSYDKPKIKVQKIKADGFSGWLKCNHCHEMIHANELGQNYNCCPKCSYHYRITAIERVKLLADKDSWRPLYTDLKSQDPLEFIDTDTYANRLEKARKNTTESEGVIVGICTIGLHPVALAVMDFNFMAGSMGAVVGXKLTRLIEEAIETRLPVIIVSASGGARMQESVFSLMQMVKTSAALAKLHEAGLPYISVLTNPTSGGVTASFAALGDIIIAEPKALICFAGPRVVAQVIGEDLPEGFKNLNSY

SEQ ID NO: 77 - protein, 90 aa, Chlamydia pneumoniae
ICNAILMTVFCELDSGGELPEYTTPGAAGADLRANIEEPIALLPGQRALIPTGIKAEIPEVRATGPSSERFGFKARHYCFKFPRDYRFRL

SEQ ID NO: 78 - protein, 101 aa, Chlamydia pneumoniae
  SITE 1...101: Xaa=unknown or other
SLPESKQKFPKYELQVRPRSGLALKHGITVLNSPGTIDSDYRGEIRVILINFGDSTFIIEPKMRIAQVVLSPVVQATFVVKQXSLAETARGSGGFGHTGAS

SEQ ID NO: 79 - protein, 169 aa, Chlamydia pneumoniae
VEVLVILEQAKMPSYCQNQQDFSLFSLLSPRLVMFLGKHSRDEILQDLTDLVDAAGLLEDKQAFFDALVRRENIMSTGIGMGVAIPHGKLESCSNFFIAIGIHTQGILWDAIDGALVRLVFLIGGPENAQAEYLKLLSTLTLSLREESRRQQLLQVNTIEEVMNVFVGM

SEQ ID NO: 80 - protein, 225 aa, Chlamydia pneumoniae
MDLKLDEVASLLDVSEHTVLQWLKEGAIPSYSMNNEYRFSREEIEDWLLHNQALMIQERGEDKEALKDLSLKYSLYKAIHRGGVLCDVVVHSKEEALQYASKYIAQKFQLDESVLFEMLSHRENLMSTGIGEGIALPHAKDFLINAYYDIVVPMFLAEPIEYGALDGKPVGILFFLFACQDKSHLNLVNKIVHLGMSLNARSFFKNYPNKDQLLAYVKEWESQTH

SEQ ID NO: 81 - protein, 480 aa, Chlamydia pneumoniae
KKSFCCYGDPHRLPGDCSRMMSSKRTSKIAVLSILLTFTHSIGFANANSSVGLGTVYITSEVVKKPQKGSERKQAKKEPRARKGYLVPSSRTLSARAQKMKNSSRKESSGGCNEISANSTPRSVKLRRNKRAEQKAAKQGFSAFSNLTLKSLLPKLPSKQKTSIHEREKATSRFVNESQLSSARKRYCTPSSAAPSLFLETEIVRAPVERTKELQDNEIHIPVVQVQTNPKEQNTKTTKQLASQASIQQSEGTEQSLRELAQGASLPVLVRSNPEVSVQRQKEELLKELVAERRQCKRKSVRQALEARSLTKKVARGGSVTSTLRYDPEKAAEIKSRRNCKVSPEAREQKYSSCKRDARANGKQDKTTPSEDASQEEQQTGAGLVRKTPKSQVASNAQNFYRNSKNTNIDSYLTANQYSCSSEETDWPCSSCVSKRRTHNSISVCTMVVTVIAMIVGALIIANATESQTTSDPTPPTPTP

SEQ ID NO: 82 - protein, 590 aa, Chlamydia pneumoniae
YDYYKYNMFFKKNYMTDFPTHFKGPKLNPIKVNPNFFERNPKVARVLQITAVVLGIIALLSGIVLIIGTPLGAPISMILGGCLLASGGALFVGGTIATILQARNSYKKAVNQKKLSEPLMERPELKALDYSLDLKEVWDLHHSCCQHLKKIDLNLSETQREVLNQIKIDDEGPSLGECAAMISENYDACLKMLAYREELLKEQTQYQETRFNQNLTHRNKVLLSILSRITDNISKAGGVFSLKFSTLSSRMSRIHTTTTVILALSAVVSVMVVAALIPGGILALPILLAVAISAGVIVTGLSYLVRQILSNTKRNRQDFYKDFVKNVDIELLNQTVTLQRFLFEMLKGVLKEEEEVSLEGQDWYTQYITNAPIEKRLIEEIRVTYKEIDAQTKKMKTDLEFLENEVRSGRLSVASPSEDPSETPIFTQGKEFAKLRRQTSQNISTIYGPDNENIDPEFSLPWMPKKEEEIDHSLEPVTKLEPGSREELLLVEGVNPTLRELNMRIALLQQQLSSVRKWRHPRGEHYGNVIYSDTELDRIQMLEGAFYNHLREAQEEITQSLGDLVDIQNRILGIIVEGDSDSRTEEEPQE

SEQ ID NO: 83 - protein, 580 aa, Chlamydia pneumoniae
GVYMANPTQSRPPSPEISIEELELQELAGSSNTETISNTPPPSCAATAEEVSLFIEGGRRNSEDEEGPLGSCEVYDVVCITNQGDPEVRDHEVRVMYINGSGRTQHEGILDAMNICDLRGEPVRFIHNSGYGLGSCFLGIRNRIPPRDNVISQAIQARWNEFFIFAENANRDYIVLFSGNGGLYLQVALDNSIYSHHILCVGIGSSYYIQGNYRVHNYRVTGDWTTLLDRRGATAVNTTTLPYADSAEGLFLPSVRCPSYQWALRCGEQCLIMDNNQQVGFRPQDSSSEIALVVNLNQDHSTWTRLIEWIDRGDSQAVLELNPQPSHCRDIALTALYATTRISSLLQECLMISVTYAPEVFVTYAIVTGYSIMTLRYFILLLTNRPGCRRHFRVLRLAALGLQSLGFLTVLLDHINVTRRVNRRPPLISVIFCTASFATGSFIYVDLTRMFFTSLRSRLQLFVQRRLTGRGLPLRRVFVNHLDSLRFSQNALITFHGGLFMPLIIGFFNQLVIQVPRVVIRPNTTAVYDLNQTSQEAWDSGDVLAIGQTINFLLCMILLVINTFFFVRSVRRNLHRRPHR

SEQ ID NO: 84 - protein, 264 aa, Chlamydia pneumoniae
  SITE 1...264: Xaa=unknown or other
KGSGYSYRGPPMAVEGRVNSSQALNQDCQEVLANKQSKGLLRCRILSIVVAVITFIAGVVLIALTLASILTSVPYLALGVFLLIVTLGCIIFALCSEKIKKVPPTPISHKEEIIAWFEERKNIDMEKEKEDPEHFGRTATDIPMRSALDQFNHSCHHIHESPALTETYRSHQDVLLFKDWCPVTLPDVTSEEEVLIRSVVGSYLLMEACVPKVSMLIDELHNKLXSPSERECLFIDKKTLQRKASFLFTQKDLATFFLDLYAGE

SEQ ID NO: 85 - protein, 193 aa, Chlamydia pneumoniae
SFMIKKFFIYSLIFSCSFSAPLKGICNEDVSSQSRIEEDPEVLITQLNELIETPIEEGKEIRNELQAISDGQKSSEEIEESCGTSDSEGLSEKTDKESSNEYVLDFFDSMVQRLEGISKMCQSGQVAQIIDCFNREFDIRNRELELKNRELELREKDLEFKKSILDWNKEKVSRELAFQREQDIKQTLMLLKK

SEQ ID NO: 86 - protein, 297 aa, Chlamydia pneumoniae
NFKIWGIRITIAVELPPPEVGGELPPYFSASNFVVIERGAPSLPSPQQLLSLPEYSRQPPPGYFDETASITSRTSEEMFGTLVSTLCCPANSERDWEDHEVNCIYIASTSDTQLEAVQGGMHITELRGEPVRVLYETGHLYAFARENTCHSRLEVSHTVRAMTYFWDRFFSRHWNVGRRFLVFYQGNGGAYVQAALDSSMHTQDIYVLGLSPTVYIRGNYHVQHYRVRGFWPSCLDSLAACAENTSVLPTGNRVTESFTPLYSATHLITRYGMVRDACWFVLRAWECFQKRNNKHLL

SEQ ID NO: 87 - protein, 380 aa, Chlamydia pneumoniae
RELSRTALPCSRILALLPGFSSGLCGKYISTSYGESSDGIFYPSLFSHTFDNAIRYGERCLLVCSEGMGMLPETQQQTSPLTSLEGGHEVALVLNPQQNPEALSIASRLMHEERGGRLESNYMPGRSSNPFMTSMYVLVRLNTLAQIYLMSPYYSFQSNDIVCLIFISSAAVETVSYIFLTVTDSTCGRRYLRVPRLVCTGLRNLALPTTLLELLILSYPRSVEGVPFNVRFILGYMCTTRVVFFAWNLILHWPFRCLRHGIQLFVHRSIIGHTLGARITDLTLASMRYAIVFPSIVSSCLLTALAHANTNILALDPYRLIESGDLRRPAFNDDEMQQADNPWDAYSIGLVINTCIYMLILFANLIFMVYSVRRYHRSRR

SEQ ID NO: 88 - protein, 156 aa, Chlamydia pneumoniae
  SITE 1...156: Xaa=unknown or other
IKSLRSILEFICPLQHARCLKKQHKIIEELFPEPFQKDHLYLKLMENSSSRDAFDKKRMLKENLVVGCQSDLYLYEVYQDGILFFFTYTKALVSSGIASLFTEVYSGETPSTILTCKPIFFQRLTPYLSFGRLNGGESLYMRMKQIAVQYLKPPQT

SEQ ID NO: 89 - protein, 345 aa, Chlamydia pneumoniae
CLLFYFFHYRMSTPLSSGGISPSDQYVPQELFCDRLSSSRSNSPDSNASGDSPIVSPPISALVALTDLKLVPYNQNSFSWTTRLKNAVEKIGLFLQRNWKYILLYILAWALILVCHHTVALTLTIWLGVGLGIGVVFGIFTATCLDKENKHRHVNSLWNLINHGILQLDPNGTRQILLATMIASISALIYAVPQAVGLVIGFSIGNQLSINTVYGARLGDEATYAIDRKAHKKRIENIEQAINQHQIIKHQMINQKQLNALIEINRNNQTDPATANLLASLKLNLNQPMPYCFSMPECGVTSSYLDLNNNSPDDIIARADQCIMTLSQTLQQIKKEPDRIIESNH

SEQ ID NO: 90 - protein, 394 aa, Chlamydia pneumoniae
  SITE 1...394: Xaa=unknown or other
MSKETFQRNKPHINIGTIGHVDHGKTTLTAAITRALSGDGLASFRDYSSIDNTPEEKARGITINASHVEYETPNRHYAHVDCPGHADYVKNMITGAAQMDGAILVVSATDGAMPQTKEHILLARQVGVPYIVVFLNKVDMISQEDAELIDLVEMELSELLEEKGYKGCPIIRGSALKALEGDANYIEKVRELMQAVDDXIPTPEREIDKPFLMPIEDVFSISGRGTVVTGRIERGIVKVSDKVQLVGLGETKETIVTGVEMFRKELPEGRAGENVGLLLRGIGKNDVERGMVVCQPNSVKPHTKFKSAVYVLQKEEGGRHKPFFSGYRPQFFFRTTDVTGVVTLPEGTEMVMPGDNVELDVELIGTVALEEGMRFAIREGGRTIGAGTISKINA

SEQ ID NO: 91 - protein, 88 aa, Chlamydia pneumoniae
SRSWFMKQQHNRKALSRKIGTVKKQAKFAGSFLDEIKKIEWVSKHDLKKYIKVVLISIFGFGFAIYFVDLVLRKSITCLDGITTFLFG

SEQ ID NO: 92 - protein, 190 aa, Chlamydia pneumoniae
QPFCSVNCMYKWYVVQVFTAQEKKVKKALEDFKESSGMTDFIQEIILPIENVMEVKKGEHKVVEKYIWPGYLLVKMHLTDESWLYVKSTAGIVEFLGGGVPVALSEDEVRSILTDIEEKKSGVVQKHQFEVGSRVKINDGVFVNFIGTVSEVFHDKGRLSVMVSIFGRETRVDDLEFWQVEEVAPGQESE

SEQ ID NO: 93 - protein, 150 aa, Chlamydia pneumoniae
VSQCKVRFSMSVKKVIKIIKLQIPGGKANPAPPIGPALGAAGVNIMGFCKEFNAATQDKPGDLLPVVITVYADKTFTFITKQPPVSSLIKKTLNLESGSKIPNRNKVGKLTQAQVEAIAEQKMKDMDIVLLESAKRMVEGTARSMGIDVE

SEQ ID NO: 94 - protein, 232 aa, Chlamydia pneumoniae
MTKHGKRIRGILKNYDFSKSYSLREAIDILKQCPPVRFDQTVDVSIKLGIDPKKSDQQIRGAVFLPNGTGKTLRILVFASGNKVKEAVEAGADFMGSDDLVEKIKSGWLEFDVAVATPDMMREVGKLGKVLGPRNLMPTPKTGTVTTDVAKAISELRKGKIEFKADRAGVCNVGVGKLSFESSQIKENIEALSSALIKAKPPAAKGQYLVSFTISSTMGPGISIDTRELMAS

SEQ ID NO: 95 - protein, 170 aa, Chlamydia pneumoniae
MKQEKTLLLQEVEDKISAAQGFILLRYLRFTAAYSREFRNSLSGVSAEFEVLKKRIFFKAIEAAGLEVDCSDTDGHLGVVFSCGDPVSAAKQVLDFNKQHKDSLVFLAGRMDNASLSGAEVEAVAKLPSLKELRQQVVGLFAAPMSQVVGIMNSVLSGVISCVDQKAGKN

SEQ ID NO: 96 - protein, 132 aa, Chlamydia pneumoniae
VTKVTTESLETLVEKLSNLTVLELSQLKKLLEEKWDVTASAPVVAVAAGGGGEAPVAAEPTEFAVTLEDVPADKKIGVLKVVREVTGLALKEAKEMTEGLPKTVKEKTSKSDAEDTVKKLQDAGAKASFKGL

SEQ ID NO: 97 - protein, 1262 aa, Chlamydia pneumoniae
LSHQNSRRTRTLKCPERVSVKKKEDIPDLPNLIEIQIKSYKQFLQIGKLAEERENIGLEEVFREIFPIKSYNEATVLEYLSYNLGVPKYSPEECIRRGITYSVTLKVRFRLTDETGIKEEEVYMGTIPLMTDKGTFIINGAERVVVSQVHRSPGINFEQEKHSKGNILFSFRIIPYRGSWLEAIFDINDLIYIHIDRKKRRRKILAITFIRALGYSSDADIIEEFFTIGESSLRSEKDFALLVGRILADNIIDEASSLVYGKAGEKLSTAMLKRMLDAGIASVKIAVDADENHPIIKMLAKDPTDSYEAALKDFYRRLRPGEPATLANARSTIMRLFFDPKRYNLGRVGRYKLNRKLGFSIDDEALSQVTLRKEDVIGALKYLIRLKMGDEKACVDDIDHLANRRVRSVGELIQNQCRSGLARMEKIVRERMNLFDFSSDTLTPGKVVSAKGLASVLKDFFGRSQLSQFMDQTNPVAELTHKRRLSALGPGGLNRERAGFEVRDVHASHYGRICPIETPEGPNIGLITSLSSFAKINEFGFIETPYRIVRDGIVTDEIEYMTADVEEECVIAQASASLDEYNMFTEPVCWVRYAGEAFEADTSTVTHMDVSPKQLVSIVTGLIPFLEHDDANRALMGSNMQRQAVPLLKTEAPVVGTGLECRAAKDSGAIVVAEEDGVVDFVDGYKVVVAAKHNPTIKRTYHLKKFLRSNSGTCINQQPLCAVGDVITKGDVIADGPATDRGELALGKNVLVAFMPWYGYNFEDAIIISEKLIREDAYTSIYIEEFELTARDTKLGKEEITRDIPNVSDEVLANLGEDGIIRIGAEVKPGDILVGKITPKSETELAPEERLLRAIFGEKAADVKDASLTVPPGTEGVVMDVKVFSRKDRLSKSDDELVEEAVHLKDLQKGYKNQVATLKTEYREKLGALLLNEKAPAAIIHRRTAEIVVHEGLLFDQETIERIEQEDLVDLLMPNCEMYEVLKGLLSDYETALQRLEINYKTEVEHIREGDADLDHGVIRQVKVYVASKRKLQVGDKMAGRHGNKGVVSKIVPEADMPYLSNGETVQMILNPLGVPSRMNLGQVLETHLGYAAKTAGIYVKTPVFEGFPEQRIWDMMIEQGLPEDGKSFLYDGKTGERFDNKVVIGYIYMLKLSHLIADKIHARSIGPYSLVTQQPLGGKAQMGGQRFGEMEVWALEAYGVAHMLQEILTVKSDDVSGRTRIYESIVKGENLLRSGTPESFNVLIKEMQGLGLDVRPMVVDA

SEQ ID NO: 98 - protein, 1218 aa, Chlamydia pneumoniae
  SITE 1...1218: Xaa=unknown or other
LEKIMFGENSRDIGVLSKEGLFDKLEIGIASDITIRDKWSCGEIKKPETINYRTFKPEKGGLFCEKILGPTKDWECCCGKYKKIKHKGIVCDRCGVEVTLSKVRRERMAHIELAVPIVHIWFFKTTPSRIGNVLGMTASDLERVIYYEEYVVIDPGKTDLTKKQLLNDAQYREVVEKWGKDAFVAKMGGEAIYDLLKSEDLQSLLKDLKERLRKTKSQQARMKLAKRLKIIEGFVSSSNHPEWMVLKNIPVVPPDLRPLVPLDGGRFATSDLNDLYRRVINRNNRLKAILRLKTPEVIVRNEKRMLQEAVDALFDNGRHGHPVMGAGNRPLKSLSEMLKGKNGRFRQNLLGKRVDYSGRSVIIVGPELKFNQCGLPKEMALELFEPFIIXRLKDQGSVYTIRSAKKMIQRGAPEVWDVLEEIIKGHPVLLNRAPTLHRLGIQAFEPVLIEGKAIRIHPLVCAAFNADFDGDQMAVHVPLSVEAQLEAKVLMMAPDNIFLPSSGKPVAIPSKDMTLGLYYLMADPTYFPEEHGGKTKIFKDEIEVLRALNNGGFIDDVFGDRRDETGRGIHIHEKIKVRIDGQIIETTPGRVLFNRIVPKELGFQNYSMPSKRISELILQCYKKVGLEATVRFLDDLKDLGFIQATKAAISMGLKDVRIPDIKSHILKDAYDKVAIVKKQYDDGIITEGERHSKTISIWTEVSEQLSDALYVEISKQTRSKHNPLFLMIDSGARGNKSQLKQLGALRGLMAKPNGAIIESPITSNFREGLTVLEYSISSHGARKGLADTALKTADSGYLTRRLVDVAQDVIITEKDCGTLNHIEISAIGQGSEELLPLKDRIYGRTVAEDVYQPGDKSRLLAQSGDVLNSVQAEAIDDAGIETIKIRSTLTCESPRGVCAKCYGLNLANGRLIGMGEAVGIIAAQSIGEPGTQLTMRTFHLGGIAATSSTPEIITNSDGILVYMDLRVVLGQEGHNLVLNKKGALHVVGDEGRTLNEYKKLLSTKSIESLEVFPVELGVKILVADGTPVSQGQRIAEVELHNIPIICDKPGFIKYEDLVEGISTEKVVNKNTGLVELIVKQHRGELHPQIAIYDDADLSELVGTYAIPSGAIISVEEGQRVDPGMLLARLPRGAIKTKDITGGLPRVAELVEARKPEDAADIAKIDGVVDFKGIQKNKRILVVCDEMTGMEEEHLIPLTKHLIVQRGDSVIKGSSLPMV

SEQ ID NO: 99 - protein, 186 aa, Chlamydia pneumoniae
  SITE 1...186: Xaa=unknown or other
GQQLTDGLVVPHEILEICGVRELQKYLVNEVQEVYRLQGVDINDKHIEIIVRQMLQKVRITDPGDTTLLFGEDVNKKEFYEENRRTEEDGGKPAQAVPVLLGITKASLGTESFISAASFQDTTRVLTDAACCSKTDYLLGFKENVIMGHMIPGGTGFETHKRIKQYLEKEQEDLVFDFVSETECVX

SEQ ID NO: 100 - protein, 337 aa, Chlamydia pneumoniae
  SITE 1...337: Xaa=unknown or other
LEINSDAKVPMSNQFDQLKKLSTIVCDSGDPELVKASGSQDATTNPSLILKVAQEPKFQELLNEAVVWGIRQNGDDLQTLSFILDKIQVNFALEIIKNIPGRISLEIDARLSFNVEAMVQRAVFLSQLFEAMGGDKKRLLVKIPGTWEGIRAVEFLEAKGIACNVTLIFNLVQAIAAAKAKATLISPFVGRIYDWWIAAYGDEGYSIDADPGVASVSNIYAYYKKFGIPTQIMAASFRTKEQVLALAGCDLLTISPKLLDELKKSQHPVKKELDPAEAKKLDVQPIELTESFFRFLMNEDAMATXKLAEGIRIFAGDTQILETAITEFIKQIAAEGA

SEQ ID NO: 101 - protein, 132 aa, Chlamydia pneumoniae
SEMKNKMDYKSQLVFSCPCCCKGNVCFSVFNLDVILTCNVCSSTYTFDSVIRNEIRQFVALCKRIHDANSILGNATVSVSVEDNQMDIPFQLLFSRFPVVLNLSLDGKKIAIRFLFDALNTSILHQESDLIS

SEQ ID NO: 102 - protein, 192 aa, Chlamydia pneumoniae
NKSTARKKIGKFEKKPSLSPVQWVRYSGKNYSIQTPSLWQCIDDKTQLPEKLDVLLIGKGKGNLTPTINIAQEITSKSSKEYIEEILAYHKANEMTLESGIFTQIQSPSGEFTIIKTEKNSSWGRVFCLQATTVIDHTAYIFTSTATLDDYAELSFTFLKVVSSFQIRGGKEATSGDAILEKALEALQNENK

SEQ ID NO: 103 - protein, 163 aa, Chlamydia pneumoniae
NIMANLNADGKLKQICDALRLDTLKPAEDEAAALLHNAKEQAKRIIQEAQEEARKILETAEERAHQKIKQGEVALSQAGKRALEALKQAVENKIFRESLVEWLEHVTTDPEVSTKLIQALVQALEAQGVSGNLTAYIGKHVSPRAVNELLRKGCNNKNYERKV

SEQ ID NO: 104 - protein, 211 aa, Chlamydia pneumoniae
  SITE 1...211: Xaa=unknown or other
SHEKIFSIFKVVVMTQYYFLSSFLPTQLPESVPLFSISDLDDLLYLNLSENDLCNYGLLKRFFDFENFAFFWAGKPIPFSFGEVTQENVERMLSSQQWSDDNDFEDFFKDFLMNHKSSQDRLNHFSDLFREFLSYHQTNSSKFLQDYFRFQQQLRVVLAGFRARVLNMDVSYVLRDEDSSDPVVLEVLMQKDSPNYEXPEEFXDLQGVLDD

SEQ ID NO: 105 - protein, 440 aa, Chlamydia pneumoniae
KRQSNGNSFRTKLAQGHVIEAYGNLLRVRFDGYVRQGEVAYVNVDNTWLKAEVIEVADQEVKVQVFEDTQGACRGALVTFSGHLLEAELGPGLLQGIFDGLQNRLEVLAEDSSFLQRGKHVNAISDHNLWNYTPVASVGDTLRRGDLLGTVPEGRFTHKIMVPFSCFQEVTLTWVISEGTYNAHTVVAKARDAQGKECAFTMVQRWPIKQAFIEGEKIPAHKIMDVGLRILDTQIPVLKGGTFCTPGPFGAGKTVLQHHLSKYAAVDIVILCACGERAGEVVEVLQEFPHLIDPHTGKSLMHRTCIICNTSSMPVAARESSIYLGVTIAEYYRQMGLDILLLADSTSRWAQALREISGRLEEIPGEEAFPAYLSSRIAAFYERGGAITTKDGSEGSLTICGAVSPAGGNFEEPVTQSTLAVVGAFCGLSKARLTHVGILQ

SEQ ID NO: 106 - protein, 185 aa, Chlamydia pneumoniae
RTSHSIYISCSRSVLWSFKSTTDARRYPSIDPLISWSKYLNQVGQILEEKVSGWGGAVKKAAQFLEKGSEIGKRMEVVGEEGVSMEDMEIYLKAELYDFCYLQQNAFDPVDCYCPFERQIELFSLISRIFDAKFVFDSPDDARSFFLELQSKIKTLNGLKFLSEEYHESKEVIVRLLEKTMVQMA

SEQ ID NO: 107 - protein, 438 aa, Chlamydia pneumoniae
MQTIYTKITDIKGNLITVEAEGARLGELATITRSDGRSSYASVLRFDLKKVTLQVFGGTSGLSTGDHVTFLGRPMEVTFGSSLLGRRLNGIGKPIDNEGECFGEPIEIATPTFNPVCRIVPRSMVRTNIPMIDVFNCLVKSQKIPIFSSSGEHHNALLMRIAAQTDADIVVIGGMGLTFVDYSFFVEESKKLGFADKCVMFIHKAVDAPVECVLVPDMALACAEKFAVEEKKNVLVLLTDMTAFADALKEISITMDQIPANRGYPGSLYSDLALRYEKAVEIADGGSITLITVTTMPSDDITHPVPDNTGYITEGQFYLRNNRIDPFGSLSRLKQLVIGKVTREDHGDLANALIRLYADSRKATERMAMGFKLSNWDKKLLAFSELFETRLMSLEVNIPLEEALDIGWKILAQSFTSEEVGIKAQLINKYWPKACLSK

SEQ ID NO: 108 - protein, 214 aa, Chlamydia pneumoniae
VLAKSMSVQVKLTKNSFRLEKQKLARLQTYLPTLKLKKALLQAEVQNAVKDAAECDKDYVQAYERIYAFAELFSIPLCTDCVEKSFEIQSIDNDFENIAGVEVPIVREVTLFPASYSLLGTPIWLDTMLSASKELVVKKVMAEVSKERLKILEEELRAVSIRVNLFEKKLIPETTKILKKIAVFLSDRSITDVGQVKMAKKKIELRKARGDECV

SEQ ID NO: 109 - protein, 660 aa, Chlamydia pneumoniae
VRLNIHKYLFIGRNKADFFSASRELGVVEFISKKCFITTEQGHRFVECLKVFDHLEAEYSLEALEFVKDESVSVEDIVSEVLTLNKEIKGLLETVKALRKEIVRVKPLGAFSSSEIAELSRKTGISLRFFYRTHKDNEDLEEDSPNVFYLSTAYNFDYYLVLGVVDLPRDRYTEIEAPRSVNELQVDLANLQREIRNRSDRLCDLYAYRREVLRGLCNYDNEQRLHQAKECCEDLFDGKVFAVAGWVIVDRIKELQSLCNRYQIYMERVPVDPDETIPTYLENKGVGVMGEDLVQIYDTPAYSDKDPSTWVFFAFVLFFSMIVNDAGYGLLFLMSSLLFSWKFRRKMKFSKHLSRMLKMTAILGLGCICWGTTTTSFFGMSFSKTSVFREYSMTHVLALKKAEYYLQMRPKAYKELTNEYPSLKAIRDPKAFLLATEIGSAGIESRYVVYDKFIDNILMELALFIGVVHLSLGMLRYLRYRYSGIGWILFMVSAYLYVPIYLGTVSLIHYLFHVPYELGGQIGYYGMFGGIGLAVVLAMIQRSWRGVEEIISVIQVFSDVLSYLRIYALGLAGAMMGATFNQMGARLPMLLGSIVILLGHSVNIILSIMGGVIHGLRLNFIEWYHYSFDGGGRPLRPLRKIVCSEDAEASGIHLDNNSIV

SEQ ID NO: 110 - protein, 149 aa, Chlamydia pneumoniae
LKGAHEVSMIDMSVVGPALVLGLAMIGSAIGCGMAGVASHAVMSRIDEGHGKLIGMSAMPSSQSIYGFILMLLMQAAIKNGTLSPVGGIAIGLSVGAALLVSSVMQGKCCVSGIQAYARSSSIYGKCYAAIGIVESFSLFAVVFALLLL

SEQ ID NO: 111 - protein, 940 aa, Chlamydia pneumoniae
MTTEDFPKAYNFQDTEPELYVFWEKNGMFKAEASSDKPPYSVIMPPPNVTGVLHMGHALVNTLQDVLVRYKRMSGFEVCWIPGTDHAGIATQAVVERHLQASEGKRRTDYSREDFLKHIWAWKEKSEKVVLSQLRQLGCSCDWDRKRFTMEPLANRAVKKAFKTLFENGYIYRGYYLVNWDPVLQTALADDEVEYEEKDGWLYYIRYRMVGSQESIVVATTRPETSLGDTGIAVSPNDERYASWIGASVEVPFVNRQIPIIGDASVDPTFGTGAVKVTPAHDKDDYLMGTNHHLPMINILTPSGGINENGGPFAGMAKEKAREEILIALEEQGLFVRKEPYKLRVGVSYRSGAVIEPYLSKQWFVSVSEFRGALREFVESQDIKIFPKDFVKNYLSWVNHLRDWCISRQLWWGHRIPVWYHKNHDERVLCYDGEGIPEEVAQDPDSWYQDPDVLDTWFSSGLWPLTCLGWPDENSPDLKKFYPTALLVTGHDILFFWVTRMVLLCSSMSGEKPFSEVFLHGLIFGKSYKRYNDFGEWSYISGKEKLAYDMGEALPDGVVAKWEKLSKSKGNVIDPLEMIATYGTDAVRLTLCSCANRGEQIDLDYRLFEEYKHFANKVWNGARFIFGHISDLQGKDLLAGIDEDSLGLEDFYILDGFNQLIHQLEEAYATYAFDKVATLAYEFFRNDLCSTYIEIIKPTLFGKQGNEASQSTKRTLLAVLLINVLGVLHPVAPFITESLFLRIQDTLGALPEGDGDAFTGHALRMLRSRACMEAPYPKAFDVKIPQDLRESFTLAQRLVYTIRNIRGEMQLDPRLHLKAFVVCSDTTEIQSCIPILQALGGLESIQLLDKEPEKGLYSFGVVDTIRLGIFVPEEHLLKEKGRLEKERVRLERAVENLERLLGDESFCQKANPNLVVAKQEALKNNRIELQGILDKLASFA

SEQ ID NO: 112 - protein, 945 aa, Chlamydia pneumoniae
ACIVCLDREDQRSLERYDIVRIIGKGGMGEVYLAYDPVCSRKVALKKIREDLAENPLLKRRFLREARIAADLIHPGVVPVYTIYSEKDPVYYTMPYIEGYTLKTLLKSVWQKESLSKELAEKTSVGAFLSIFHKICCTIEYVHSRGILHRDLKPDNILLGLFSEAVILDWGAAVACGEEEDLLDIDVSKEEVLSSRMTIPGRIVGTPDYMAPERLLGHPASKSTDIYALGVVLYQMLTLSFPYRRKKGKKIVLDGQRIPSPQEVAPYREIPPFLSAVVMRMLAVDPQERYSSVTELKEDIESHLKGSPKWTLTTALPPKKSSSWKLNEPILLSKYFPMLEVSPASWYSLAISNIESFSEMRLEYTLSKKGLNEGFGILLPTSENALGGDFYQGYGFWLHIKERTLSVSLVKNSLEIQRCSQDLESDKETFLIALEQHNHSLSLFVDGTTWLIHMNYLPSRSGRVAIIVRDMEDILEDIGIFESSGSLRVSCLAVPDAFLAEKLYDRALVLYRRIAESFPGRKEGYEARFRAGITVLEKASTDNNEQEFALAIEEFSKLHDGVAAPLEYLGKALVYQRLQEYNEEIKSLLLALKRYSQHPEIFRLKDHVVYRLHESFYKRDRLALVFMILVLEIAPQAITPGQEEKILVWLKDKSRATLFCLLDPTVLELRSSKMELFLSYWSGFIPHLNSLFHRAWDQSDVRALIEIFYVACDLHKWQFLSSCIDIFKESLEDQKATEEIVEFSFEDLGAFLFAIQSIFNKEDAEKIFVSNDQLSPILLVYIFDLFANRALLESQGEAIFQALDLIRSKVPENFYHDYLRNHEIRAHLWCRNEKALSTIFENYTEKQLKDEQHELFVLYGCYLALIQGAEAAKQHFDVCREDRIFPASLLARNYNRLGLPKDALSYQERRLLLRQKFLYFHCLGNHDERDLCQTMYHLLTEEFQL

SEQ ID NO: 113 - protein, 1826 aa, Chlamydia pneumoniae
  SITE 1...1826: Xaa=unknown or other
MKSLPVYVSGIKVRNLKNVSIHFNSEEIVLLTGVSGSGKSSIAFDTLYAAGRKRYISTLPTFFATTITTLPNPKVEEIHGLSPTIAIKQNHFSHYSHATVGSTTELFSHLALLFTLEGQARDPKTKEVLDLYSKEKVLSTIMELSEGVQISILAPLLRKDIAAIHEYAQQGFTKVRCNGTIHPIYSFLTSGIPEDCSVDIVIDTLIKSENNIARLKVSLFTALEFGEGHCSVLSDEELMTFSTKQQIDDVTYTPLTQQLFSPHALESRCSLCQGSGIFISIDNPLLIDENLSIKENCCSFAGNCSSYLYHTIYQALADALNFNLETPWKDLSPEIQNIFLRGKNNLVLPVRLFDQTLGKKNLTYKVWRGVLNDIGDKVRYTTKPSRYLSKGMSAHSCSLCKGTGLGDYASVATWEGKTFTEFQQMSLNNWHVFFSKVKSPSLSIQEILQGLKQRLSFLIDLGLGYLTPNRALATLSGGEQERTAIAKHLGGELFGITYILDEPSIGLHPQDTEKLIGVIKKLRDQGNTVILVEHEERMISLADRIIDIGPGAGIFGGEVLFNGKPEDFLMNSSSLTAKYLRQELTIPIPESREAPTSWLLLTEATIHNLKNLSIRLPLARLIGVTGVSGSGKSSLINNTLVPAIESFLKQENPKNLHFEWGCIGRLIHITRDLPGRSQRSIPLTYIKAFDDIRELFASQPRSLRQGLTKAHFSFNQPQGACIQCQGLGTMTISDDDTPIPCSECQGKRYHSEVLEILYEGKNIADILDMTAYEAEKFFISHPKIHEKIHALCSLRLDYLPLGRPLSTLSGGEIQRLKLAHELLFASPKQTLYVLDEPTTGLHTHDIQALIEVLLSLTYLGHTVLVIEHNMHVVKVCDYVLELGPEGGDLGGYLLASCTPKDLIQLNTPTAKALAPYIEGSLDIPVVKSEPPSSPKSCDILIKDAYQNNLKHIDLALPRNSLIAIAGPGASGKHSLVFDILYASGNIAYAELFPPYIRQGLLKETPLPSVGEVKGLSPVISVRKCSSSNRSYHTIASALGLSNGLEKLFAILGEPFSPLTEEKLSKTTPQTIIDSLLKSYKDDYVTITSPIPLGSDLEIFLQEKQKEGFIKLYSEGNLYDLDERLPLNLIEPAIVIQHTKVSPKNSSSLLSAISVAFSLSSEIWIYISQKKQRKLSYSLGWKDKKGRLYPEITHQLLXSDHPEGRCLTCGGRGEILKISLEEHKEKIAHYTPLEFFSLFFPKSYMKPVQKLLKDENASQPLKLLTTKEFLNFCRGSSEFPGMNALLMEQLDTESDSPLIKPLLALTSCPACKGSGLNDYANYVRINNTSLLDIYQEDATFLESFLNTIGTDDTRSIIQDLMNRLTFISKVGLSYITLGQRQDTLSDGENYRLHLAKKISINLTNIVYLFEEPLSGLHPQDLPTIVQLLKELVANNNTVIATDRSCSLIPHADHAIFLGPGSGPQGGFLMDSDTEVCPSVDLHANVPQTEVCPKAPLSISKANHTRGSDRTLKVNLSIHHIQNLKVSAPLHALVAIGGVSGSGKTSLLLEGFKKQAELLIAKGTTTFSDLVVIDSHPIASSQRSDISTYFDIAPSLRAFYASLTQAKALNISSTMFSTNTKQGQCSDCQGLGYQWIDRAFYALEKRPCPTCSGFRIQPLAQEVLYEGKHFGELLHTPIETVALRFPFIKKIQKPLKALLDIGLGYLPIGQKLSSLSVSEKTALKTAYFLYQTPETPTLFLIDELFSSLDPIKKQHLPEKLRSLINSGHSVIYIDHDVKLLKSADYLIEIGPGSGKQGGKLLFSGSPKDIYASKDSLLKKYICNEELDS

SEQ ID NO: 114 - protein, 486 aa, Chlamydia pneumoniae
DSMITRTKIICTIGPATNSPEMLAKLLDAGMNVARLNFSHGSHETHGQAIGFLKELREQKRVPLAIMLDTKGPEIRLGNIPQPISVSQGQKLRLVSSDIDGSAEGGVSLYPKGIFPFVPEGADVLIDDGYIHAVVVSSEADSLELEFMNSGLLKSHKSLSIRGVDVALPFMTEKDIADLKFGVEQNMDVVAASFVRYGEDIETMRKCLADLGNPKMPIIAKIENRLGVENFSKIAKLADGIMIARGDLGIELSVVEVPNLQKMMAKVSRETGHFCVTATQMLESMIRNVLPTRAEVSDIANAIYDGSSAVMLSGETASGAHPVAAVKIMRSVILETEKNLSHDSFLKLDESNSALQVSPYLSAIGLAGIQIAERADAKALIVYTESGSSPMFLSKYRPKFPIIAVTPSTSVYYRLALEWGVYPMLTQESDRAVWRHQACIYGIEQGILSNYDRILVLSRGACMEETNNLTLTIVNDILTGSEFPET

SEQ ID NO: 115 - protein, 463 aa, Chlamydia pneumoniae
LVGKKFHQIKRTILEAPLYYLVSGIIALCRHTPRSFLTGLGKGFGFLAFYIISDYRKTALTNLALAFPEKTFDERYKIARQSLQHLIITLLELLAIEQLVGNIDKLITIVTSSRNPKGFSSEEVISNEDLEETFKNLQEKQGLILFCGHQANWELPFLYITKNYPGIAFAKAIKNQRLSKKIFALREVFKGKIVPPKNGIQQGIEALNQGKLVGIVGDQALLMSSYTYPLFGSPAFTTTSPALLAYKTGFPVIAVNVSRQAKGFEVIPSAKLYANKSLPMKESVAILMDQMMGFLEKGIASQPEQWMWIHKRWKRKISNVIKKKYRYSHILVFVDQVSSHFSFLKALAECFSGTTLHLTLGNADHLEELQEQFPEYSLIQLRNDQDILALPNCYPAIFDLTNNLQHLYKHFRKTGSCAVYSKRFLEKSLDHPQAPLKNSLRIFYSKNLKDKERKNFKVKSKGP

SEQ ID NO: 116 - protein, 114 aa, Chlamydia pneumoniae
IILLCFLLSQDFSFCSEDAPERNMLNSIVTKRTRTAATLLIPKVIPEAPSTPVQIKMISIKETIAVRAKSPADTVATFALDSELSEQQQTVLIAASKPWPKQSIKHIKFPLTKF

SEQ ID NO: 117 - protein, 104 aa, Chlamydia pneumoniae
NLVRGNFMCLIDCLGQGFEAAINTVCCCSDSSESKANVATVSAGLLALTAIVSFILIILICTGVLGASGMTFGMSNVAAVLVLLVTILLSMFLSGASSLQNEKS

SEQ ID NO: 118 - protein, 434 aa, Chlamydia pneumoniae
RTQKKTFILLDLETMIKFLSQLFIRHWPRKVVSLGFAIIIWILVGQSVTITRTLTNVPVRIVDLHPDQTVLGLQKSGFLNKKVSLTITGNKNTVQDLRPSNLEVVISAANHTESWIATIDKHNLVSVDHEINIRKDIHSVDANDIFVRLTQYVTEDILLTITKPIGSPPKGYEYLDVWPKYLNQKVSGPKEYINALKEQGLELTFNLNKISFEELERNRIAQGSHDEIIFPIPKEWKKILIPFENTFMDLNDPQADFLRLLFLKRECIPLNLNLPVFLFFPVTFIQTMNPLEYSLDPVPPIILNHGIHQINIPLYVKDVSRQFLDVVKNNMVLTIVMPSPQDPSSINWAIEFLDEKTLENTFLQTIIAQEHGILHDIALIDEAGIRHRFREYLRKLALFTADGEPLNLIAEIKNNKVVIQTKTKETTKLYKKEW

SEQ ID NO: 119 - protein, 279 aa, Chlamydia pneumoniae
LCNFSQYTTQGPSKTMPFDITYYTTPLLEIILIWVMLNYLLKFFWGTRAMDVVFGLLAFLFLFVLADKLHLPIIRRLMLHVVNIAAIVVFIIFQPEIRLALSRIRFHGKKFFIDTQEQFVEQLAASIYQLSERQIGALVVLENKDSFDEYLSFSSVKINATFSEELLETIFEPSSPLHDGAVILRGDILAYARVVLPLAHDTTQLSRSMGTRHRAALGASQRSDALIITVSEENGSVSLSRDGLLTRGVKIDRFKAVLRSILSPKEHKRKPLFSWIWKR

SEQ ID NO: 120 - protein, 448 aa, Chlamydia pneumoniae
MDALILSRIQFGLFITFHYLFVPLSMGLSMMLVIMEGLYLVTKKQIYKQMTWFWVGIFALTFVLGVVTGIMQIFSFGSNWANFSEYTGNIFGTLLGSEGVFAFFLESGFLGILLFGRHKVSKKMHFFSTCMVALGAHMSAFWIICANSWMQTPSGYEMVMHKGKLIPALTSFWGVVFSPTTIDRFIHAVLGTWLSGVFLVISVSAYYLWKKRHHEFAKQGMKIGTICAVIVLVLQLWSADVTARGVAKNQPAKLAAFEGIFKTEEYTPIWAFGYVDMEKERVIGLPIPGALSFLVHRNIKTPVTGLDQIPRDEWPNVQAVFQLYHLMIMLWGVMVALTLISWSAYKGWRWALKPFFLVILTFSVLLPEICNECGWCAAEMGRQPWVVQGLLKTKDAVSPIVQANKIVQSLVIFSLVFIALLTLFITVLCKKIKHGPEEENDLTEFEVK

SEQ ID NO: 121 - protein, 268 aa, Chlamydia pneumoniae
MELSLTSLLPLAWYVILGVAVFAYSFGDGFDLGLGAVYLKAKEDKERRILLNSIGPVWDGNEVWLVIIVGGLFAGFPACYATLLSIFYMPIWTLVLLYIFRGCSLEFRSKSESVSWKIFWDIIFICSGTAISFFLGTIVGNLILGLPLSPDTSYASLSWILFFRPYAALCGAVVASAFATHGSFFALMKTSDSLNARIAQQFPYILSSFLVFYVLFLGASLISIPKRFDAFPTYPLLILLIALTSCCCVAAKTSVSKKHYGTHLFILH

SEQ ID NO: 122 - protein, 403 aa, Chlamydia pneumoniae
EKSMRMLQISMLLLALGTAINSPAIYAADSQSVSFPEQLPSSFTGEIKGNHVRMRLAPHTDGTIIREFSKGDLVAVIGESKDYYVISAPPGITGYVFRSFVLDNVVEGEQVNVRLEPSTSAPVLVRLSRGTQIQPASQEPHGKWLEVVLPSQCVFYVAKNFVANKGPIELYTQREGQKKIAMDLINSALNFAHIELEKSLNEIDLEAIYKKINLVQSEEFKDVPGIQGLIQKALEEIQDAYLSKSLESQNTSIASSQCSTPKVSSSEVTTSLLSRHIRKQTALKTAPLTQGRENLEYSLFRIWASMQQGNDHSEALTQEAFYRAEQKKKQVLAGVLEVYPHVVKNNPGDYLLKAQENTIAFLYGTSINLEQWLGKRVTVECLPRPNNHFAFPAYYVVGIKEAS

SEQ ID NO: 123 - protein, 255 aa, Chlamydia pneumoniae
YVPFRKFSNQNPMLLIYCKKKEIHLQWPQTAKIRFTPKIAMKVKINDQLICIPPFISARWSQIAFIESQEGENKDQGTLRLHLIDGKIISIPNLDQSIIDIAFQEHLLYLETSQSGKEDSRDDDKLGVGVLMNVLQQITKGNDIQVLPKNLISPLFSGTNPIEAILQHTPEHKDHPDAPTDVLEKMADVIRVLSGNNATLLPRPEPHCNCMHCQIGRVMNEEDTLAVSDKDLTFRTWDIMQSGDKVVYCNESLKS

SEQ ID NO: 124 - protein, 432 aa, Chlamydia pneumoniae
VRTQMKKTMVIDTSVFIYDPEALFSFENTRIIIPFPVIEELEAFGKFRDESAKNASRALSNIRLLLENAKTKVTDGVLLPSGSELRIEVAPLSNDDRRGKLLTLELLKIIAKREPMVFVTKSLGRRVRAEALQIESRDYESKRFSFRSLYRGFRELQVSQEDIENFYKNGYLDLPLDVVSSPNEYFFMSAGENHFALGRYYVSEGKIIALKAMDKSVWGIKPLNTEQRCALDLLLRDDVKLVTLIGQAGSGKTILALAAAMHKVFDKETYNKVLVSRPIVPMGRDIGFLPGLKEDKLMHWMQPIYDNMEVLFSINQMGNSSEALQALMDAKKLEMEALTYIRGRSLPKAFIIIDEAQNLTPHEIKTIISRAGKGTKIVLTGDPTQIDSLYFDENSNGLTYLVGKFHHLALYGHMFMTRTERSELAAAAATIL

SEQ ID NO: 125 - protein, 184 aa, Chlamydia pneumoniae
NNESRWGGYKSSSIGSSQCRFLGLSQRPLNPERQGTPLNEGECRAGMWRNADGSNHTGKQGKPHYLAQLLGPKAVDHHNKSQAAFDRCKNAYLNCFSLAQTLGVTFLQIPLISSGIYAPPENRKKPNSEENKVRMRWIHAVKCALVAAMQEFGNEPGNTDRRMLIVLTDLKTPAITDPKKKSHL

SEQ ID NO: 126 - protein, 195 aa, Chlamydia pneumoniae
KNLFHYKAILMSIFNEEVFIISHRHTPLGQTSTALRNTPLVNPLHRTNLQRIASYIPIFSTFIGIKTLKGISSLQYSMVLMTGNFSSVCKTLPCPEIYEELPKVRKEAWLEIFGIKALYYLVLGVIKIIKLIVRYLCPCCRPPEPREPQNPLTPTPLDMGQQIDAIFSTPTSPTGFKDPFLDDLLQEDKKKAPHL

SEQ ID NO: 127 - protein, 1043 aa, Chlamydia pneumoniae
MTADEVGKNSFAKKEEQVLKFWKDNQIFEKSLQNRQGKTLYSFYDGPPFATGLPHYGHLLASTIKDVVGRYATMDGYYVPRRFGWDCHGVPVEYEVEKSLSLTAPGPIEDFGIASFNEECRKIVFRYVHEWEYYINRIGRWVDFSSTWKTMDASFMESVWWVFQSLYNQGLVYEGTKVVPFSTALGTPLSNFEASQNYKEVDDPSLVVRMPLQNDSASLLVWTTTPWTLPSNMAIAVGETLVYVRIQDKKSGEQWILSQGCVSRWFSNPEEFVILESFSGKDLVGRTYEPPFTFFQSKREEGAFRVIAASFVEESEGTGVVHMAPAFGEGDFLVCKENHVPLVCPVDAHGSFTEEIPQYQGQYIKHADKEIIKFLKKEGRIFYHGTVKHRYPFCWRTDTPLIYKAVNSWFVAVEKIKDKMLRANSSIHWVPEHIQEGRFGKWLEGARDWAISRNRYWGTPIPIWKSADGEILVVGSIRELEELTGTQITDIHRHFIDDLNIVKDGKPFHRIPYVFDCWFDSGAMPYAQNHYPFENQKETEEAFPADFIAEGLDQTRGWFYTLTVISAILFDRPAFRNAIVNGIILAEDGNKMSKRLNNYPSPKYVLDTYGADALRLYLLHSVVVKAEDLRFSDKGIEGVLKQILLPLTNVLSFFNTYAELYGFDPKSQDIEPAYTEIDQWILSNLYSVVGKVRESMSQYHLNFAVEPFVTFIDDLTNWYIRRCRRRFWEAEDTPDRRAAFSTLYEVLTVFCKVIAPFVPFLAEDIYQKLKLEKEPESVHLCDFPQVEMDKILPDLEKRMHDIREIVGLGHSLRKEHKLKVRQPLANFYVVGSKDRLSLLKTFEGLIAEELNVKNVIFYEEAPSFIYTTVKPNFRMLGKKVGSKMKEVQKALSELPNNAIDKLIQEETWVLTIDDREIALDGDDVVICRHTDPGYIARSSALFSVILDCQLREPLIVEGIARELVNKINTMRRNQQLHVSDRIALRIKTTEAVHRAFLDYENYICEETLIIAYDFTQDSDFQGENWDINGHATQIEITVSSIDS

SEQ ID NO: 128 - protein, 636 aa, Chlamydia pneumoniae
MKQHYSLNKSRHILRSTYKLLKSKKLAHSPADKKQLQELLEQLEEAIFEHDQETASDLAQQALAFSNRYPNSFGRKTYELIKALLFAGVVAFLVRQFWFELYEVPTGSMRPTILEQDRILVSKTTFGLHCPFAKKPLAFNPESVTRGGLVVFTVGDLPIPDADTKYFGLIPGKKRYIKRCMGRPGDFLYFYGGKIYGLDDAGKRIEFPSVHGLENLYHVPYISFDGTTSSHTEGQKTIIDFKQFNQSYGRLIFPQTSMYGQFFDHKEWHQDEPNKLKDPHLSPVSYADLFGMGNYAMVRILTEHQARTSHLLPNPGSPTKVYLEICHTANLSYPKPLLRHYEHQLSPAIQPMKTLLPLRKEHLHLIRNNLTTSRFIVAQGCAYKYHQFKINTSGIAKAYAILLPKVPDGCYEYSKGEAYQIGFGEIRYKLKSSHPLTQLNDKQVIELFNCGINFSSIYNPVNPLQAPLPNRYAFFNQGNLYIMDSPVFIKNDPTLQKFVTSETEKQEGSSETQPYIAFVDKGLPPEDFKEFVEFIHNFGIQVPKGHVLVLGDNYPMSADSREFGFVPMENLLGSPLCTFWPIGRMGRLTGVSAPTTLSGYLVSGIALATGLSLIGYVYYQKRRRLFPKKEEKNHKK

SEQ ID NO: 129 - protein, 276 aa, Chlamydia pneumoniae
QLQNRYPIMPNDSSTYFERILQKYLMKKQGKTLFLFLFLSFLFSTAFSGLFASQTSSLRTIQENIFLAKTGDYTVLSRGSQRTFVLVKSTTPKTVWIEIIHFPCIAHKERPSLEQASWKTVIHQLESPSQVFVVSLSSEGSQFFSLNTRTKSLEPVGKSTTVPAFLQIFDLPLSPAPANVIKTKGKENKPWSPKVSFEGAPLTSISVNAWQGLWPKDRGPLSETGILMYFTQPDISVFPLWVSIETPKGTSIVRAVDIGHGATSPYVYSLPDSKTQ

SEQ ID NO: 130 - protein, 109 aa, Chlamydia pneumoniae
  SITE 1...109: Xaa=unknown or other
MKKNTHPEYRQVLFVDXSTGYKFVCGXTYQSEKTEVFEGKEYPVCYVSVSSSSHPFFTGSKKFVDAEGRVDKFLKRYSNVRQPAQQPQPEEDALPAAKGKKKVVTKKKK

SEQ ID NO: 131 - protein, 359 aa, Chlamydia pneumoniae
GFMKKKVAEYLNRLAEVEIKISNPEIFSNSKEYSALSKEHSYLLELKNAYDKILNLEKVLADDKQALAIEKDPEMVVMLEEGINENKVELEKLNKILESLLVPPDPDDDLNVIMELRAGTGGEEAALFVGDCVRMYHLYASSKGWKYEVLSASESDLKGYKEYVMGISGTGVKRLLQYEAGTHRVQRVPETETQGRVHTSAITIAVLPEPSEEDTELLINEKDLKIDTFRASGAGGQHVNVTDSAVRITHLPTGVVVTCQDERSQHKNKDKAMRILKARIRDAEMQKRHNEASAMRSAQVGSGDRSERIRTYNFSQNRVTDHRIGLTLYNLDKVMEGDLDPITTAMVSHAYHQLLEHGN

SEQ ID NO: 132 - protein, 296 aa, Chlamydia pneumoniae
MPTTSYSNMEIKKAIQEGTAYLDYYGVPLSDCEALYILMDLLEVSSRAKLFDLVGISETMLMEYRKRLALRGQRCPTAYLNGAVSFLGLRLRVDSRVLIPRTETELLAEYIINYLLSHSEIQTFYDICCGSGCLGLAIKKSCPHVEVVLSDVCPQAVAVANENAKSNGLDVKILLGDLSAPYTRPADAFVCNPPYLSFNEIIHIDPEVRCYEPWKALVGGSTGLEFYQRIAQELPKIVTSTGVGWLEIGSSQGESIKNIFSKHGIYGRLHQDLSGRDRIFFLEMDGRDPVSSGAYS

SEQ ID NO: 133 - protein, 448 aa, Chlamydia pneumoniae
  SITE 1...448: Xaa=unknown or other
MINSLSQKLSSIFSFLVSSRRINEENISESIREVRLALLDADVNYHVVKDFISKVKXKILGEEIWKHVSPGKQFIRCLHEELVAFLSDGREEFTIQKTPSIILLCGLQGAGKTTTAAKLADYVIKNKKAKKVLVVPCDLKRFAAVDQLKILVAQTKAEFYQSQENKPIDVVVKALAYAKENGHDFVILDTAGRLNIDNELMEELTAIQKVSQANERLFVMNVAMGQDVLATVQAFDQSLDLTGVILSMTDGDARAGAVFSIKHVLGKPIKFEGCGERIQDLRSFDPQSMAERILGMGDTINFVKEMREYISEEEDAELGKKLVTAAFTYEDYYKQMKAFRRMGPLRKLLGMMPGFNNAKPSQKEIEDSEQQMKRTEAIILSMTPEERKELVELDMSRMKRIASGCGLTLGDVNQFRKQMSQSKKFFKGMSKGKMEQVRKKMSGGNQWR

SEQ ID NO: 134 - protein, 208 aa, Chlamydia pneumoniae
MKIDILSLSPGYFDGPLQTSILGRAIKQRLLDVQLTNLRDFGLGKWKQVDDTPFSGGGMLLMAEPVTSAIRSVRKENSKVIYLSPQGALLTAEKSRELAAASHLILLCGHYEGIDERAIESEVDEEISIGDYVLTNGGIAALVLIDAVSRFIPGVLGNQESAERDSLENGLLEGPQYTRPREFEGKEVPEVLLQGDHKAISSVEIGAK

SEQ ID NO: 135 - protein, 189 aa, Chlamydia pneumoniae
KDLSIHALESLKGKKFQKYCCKGITKPFHQWRLEQSERRTYERRPDLYLNYLYKRSIDHKFDEETTTNRDHFKCDKISVVLEVNKLKRAKNFYCKVFGLDAMSCENKFCLPHEGKTIFWLREVQAEKKNIVTLSLSLDCACEEDFCYLLRRWELFGGKLLEKQADEHAVWALAQDLDGHAWIFSWHRMK

SEQ ID NO: 136 - protein, 121 aa, Chlamydia pneumoniae
MVNLLKELEQEQCRNDLPEFHVGDTIRLATKISEGGKERVQVFQGTVMARRGGGSGETVSLHRVAYGEGMEKSFLLNSPRIVSIEIVKRGKVARARLYYLRGKTGKAAKVKEFVGPRSSKK

SEQ ID NO: 137 - protein, 214 aa, Chlamydia pneumoniae
MNTSISEIQRFLSMIAFEKELVSEDFSVVAGIDEAGRGPLAGPVVASACILPKGKVFPGVNDSKKLSPKQRAQVRDALMQDPEVCFGIGVISVERIDQVNILEATKEAMLQAISSLPISPDILLVDGLYLPHDIPCKKIIQGDAKSASIAAASILAKEHRDDLMLQLHRLYPEYGFDRHKGYGTSLHVEAIRRYGPSPCHRKSFSPIKQMCAIV

SEQ ID NO: 138 - protein, 209 aa, Chlamydia pneumoniae
VCYCMNKILVDSPFSPDHQKCCPKLFTISAPAGVGKTTLVRMLEQEFSSAFAETISVTTRKPREGEVPGKDYHFVSHEEFQRLLDRQALLEWVFLFGECYGTSMLEIERIWSLGKHAVAVIDIQGALFIRSRMPSVSIFIAPPSQEELERRLASRGSEEGSQRKERLEHSLIELAAANQFDYVIINDDLNQAYRVLKSIFIAEEHRNIL

SEQ ID NO: 139 - protein, 100 aa, Chlamydia pneumoniae
EHIMIKKDRFTNEKLNKLFDSPFSLVNYAIKQAKIKIAKGDVRSSNVAIETLVLLDREGIQPEFTEEIVVTASPTVERKRSEHTNSRKKDPSAYTWSDVK

SEQ ID NO: 140 - protein, 554 aa, Chlamydia pneumoniae
CKVMPQKVLITSALPYANGPLHFGHIAGVYLPADVYARFRRLLGDDVLYICGSDEFGIAITLNADREGLGYQEYVDMYHKLHKDTFEKLGFALDFFSRTTNPFHAELVQDFYSQLKASGLIENRISEQLYSEQEQRFLADRYVEGTCPRCGFDHARGDECQSCGADYEAIDLIDPKSKISGVELVKKETEHSYFLLDRMKDALLSFIQGCYLPDHVRKFVVDYIEHVRSRAITRDLSWGIPVPDFPGKVFYVWFDAPIGYISGTMEWAASQGNPDEWKRFWLEDGVEYVQFIGKDNLPFHSVVFPAMELGQKLDYKKVDALVVSEFYLLEGRQFSKSEGNYVDMDKFLSSYSLDKLRYVLAATAPETSDSEFTFLDFKTRCNSELVGKFGNFINRVLAFAEKNHYDKLSYHSVVLEDSDRAFLEEVRQLVRDAEKCYREYSLRKATSVIMSLAALGNVYFNQQAPWKLLKEGTRERVEAILFCACYCQKLLALISYPIIPESAVAIWEMISPKSLENCNLDTMYARDLWKEEILDVINEEFHLKSPRLLFTTVE

SEQ ID NO: 141 - protein, 408 aa, Chlamydia pneumoniae
SQAHFIFFEENPFYRRRKSNCLGRGKLSIDLAEQQREAIKACFSEKLLIITGGPGTGKSTITQAILKIFEQVTHKIILAAPTGKAAKRMTEITQKHSVTIHALLQYDFKTKSFRKNHDNPIDCDLIIVDESGMMDTHLLHHFLKALPDYTTLVFIGDIHQLPSVGPGNILKDLITSNKMTVIRLNKIFRQVHDSGIVTNAHRVNEGELPILYSETGRRDFLFFQKDDQEEALNHIIHLVTKFVPQKYHIYPQDIQVLAPMKKGTLGIYNLNKALKHALNPKKANLHGRFQSYAVGDKVMQIRNNYNKEVFNGDIGYVSTINFEDKAVVVRMEGKHVGYSFSELDDLVLAYATSVHKYQGSESPCIIIPIHTSHFMMLYRNLLYTAITRGKKLVILVGTKKAICYCNKK

SEQ ID NO: 142 - protein, 313 aa, Chlamydia pneumoniae
NSMEKICGYLEQILVENKDSGDITAYIKIPNKTTPILIKGKLPQPLELGSPIQIYGVWSHSPSNTKYFQIHSYDSPLLYEYRGVFHYLTSKLIKGIGPKIAEKIIEKFQEKTCYVLDITPERLSEVSGISETRCVSICKQLCEQKMLRKTLLFLQEYNIPIHYGVRIFKKYQEKSIEKICEDPFLLAREMEGIGFKTADFIAMKLGVPRNSESRLCAGIQHSLEELQEEGHTCYPIELLIDVVAKLLNQDVFDTPITLEEIDTQILNMQKRNFYIFKTFLGHSMSGHVISISQRKLLFLISSAFYFLRGESVL

SEQ ID NO: 143 - protein, 498 aa, Chlamydia pneumoniae
IRSKQRTVAITLLVLGILLIASGIIFLAVAIPGLSSAVALGLGCGMTALGTVLLITGLVLLIRSEKLALEQVEIKQARTRVNNELDQLSQYVFYTENVLDNLKRWSYRDLGFVRQAQEEVTNLEQDIEEIFLTLRDIRNALDNEEFFMTHAKQCLAQVGESLFQDASIDEFINLAHLSEIRQHLDINDPRWSMITKKVKGTVVRFIYVSTMYKQIKSNFEKSDFGQLRKMLLNNYKTIEEVLYQSFQRGYNRAALLSEKTRIIHTSSLLHWEKDEDKHLNIKNECASRLENFKKFRTLFLGLSEEDVIDFTGASGWDCSKLPRKEVPLDGGKKKLRFKRTFADEQVGDWDRTTSLEHMTPQEEDPLDRLMDQVEQEATSVLKDQDRYWKEIETSEAKFRSLPREDDFEKQSQIDSYIRDLDDHLSVWANQLSAAEDALIEVTDVQEHGNREMLKNIQQGLELIEDAVKATLPRVDFIQELLEKEELPLVAARMSLENS

SEQ ID NO: 144 - protein, 538 aa, Chlamydia pneumoniae
PFFSKPPEEISQLESYIRSAANDLNTIKTWPHKDQRLVETVSRKLERLAAAQNYMISELCEISEILEEEEHHLILAQESLEWIGKSLFSTFLDMESFLNLSHLSEVRPYLAVNDPRLLEITEESWEVVSHFINVTSAFKKAQILFKNNEHSRMKKKLESVQELLETFIYKSLKRSYRELGCLSEKMRIIHDNPLFPWVQDQQKYAHAKNEFGEIARCLEEFEKTFFWLDEECAISYMDCWDFLNESIQNKKSRVDRDYISTKKIALKDRARTYAKVLLEENPTTEGKIDLQDAQRAFERQSQEFYTLEHTETKVRLEALQQCFSDLREATNVRQVRFTNSENANDLKESFEKIDKERVRYQKEQRLYWETIDRNEQELREEIGESLRLQNRRKGYRAGYDAGRLKGLLRQWKKNLRDVEAHLEDATMDFEHEVSKSELCSVRARLEVLEEELMDMSPKVADIEELLSYEERCILPIRENLERAYLQYNKCSEILSKAKFLLSGRRAIASFGSESKRGGCPVKTSTGKMSREGPKVRNI

SEQ ID NO: 145 - protein, 201 aa, Chlamydia pneumoniae
KGHTSNIISVLKFYPRQSFFFPEDEQLLVSEANLREVGAQLKQVQGKCQERAQKFAIFEKHIQEQKSLIKEQVRSFDLAGVGFLKSELLSIACNLYIKAVVKESIPVDVPCMQLYYSYYEDNEAVVRNRLLNMTERYQNFKRSLNSIQFNGDVLLRDPVYQPEGHETRLKERELQETTLSCKKLKVAQDRLSELESRLSRR

SEQ ID NO: 146 - protein, 259 aa, Chlamydia pneumoniae
  SITE 1...259: Xaa=unknown or other
MLRNQVLVYCSEGVSPYYLRHTIRFLKYYSTQEGAFDILRVXGNFLIKNPFWEETTRLLVFPGGADRPYHRVLHGLGTARIFQYVSEGGNFLGICAGAYFGSKMIYFYEPEGAPLQGARDLGFFPGTAKGPAYRGNFSYVSPSGVRVSPQLFSDFGLGYAMFNGGCFFEGSEGYPGVNIESRYDDLPGKPASIVSRIVSKGLAVLSGPHIEYLPHYCRMVKENVQKTREFLQRERTTLDRYCQNLVQRLRQPAFSKADC

SEQ ID NO: 147 - protein, 396 aa, Chlamydia pneumoniae
  SITE 1...396: Xaa=unknown or other
SSMVKCSSIIHENKKPAQLLPESKFAAITKLSLAILSLFLGIAACILIALSGLLPNTLLIIALSLISIIVLSTGISLLIGTQCSKSVQKDEQKPKSIFPKETPSLDPWLLNPLKNKIQSSETLLLDPTSINLKNELFFPSFEEWKKIFLKDPDFLIKSALANWKILEQDEQYILSHIHMDPRIFVTSEPLQKTYQKLQEKHVNNLGIASQVSLTDLQNKTQYENNLIETTTNEITYYFPVVHNPDILRSEWDPISNQLYLIFKKFFIHYHNLFSTALERNQILLIDSLNTGSSNPIARQMELLAFLCVFEQLDYNEDEYTIEPRDYFNRFVYXXSXTAPQIQSFGLLHGYEEMSYASNNIRNVLTHSIVLCSPILYQLITEFDTTKIHADDFDCLI

SEQ ID NO: 148 - protein, 266 aa, Chlamydia pneumoniae
  SITE 1...266: Xaa=unknown or other
FSSLKKERFSLSLAIFLIFFFTSAYVFPSICFLELFMENAMSSSFVYNGPSWILKTSVAQEVFKKHGKGIQVLLSTSVMLFIGLGVCAFIXPQXLIVFVLTIDLLMLAISLVLFLLKVLYAPSMVDRLWCSEKGYALHQHENGPFLDVKRVQQILLRSPYIKVRALWPSGDIPEDPSQAAVLLLSPWTFFSSVDVEALLPSPQEKEGKYIDPVLPKLSRIERVSLLVFLSAFTLDDLNEQGVNPLMNNEEFLFFINKKARDMGFRI

SEQ ID NO: 149 - protein, 119 aa, Chlamydia pneumoniae
HGIQDLKHEIMSSLEKTGVPLDPSMSFQVSQAMFSVYRYLRQRDLTTSELRCFHLLSCFKGDVVHCLASFENPKDLADSDFLEACKNVEWGEFISACEKALLKNPQGISIKDLKQFLVR

SEQ ID NO: 150 - protein, 326 aa, Chlamydia pneumoniae
SMIEFAFVPHTSVTADRIEDRMACRMNKLSTLAITSLCVLISSVCIMIGILCISGTVGTYAFVVGIIFSVLALVACVFFLYFFYFSSEEFKCASSQEFRFLPIPAVVSALRSYEYISQDAINDVIKDTMQLSTLSSLLDPEAFFLEFPYFNSLIVNHSMKEADRLSREAFLILLGEITWKDCETKILPWLKDPNITPDDFWKLLKDHFDLKDFKKRIATWIRKAYPEIRLPKKHCLDKSIYKGCCKFLLLAENDVQYQRLLHKVCYFSGEFPAMVLGLGSEVPMVLGLPKVPKDLTWEMFMENMPVLLQSKREGHWKISLEDVASL

SEQ ID NO: 151 - protein, 257 aa, Chlamydia pneumoniae
MFKLLKNLFLIGCCIVGYFWMRKESIVEQWLSNRLHTQVTVGRVSIRTSGIKIRHICIHNPLASERFPYAAEIEYADVRFSSISMLLTKQLEISELIIHGANFTIFPYDSHGTKTNWSLVWKNFHPQKETPSNLWIDRAPVLIRRCLFLNTRLYGLRANHKDIPHLSVPSLEFHSHTSSAKELPKLSEALPSLLYLALEESLYHLNLPGDIIKPLSQQAHKHFYSSYPQFQDRLNDINTPGTPTEEIIGFIRGLFFH

SEQ ID NO: 152 - protein, 83 aa, Chlamydia pneumoniae
SKEGRASESFGNSLAELVWLWNSKDGTERWGMSLWLALSPYNRVFRNRHLRMSTGARSIHKFEGVSFCGWKFFHTKDQFVFVP

SEQ ID NO: 153 - protein, 544 aa, Chlamydia pneumoniae
  SITE 1...544: Xaa=unknown or other
MAAKNIKYNEEARXKIHKGVKTLAEAVKVTLGPKGRHVVIDKSFGSPQVTKDGVTVAKEIELEDKHENMGAQMVKEVASKTADKAGDGTTTATVLAEAIYSEGLRNVTAGANPMDLKRGIDKAVKVVVDELKKISKPVQHHKEIAQVATISANNDSEIGNLIAEAMEKVGKNGSITVEEAKGFETVLDVVEGMNFNRGYLSSYFSTNPETQECVLEDALILIYDKKISGIKDFLPVLQQVAESGRPLLIIAEEIEGEALATLVVNRLRAGFRVCAVKAPGFGDRRKAMLEDIAILTGGQLVSEELGMKLENTTLAMLGKAKKVIVTKEDTTIVEGLGNKPDIQARCDNIKKQIEDSTSDYDKEKLQERLAKLSGGVAVIRVGAATEIEMKEKKDRVDDAQHATIAAVEEGILPGGGTALVRCIPTLEAFLPMLANEDEAIGTRIILKALTAPLKQIASNAGKEGAIICQQVLARSANEGYDALRDAYTDMIDAGILDPTKVTRSALESAASIAGLLLTTEALIADIPEEKSSSAPAMPSAGMDY

SEQ ID NO: 154 - protein, 102 aa, Chlamydia pneumoniae
MSDQATTLRIKPLGDRILVKREEEEATARGGIILPDTAKRKQDRAEVLVLGTGKRTDDGTLLPFEVQVGDIILMDKYAGQEITIDDEEYVILQSSEIMAVLK

SEQ ID NO: 155 - protein, 617 aa, Chlamydia pneumoniae
  SITE 1...617: Xaa=unknown or other
KGVPSLMTTELKTEALPTRTQVDPKHCWDTTLMYANREEWKKDFDLCSSGKDRSPIWPEFSPSHYQIDNPESLLELLSKKFSVERKLDQLYIYAHLIHDQDITNPEGESDYQSIVYLYTLFSQEISWIQPAXIALSEEKVAALLSSSVLAPYRFYLEKIFRLSPHTGTANEEKILASSFAALNVSNKAFSSLSDAEIPFGIAKDSNGEEHPLSHALASLYMQSPDQELRRTAYLAQFQRYYDYRNTFANLLNGKVQAHLFEAKARNYPSCLEASLFQHNIPTTVYINLINETKKHTSLINRYFNLKKEALNLKEFHFYDVYAPISQTTSKNYSYEEGVDLVCKSLLPLGTHYVEILRNGLLSNRWVDRYENKHKRSGAYSSGCYDSAPYILLNYTNTLYDVSVIAHEAGHSMHSYFSREAQPYHDAQYPLFLAEIASTFNEMLLMEALSKSDQSKEDKIVIITKTLDTIFATLFRQTFFAAFEYEIHSAAEQGTPLTEEFLSATYGNLQKEFYGGVVTSDSLSALEWARIPHFYYNFYVYQYATGIIAALSFAEKXLTQEPGALELYLKFLKSGRSDFPLNILKKSGLDMTTSAPLDKAFAFITKKIDLLSSLLSED

SEQ ID NO: 156 - protein, 251 aa, Chlamydia pneumoniae
MNVADLLSHLETLLSSKIFQDYGPNGLQVGDPQTPVKKIAVAVTADLETIKQAVAAEANVLIVHHGIFWKGMPYPITGMIHKRIQLLIEHNIQLIAYHLPLDAHPTLGNNWRVALDLNWHDLKPFGSSLPYLGVQGSFSPIDIDSFIDLLSRYYQAPLKGSALGGPSRVSSAALISGGAYRELSSAATSQVDCFITGNFDEPAWSTALESNINFLAFGHTATEKVGPKSLAEHLKSEFPISTTFIDAANPF

SEQ ID NO: 157 - protein, 449 aa, Chlamydia pneumoniae
  SITE 1...449: Xaa=unknown or other
MWKLTKRNSMLNCSNQKHTVTFEEACQVFPGGVNSPVRACRSVGVTPPIVSSAQGDIFLDTHGREFIDFCGGWGALIHGHSHPKIVKAIQKTALKGTSYGLTSEEEILFATMLLSSLKLKEHKIRFVSSGTEATMTAVRLARGITNRSIIIKFIGGYHGHADTLLGGISTTEETIDNLTSLIHTPSPHSLLISLPYNNSQILHHVMEALGPQVAGIIFEPICANMGIVLPKAEFLDDIIELCKRFGSLSIMDEVVTGFRVAFQGAQDIFNLSPDITIYGKILGGGLPAAALVGHRSILDHLMPEGTIFQAGTMSGNFLAMATGHAAIQLCQSEGFYDHLSQLEALFYSPIEEEIRSQGFPVSLVHQGTMFSLFFTESAPTNFDEAKNSDVEKFQTFYSEVFDNGVYLSPSPLEANFISSAHTEENLTYAQNIIIDSLIKIFDSSAQRFX

SEQ ID NO: 158 - protein, 174 aa, Chlamydia pneumoniae
  SITE 1...174: Xaa=unknown or other
SLLLNINQGVFARSVILLCEHSLNGSFGLILNKTLGFEISDDIFTFEKVSNHNIRFCXGGPLQANQMMLLHSCSEIPEQTLEICPSVYLGGDLPFLQEIASSESGPEINLCFGYSGWQAGQLEKEFLSNDWFLAPGNKDYVFYSEPEDLWALVLKDLGGKYASLSTVPDNLLLN

SEQ ID NO: 159 - protein, 124 aa, Chlamydia pneumoniae
MSLEKELLEETPLVLLNFYKLVSFCNYAGMILGTEEKKFAIYGHVSMGQAFQGADTEGHSPQRPFAHDLLNFVFSGFDIQVLRVVINDYKDNVFYTRLFLEQKDREFLYVVDVDARPSDRSLSP

SEQ ID NO: 160 - protein, 140 aa, Chlamydia pneumoniae
SRPSIADDQRWWRTFFREKILLRAAKRSIILVDESKLVPVLGKFRVPLEISRFGRSAIIEEIRHLGYEGEWRLQDTGDLFITDSSNYIYDIFSPNSYPNPEKDLLKLIQIHGVIEVGFVIEKVEVWSSNSQGLISKKYSV

SEQ ID NO: 161 - protein, 112 aa, Chlamydia pneumoniae
VEKDLHLHEKKCLAHEAATQVTSGMILGLGSGSTAKEFIFALAHRIQTESLAVHAIASSQNSYALAKQLAIPLLNPEKFSSLDLTVDGADEVDPQLRMIKGGGGPFSEKRFF

SEQ ID NO: 162 - protein, 378 aa, Chlamydia pneumoniae
RRTIMNTSLKRPLKSHFDVVGSFLRPEHLKKTRESLKEGSISLDQLMQIEDIAIQDLIKKQKAAGLSFITDGEFRRATWHYDFMWGFHGVGHHRATEGVFFDGERAMIDDTYLTDKISVSHHPFVDHFKFVKALEDEFTTAKQTLPAPAQFLKQMIFPNNIEVTRKFYPTNQELIEDIVAGYRKVIRDLYDAGCRYLQLDDCTRGGLVDPRVCSWYGIDEKGLQDLIQQYLLINNLVIADRPDDLVVNLHVCRGNYHSKFFASGSYDFIAKPLFEQTNVDGYYLEFDHERSGDFSPLTFISGEKTVCLGLVTSKTPTLENKDEVIARIHQAADYLPLERLSLSPQCGFASCEIGNKLTEEEQWAKVALVKEISEEVWK

SEQ ID NO: 163 - protein, 872 aa, Chlamydia pneumoniae
VLGVNFMEKFSDAVSEALEKAFELAKSSKHTYVTENHLLLALLENTESLFYLVIKDIHGNPGLLNTAVKDALSREPTVVEGEVDPKPSPGLQTLLRDAKQEAKTLGDEYISGDHLLLAFWSSNKEPFNSWKQTTKVSFKDLKNLITKIRRGNRMDSPSAESNFQGLEKYCKNLTALAREGKLDPVIGRDEEIRRTIQVLSRRTKNNPMLIGEPGVGKTAIAEGLALRLIQGDVPESLKGKQLYVLDMGALIAGAKYRGEFEERLKSVLKDVESGDGEHIIFIDEVHTLVGAGATDGAMDAANLLKPALARGTLHCIGATTLNEYQKYIEKDAALERRFQPIFVTEPSLEDAVFILRGLREKYEIFHGVRITEGALNAAVLLSYRYIPDRFLPDKAIDLIDEAASLIRMQIGSLPLPIDEKERELAALIVKQEAIKREQSPSYQEEADAMQKSIDALREELASLRLGWDEEKKLISGLKEKKNSLESMKFSEEEAERVADYNRVAELRYSLIPQLEEEIKQDEASLNQRDNRLLQEEVDERLIAQVVANWTGIPVQKMLEGEAEKLLILEESLEERVVGQPFAVSAVSDSIRAARVGLNDPQRPLGVFLFLGPTGVGKTELAKALADLLFNKEEAMVRFDMSEYMEKHSISKLIGSSPGYVGYEEGGSLSEALRRRPYSVVLFDEIEKADKEVLNILLQVFDDGILTDGKKRKVNCKNALFIMTSNIGSPELADYCSKKGSELTKEAILSVVSPVLKRYLSPEFMNRIDEILPFVPLTKEDIVKIVGIQMRRIAQRLKARRINLSWDDSVILFLSEQGYDSAFGARPLKRLIQQKVVILLSKALLKGDIKPDTSIELTMAKEVLVFKKVETPS

SEQ ID NO: 164 - protein, 182 aa, Chlamydia pneumoniae
NCAASFIWLNKSSHRNLRSPMFKSFIVRYMFVGGLVSFLLPIPDLECANNVTKTYDKKASVISRDLKLQEDCQKFWNLDPYKLESLCAYQVLYHDDYSSKRIRELFPQIQKDEVPIFATMILTLGKVDRGFSPEEISLIQKLSYPGLSLASLRGSTEIRPEYRFGSCFSSVGVFWRFREEPS

SEQ ID NO: 165 - protein, 399 aa, Chlamydia pneumoniae
EGLQKLDPNTDLARALVVSEFSGDLGKNRADYYSNCLDILALRIHAERQRYLDQSPCVPGTSEFHKATIEAINTILFYEEAVRYPSKKEMFSDEFSFLSSVTDRKFGVCLGVSSLYFSLSQRLDLPLEAVTPPGHIYLRYQGGEVNIETTAGGRHLPTASYCDCLDLEDLQVRTPEEMIGLTFMNQGSFALQKKKYKEAEEAYKKAQEYLGDEELQELLGFVQILGGKKKEGKSLIGKSPRASQKGSVAYDYLKGRINIPTLALLFSYPGSNYEEIASYEEELKKAMKSSMPCCEGQRRLASVAFHLGKTAEAVALLEKCVEDIPNDLSLHLRLCKILCDRHEYTKALKYFIIAERLMEDQGFLKKDNRSFALFYEVKKIISKVAPQKANTLLLMESER

SEQ ID NO: 166 - protein, 167 aa, Chlamydia pneumoniae
IIVGISMSSSEVVFQTVHGLGFGGLSSKSVVPFKKSLSDAPRVVCSILVLTLGLGALVCGIAITCWCVPGVILMGGICAIVLGAISLALSLFWLWGLFSNCCGSKRVLPGEGLLRDKLLDGGFSRAAPSGMGLPGDGSPRASTPSCLEELQAEIQAVTQAIDQMSDD

SEQ ID NO: 167 - protein, 145 aa, Chlamydia pneumoniae
LPAPELRSSWVKGDPPPRPASPATPPSRGGVAEFLSLGSPLFPGLGISALGILSSLKVISIAQANNATPSSIVIAPAAIPKGQQPARTTRPSPSKEIATTAMIAAITDLAILVALSSVLNAGIASLEQFTHPTDVAADVTASFID

SEQ ID NO: 168 - protein, 538 aa, Chlamydia pneumoniae
GKWWRVSSMESEKDIGAKFLGDYRILYRKGQSLWSEDLLAEHRFIKKRYLIRLLLPDLGSSQPFMEAFHDVVVKLAKLNHPGILSIENVSESEGRCFLVTQEQDIPILSLTQYLKSIPRKLTELEIVDIVSQLASLLDYVHSEGLAQEEWNLDSVYIHILNGVPKVILPDLGFASLIKERILDGFISDEENRESKIKERVLLHTSEGKQGREDTYAFGAITYYLLFGFLPQGIFPMPSKVFSDFIYDWDFLISSCLSCFMEERAKELFPLIRKKTLGEELQNVVTNCIESSLREVPDPLESSQNLPQAVLKVGETKVSHQQKESAEHLEFVLVEACSIDEAMDTAIESESSSGVEEEGYSLALQSLLVREPVVSRYVEAEKEEPKPQPILTEMVLIEGGEFSRGSVEGQRDELPVHKVILHSFFLDVHPVTNEQFNRYLECCGSEQDKYYNELIRLRDSRIQRRSGRLVIEPGYAKHPVVGVTWYGASGYAEWIGKRLPTEAEWEIAASGGVACYAIPVGRKSKKAGQIFSLRIRQQS

SEQ ID NO: 169 - protein, 662 aa, Chlamydia pneumoniae
MKEENSQAHYLALCRELEDHDYSYYVLHRPRISDYEYDMKLRKLLEIERSHPEWKVLWSPSTRLGDRPSGTFSVVSHKEPMLSIANSYSKEELSEFFSRVEKSLGTSPRYTVELKIDGIAVAIRYEDRVLVQALSRGNGKQGEDITSNIRTIRSLPLRLPEDAPEFIEVRGEVFFSYSTFQIINEKQQQLEKTIFANPRNAAGGTLKLLSPQESRKRKLEISIYNLIAPGDNDSHYENLQRCLEWGFPVSGKPRLCSTPEEVISVLKTIETERASLPMEIDGAVIKVDSLASQRVLGATGKHYRWALAYKYAPEEAETLLEDILVQVGRTGVLTPVAKLTPVLLSGSLVSRASLYNEDEIHRKDIRIGDTVCVAKGGEVIPKVVRVCREKRPEGSEVWNMPEFCPVCHSHVVREEDRVSVRCVNPECVAGAIEKIRFFVGRGALNIDHLGVKVITKLFELGLVHTCADLFQLTTEDLMQIPGIRERSARNILESIEQAKHVDLDRFLVALGIPLIGIGVATVLAGHFETLDRVISATFEELLSLEGIGEKVAHAIAEYFSDSTHLNEIKKMQDLGVCISPYHKSGSTCFGKAFVITGTLEGMSRLDAETAIRNCGGKVGSSVSKQTDYVVMGNNPGSKLEKARKLGVSILDQEAFTNLIHLE

SEQ ID NO: 170 - protein, 441 aa, Chlamydia pneumoniae
IIYYKFFYSYNCPYFISFFVLLGVNMASSSNNSTKQDGIPSWVNPNVQWNRASQVGDQEANSLTPEAQTSRSWFSDRKHFLEVLDVSLEEMENNDLKKYSRYKTIILIATLVTVAITCIVPISMVFGIPMWVPCLILFGAGLSSAFLSHRLQSKCKEIHLRYRAYQIYRQQLLSQYPDLRKSTLYKYSITHVKPKKGFVGKLVENLRPDLHKNKDDGGAAADSRLDFAGYGVKHYQTDALLGVSGVNSVEWQRLASLIMSVKNDILNDVGSREPIDKAQRSALVVSGKDIGGEIQPGGILDISRDILAICGYGMNVGVEAKKAIDQYKKWYLNSSTFIAWNPQLPAIAQSYLLEQQRHLDYAAKIFQDLSALTTAHGTGQALEDLDSLLCYYDQLIESKGVGEKIIASIHQKASRLSNARFLRSGTFKEMVESIPRVFNYY

SEQ ID NO: 171 - protein, 1156 aa, Chlamydia pneumoniae
HRFTRKHLDLAMQDSCDQEHLKKWSNLYHVFSITIKEFTEGKLEQNEVVSRIQRLRGKLEKSKCSILGNCRTNAEYATKSEKKLADYLLQIGDREPFLTGMHKAIATGKAIQGKVEGVISQHPEKQIMMLRCSIERLEGMLRREDWGAILQKNEDEVLALKSTMEAQLQGFKDLVGTWEGKYQEFKKNKLSKVLVYDFTKSYSNLLNRLEVLHAESSTDDLVLHVDRMSEDLKKTIEEIDGNLFQVTPEELSLLAREYQGLMNELPLIVQEGNRLQEAISSEGVSQGLMLLNSLLNRDEKINKNIESSRKNLVAIAKQARSDARNIDSQGLAPLIQRNRASLDNILQNMYLFNGSIRNIHALDTETLVATSSNMFSAMHTFDWNIYTNLLDVLEIQSKPAPAPMENPDLPGALPEEVQDAVAEDVSGTHRLHHQVLKRRCADLKNMISQLQKSINKWGMAKAIVLGIVAVLFCVLSAIFIGQNILSLLILSCVGLLLTQVCPLIFDRISKSKEFEKQVLETAQSLIPATKILPSEFNNKDLNRLAKLQDNLNLEGFGPTWARNIVSDLEGIPTKEKSLKDLTKEFRKDSKNLNKRIKRRFKEGLGQEAPVVRPTIPQDIRGAEVFAELHRELEHLQKQKEEISIRGDALVQERMGLCLEKSKYDNEKAHAAAMTKKVGKLQNIDRLQKNNETYVRIQNFFRTLIQEKLGRDTVQEIDVVKEAKELHELAAIIYGNTSGKSQKQRAKKQFKENVLHIAGKGQLELLEAYLNVTASQGLCRHQMQASFRERILLNPDGAKHGEAERTLASREEMLKTLGLSYLTPFVRFSSPESTQSGYNQILKVREQLFDIEQRLQNQETVSPEDYAAVQAALAAYVRKHESLIVSTYGLGAQEGQTSSKVTTLMRDLHAVEELVEMGVETYRLNRSDQILHRVHSVLHSHLRDSDSSGNGIIDVVKKLFELLNNNGNNPNDPECQKYMQILLDAPVSLLYGAFKSFKNEFLLNFTELNIANSTKAAEEEAKRYVEEKGRGFETYWEEAKQRLEAIAAELDDLRNQETLLEQEIRLANLKISIFSDLNLREKVSVEKAALEEEIQGIQEQYAEMQGIEDLELKQKFEDLQKKLEALEERLLQIGRRIDSSVDKQKELLGLLGREEAA

SEQ ID NO: 172 - protein, 518 aa, Chlamydia pneumoniae
CYENLFHYPRASMADILVIGANPTGLILANMLIQHGISVKVIDHRASPEDPSFLDCRKLPVILSCSSLELLHNSEMLGDFIQANHKIFGARYHWKKRTLLFKFSQATDSPVPFSLSTTYQSLEQHLIDEFLKRGGVIDWSTRPVTLVDNSIFIESTKVSQNFENREIYNPKWIIACEADNNLDIRDLVKSQLRARRINREVIFINCDEGEPFEEDHIHLLPITKNFLNFVFYNPQEKTKQLCLPQGTHSISPKLKQKLLYTYNLVISDENFHIKTSHHAFPPEHGNVLFLGSLSNTLLLSYLNGINTNIHAAFNLAWKLLPVLKKAALKHLVITKEQEDGNILPYISPTTEKRAKKLPFSRFYTPALMYYFLKGCRKFNTTGEEYYYPPHQALKYRSSDIIKMSPQDKEIHGPGPGMRAIDARLENGSFLLDPLKSSKHLLIFFKDIPDLKEALQEEYGEWIEICNVKEPRILNLYHANPNSLFIIRPDRYIGYRTHTFKLHELISYLLRIFASEKTS

SEQ ID NO: 173 - protein, 319 aa, Chlamydia pneumoniae
  SITE 1...319: Xaa=unknown or other
LIKMRKVAFLVSCLFSVAIGASAAPVRVPGFPQIPEDXVQIKTEVCPKQEVCLAVTIKCDDHNLIGVLHLPNTPTPEGGFPTVVLFHGFRGTKFGGLTGAYRKLGRKFAAAGIATLRVDMAGCGDSEGVAEEVPIETYLRDAQTILETVQEHPDLNAYRLGISGFSLGCHIAFELAKIYNPRDLNIKALSVWAPIADGGILLKELYENFSKHGEGDIISVGKDFGFGPPPIIVCSGDVDLLIRIQDHVTANSLPTKPYILHQQGIDDTLVSRTQQTLFKNTAPGRMTFISYPNTGHNLATAPDLDMILDQIVSHFQRTL

SEQ ID NO: 174 - protein, 507 aa, Chlamydia pneumoniae
  SITE 1...507: Xaa=unknown or other
MRYDPNLIEKKWQQFWKEHRSFQANEDEDKVKYYVLDMFPYPSGAGLHVGHLIGYTATDIVARYKRARGFSVLHPMGWDSFGLPAEQYAIRTGTHPKVTTQKNIANFKKQLSAMGFSYDEGREFATSDPDYYHWTQKLFLFLYDQGLAYMADMAVNYCPELGTVLSNEEVENGFSIEGGYPVERKMLRQWILKITAYADKLLEGLDALDWPENVKQLQKNWIGKSEGALVTXHLTQEGSLEAFTTRLDTLLGVSFLVIAPEHPDLDSIVSEEQRDEVTAYVQESLRKSERDRISSVKTKTGVFTGNYAKHPITGNLLPVWISDYVVLGYGTGVVMGVPAHDERDREFAEMFSLPIHEVIDDNGVCIHSNYNDFCLNGLSGQEAKDYVINYLEMRSLGRAKTMYRLRDWLFSRQRYWGEPIPIIHFEDGTHRPLEDDELPLLPPNIDDYRPEGFGQGPLAKAQDWVHIYDEKTGRPGCRETYTMPQWAGSCWYYLRFCDAHNYSVALE

SEQ ID NO: 175 - protein, 198 aa, Chlamydia pneumoniae
RRLKIGCISTTRRQVDQDVERLILCHSGQALAGIIFVSVMHTTTQLPWSKEKESYWMPVDLYIGGAEHAVLHLLYSRFWHRVFYDAGLVSTPEPFKKLINQGLVLASSYRIPGKGYVSIEDVREENGTWISTCGEIVEVRQEKMSKSKLNGVDPQVLIEEYGADALRMYAMFSGPLDKNKTWSNEGVWGVPSFPKSFL

SEQ ID NO: 176 - protein, 163 aa, Chlamydia pneumoniae
  SITE 1...163: Xaa=unknown or other
FGXSSEVQDIEDRDGLVLAHKLVFRITEHIEKMSLNTIPSSFMEFLNDFSKLPVYSKRALSMAVRVLEPIXPHISEELWVILGNPPGIDQAAWPQIDESYLVAQTVTFVVQVNGKLRGRLEVAKEAPKEEVLSLSRSVVAKYLENAQIRKEIYVPNKLVNFVL

SEQ ID NO: 177 - protein, 437 aa, Chlamydia pneumoniae
MMLRGVHRIFKCFYDVVLVCAFVIALPKLLYKMLVYGKYKKSLAVRFGLKKPHVPGEGPLVWFHGASVGEVRLLLPVLEKFCEEFPGWRCLVTSCTELGVQVASQVFIPMGATVSILPLDFSIIIKSVVAKLRPSLAVFSEGDCWLNFIEEAKRIGATTLVINGRISIDSSKRFKFLKRLGKNYFSPVDGFLLQDEVQKQRFLSLGIPEHKLQVTGNIKTYVAAQTALHLERETWRDRLRLPTDSKLVILGSMHRSDAGKWLPVVQKLIKEGVSVLWVPRHVEKTKDVEESLHRLHIPYGLWSRGANFSYVPVVVVDEIGLLKQLYVAGDLAFVGGTFDPKIGGHNLLEPLQCEVPLIFGPHITSQSELAQRLLLSGAGLCLDEIEPIIDTVSFLLNNQEVREAYVQKGKVFVKAETASFDRTWRALKSYIPLYKNS

SEQ ID NO: 178 - protein, 179 aa, Chlamydia pneumoniae
LLLEDLDTDSIPWPKLYLSEDFDFAYYPESKAIIDTVAKLEKNNPGEEFCLESKKILARYLLEQLFKLETGLNFPTSTIDGGRESFLIEFSHETKKPTVWAFIYFYYYHSNGPKLEKDFKQAGCEVHNRLLNLGLKYRPQAGAQNDGRNGGPYGPIGFLIVWEENYGSVLKDHGFIKDN

SEQ ID NO: 179 - protein, 115 aa, Chlamydia pneumoniae
CCFGGETATRIFSMTPSGFSLATEEKVQVSTAEKVIKILALIFFPIILIALAIRYFLHRKFDRKCFVIPQDTPKELELILAANPQLVEKAAREVHPGFFALPTKYQSMYIQTSKG

SEQ ID NO: 180 - protein, 544 aa, Chlamydia pneumoniae
TVELLSLNKSYFEIQRLRYRPEILTLLETIRSKHIQETSSPPSPPPELQKHIPNLCRIPEVSIYTEQETSSKPLKIGVLLSGGQAPGGHNVVIGLFDALRVFNPKTRLFGFIKGPLGLTRGLYKDLDISVIYDYYNMGGFDMLSSSREKIKTEEQKKNILNTVKQLKLDGLLIIGGNNSNTDTAMLAEYFLAHNCKTSVIGVPKTIDGDLKNCWIETSLGFHTSCRTYSEMIGNLAKDALSAKKYHHFIRLMGQQASYTTLECGLQTLPNIALISELIATRKISLKQLSEQLALGLVRRYKSGKNYSTVLIPEGLIEHIFDTRKLIDELNVLLANGDSSMKNSFQALSRDIKTFHLFPKDIANQLLLARDSHGNVRVSKIATEELLAVMVKKEIEKIKPHMEFHSVSHFFGYEARAGFPSNFDCNYGIALGIISALFLVRQKTGYMITINNLAQSYTEWQGGATPLYKMMHLENRCGTETPVIKTDSVDPKSPAVQHLLQQSDSCLVEDLYRFPGPLQYFGKEELIDQRPLTLLWENQTHSPLL

SEQ ID NO: 181 - protein, 275 aa, Chlamydia pneumoniae
LITGVVLEKHEQRTMFSLTLLNNFTTFGLLHTPLHYNPPYPIVILLHGLASDKTGSKRSHVRLAQELTRLGIAALRVDLLGHGDCEGELMDFSLENYKQNIREIIEYTHSLLHIDQERLAIFGSSLGGTLALQTLPFFNKIKALAVWAPTISGELMAAEAQKNAPEVITMSQKGAITYAGMTLNPDFYTQFLKIDIVKELMPSARNLPPILYMQGEQDLLVSINHRTLFTEAFANQDKPITILTYPDVDHAFPFAESSALSDLTQWLKRELTSGE

SEQ ID NO: 182 - protein, 242 aa, Chlamydia pneumoniae
  SITE 1...242: Xaa=unknown or other
FVYTLYNIQSPFRIMKLYSISSDVDTPWIFQLMSKVDSYLFLGGNRIKVVSIVMQEPNLIIGKVENVRISTIVKILKILSFLIFPLILIALALHYFLHAKYANHLLVSXILERAPQYVPIPGRSGXTASHYKLTTLVPVSQKNLQAMGSNPLXVEAALRTTKPSFFCVPAKYRQIIISSHGIRFSLDLEQLADDINLDSVSWPTEYLNSTMDFCSKADKRVIQNVQNLRTGTYINSVGKRSF

SEQ ID NO: 183 - protein, 188 aa, Chlamydia pneumoniae
FEKAIVYCIKCKQIIKCISIIHTPTPATPLCTEGEIFPGLVDSAIQNDLERLLTVKKRPDIIREYLRAGGSLVTTYPKEGQRLRSPEQLRVLDDLVQSYPNHLHAIELDCGAIPQDLIGATYIITFADFSTYILSLRSYQANSPSDDTWGIWFGSIDDPVQAVISFLKDHGFALPSTLAQDPLLCTNK

SEQ ID NO: 184 - protein, 185 aa, Chlamydia pneumoniae
  SITE 1...185: Xaa=unknown or other
LCFKCIYIKIIFSFLKQLMTRSTIESSDSLCSRSFSQKLSVQTLKNLCESRLMKITSLVIAFLTLIVGGALIALAGGGVLSFPLGLILGSVLVLFSSIYLVSCCKFFTLKEMTMTCSVKSKINIWFEKQRNKDIEKALENPDLXGENKRNVGNRSARNQLEMILHETDGIILKRYMKGAKMYFYL

SEQ ID NO: 185 - protein, 200 aa, Chlamydia pneumoniae
NVLLFMNWVPKTIDHVDPESEIDIRKVVSCYKLIKECQPEFRSLISELLGVIRCGLRLLKRSKYQEQARTVSDEDAPLFCLTRSYYQDGYLTPLRAGPRDLINHYIHLRRRENPKHFFSPKHPCYYARLAFNESVCVYRELFDIERLTKMYVEGDYSKEQEKNLQAILSFVKTLDEGKDFLIEHKDTDLIGRGFTDVFCT

SEQ ID NO: 186 - protein, 111 aa, Chlamydia pneumoniae
NLWSHFPRGFFMLPFCPTILLAKPFLNSENYGLERLAATVDSYFDLGQSQIVFLSKQDQGITVEELSAKDRKFKPGSMNCTLYTEDPILPAHNSFSNCSDIQMRTPISPIH

SEQ ID NO: 187 - protein, 276 aa, Chlamydia pneumoniae
SFHIEFTIGENNMKNVGSECSQPLVMELNTQPLRNLCESRLVKITSFVIALLALVGGITLTALAGAGILSFLPWLVLGIVLVVLCALFLLFSYKFCPIKELGVVYNTDSQIHQWFQKQRNKDLEKATENPELFGENRAEDNNRSARSQVKETLRDCDGNVLKKIYERNLDVLLFMNWVPKTMDDVDPVSEDSIRTVISCYKLIKACKPEFRSLISELLRAMQSGLGLLSRCSRYQERAKTVSHKDAPLFCPTHSYYRDGYLTPLRAGPRYIINRAI

SEQ ID NO: 188 - protein, 358 aa, Chlamydia pneumoniae
NVRKNHIIRGEKYNTCTVIAFVLSMSYDTLFKNLEKEDSVHKICNEIFALVPRLNTIACTEAIIKNLPKADIHVHLPGTITPQLAWILGVKNGFLKWSYNSWTNHRLLSPKNPHKQYSNIFRNFQDICHEKDPDLSVLQYNILNYDFNSFDRVMATVQGHRFPPGGIQNEEDLLLIFNNYLQQCLDDTIVYTEVQQNIRLAHVLYPSLPEKHARMKFYQILYRASQTFSKHGITLRFLNCFNKTFAPQINTQEPAQEAVQWLQEVDSTFPGLFVGIQSAGSESAPGACPKRLASGYRNAYDSGFGCAAHAGEGIETRTIFSSAKVNPEGLIEITRVTFSSLKRKQPSSLPIRVTCQLG

SEQ ID NO: 189 - protein, 429 aa, Chlamydia pneumoniae
LQSARRHLNTIFILDFGSQYTYVLAKQVRKLFVYCEVLPWNISVQCLKERAPLGIILSGGPHSVYENKAPHLDPEIYKLGIPILAICYGMQLMARDFGGTVSPGVGEFGYTPIHLYPCELFKHIVDCESLDTEIRMSHRDHVTTIPEGFNVIASTSQCSISGIENTKQRLYGLQFHPEVSDSTPTGNKILETFVQEICSAPTLWNPLYIQQDLVSKIQDTVIEVFDEVAQSLDVQWLAQGTIYSDVIESSRSGHASEVIKSHHNVGGLPKNLKLKLVEPLRYLFKDEVRILGEALGLSSYLLDRHPFPGPGLTIRVIGEILPEYLAILRRADLIFIEELRKAKLYDKISQAFALFLPIKSVSVKGDCRSYGYTIALRAVESTDFMTGRWAYLPCDVLSSCSSRIINEIPEVSRVVYDISDKPPATIEWE

SEQ ID NO: 190 - protein, 266 aa, Chlamydia pneumoniae
APIGAAIGIGPLGISRAHHLVEAGANVLVIDTAHAHSKGVFQTVLEIKSQFPQISLVVGNLVTAEAAVSLAEIGVDAVKVGIGPGSICTTRIVSGVGYPQITAITNVAKALKNSAVTVIADGRIRYSGDVVKALAAGADCVMLGSLLAGTDEAPGDIVSIDEKLFKRYRGMGSLGAMKQGSADRYFQTQGQKKLVPGGVEGLVAYKGSVHDVLYQILGGIRSGMGYVGAETLKDLKTKASFVRITESGRAESHIHNIYKVQPTLNY

SEQ ID NO: 191 - protein, 170 aa, Chlamydia pneumoniae
KIFIWFVEKIVILSMIMTTISNSPSPALNPELSLIPPPTLVSSGTQTSLAYTIPAQGRRSTLRIILDIFIIILGLATIISTFIVIFFLNGLNLLSTPSIISSSCLIIVGLLFLIMGLYFMISSLDQGLVGLLQKELSQAEEREEEYIQEIEALRGAPRAESPTESPSTWL

SEQ ID NO: 192 - protein, 140 aa, Chlamydia pneumoniae
LLLACFQFLLRRRDMEQPNCVIQDTTTVLYALNSFDPRLSDDTHRLGKQSPLEAENALGEFIEGLDTNSFPLEEVAIPILPGYHPKFYLSFIDRDDQGVHYEVLDGVFLKTVAACIIENSFLTDSMSPELLSEVKEALKR

SEQ ID NO: 193 - protein, 416 aa, Chlamydia pneumoniae
NDDDPMDESDGEEASKDSAFSASFSYEFVKSSTRESKNTVTHSTASRTLYILRQDCSYDPRALKVDDEFRYWVEKRLDAKNPDSLNAFVKEVGTHYVASVTYGGIGFQVLKMSYLQVEELEKEKISISVAAASSLLKSKTSNATEKGYSSYQSESSAQTVFLGGTVLPDLQQDKLDFKDWSESIPNEPIPLAISVSSITDLIIPELFPSEDAQVLSQKKSALGQVILNYLESHKPKEEGPKPVQITSGFNSSSSVFTLQAAKAPKTVSFPYIDYWSTIPYLFPTLKETSGAQPLSFYLRFDDIFEQQNLVHNTSYILASTSVRLGYFGDSYRDYDALSFYGSWPQAYFDWAGYKDRCTWTLEKLNTTGDLFIRSGDEIRLKHNTSGKYLATTSMSDGYQTLTCTTQTSDSVFIITV

SEQ ID NO: 194 - protein, 303 aa, Chlamydia pneumoniae
  SITE 1...303: Xaa=unknown or other
VGQKRANXSKFIFLISEESMKQPMSLIFSSVCLGLGLGSLSSCNQKPSWNYHNTSTSEEFFVHGNKSVSQLPHYPSAFRTTQIFSEEHNDPYVVAKTDEESRKIWREIHKNLKIKGSYIPISTYGSLMHPKSAALTLKTYRPHPIWINGYERSFNIDTGKYLKNGSRRRTSHDGPKNRAVLNLIKSSGRRCNAIGLEMTEEDFVIARRREGVYSLYPVEVCSYPQGNPFVIAYAWIADESACSKEVLPVKGYYSLVWESVSSSDSLNAFGDSFAEDYLRSTFLANGTSILCVHESYKKVPPQP

SEQ ID NO: 195 - protein, 88 aa, Chlamydia pneumoniae
VKEYLDFLVQRNVERDPQTKRHCTVSQKFGGESIDAKTTTGQLFHIAGKTEPGHGKLCLGESILKQLLALGIITGYENREREVWVYLD

SEQ ID NO: 196 - protein, 203 aa, Chlamydia pneumoniae
TSLHKILDCKYKPVFIQNTVASETYPSQILHAQREVRDAYFNQADCHPARANQILEAKKICLLDVYHTNHYSVFTFCVDNYPNLRFTFVSSKNNEMNGLSNPLDNVLVEAMVRRTHARNLLAACKIRNIEVPRVVGLDLRSGILISKLELKQPQFQSLTEDFVNHSTNQEEARVHQKHVLLISLILLCKQAALESFQEKKRSS

SEQ ID NO: 197 - protein, 454 aa, Chlamydia pneumoniae
MKKVLIANRGEIAVRIIRACHDLGLSTVAVYSLADQEALHVLLADEAICIGEPQAAKSYLKISNILAACEITGADAVHPGYGFLSENANFASICESCGLTFIGPSSESIAMMGDKIAAKSLAKKIKCPVIPGSEGIIEDESEGLKIAEKIGFPIVIKAVAGGGGRGIRIVKEKDEFYRAFSAARAEAEAGFNNPNVYIEKFIENPRHLEIQVIGDTHGNYVHLGERDCTIQRRRQKLIEETPSPILNAEIRVKVGKVAVDLARSAGYFSVGTVEFLLDKDKKFYFMEMNTRIQVEHTITEEVTGIDLVKEQIHVAMGNKLPWKQKNIEFSGHIIQCRINAEDPTNNFSPSPGRLDYYLPPAGPSIRVDGACYSGYAIPPYYDSMIAKVIAKGKNREEAIAIMKRALKEFHIGGVQSTIPFHQFMLDNPKFLESNYDINYIDNLLAQGNSFFKEF

SEQ ID NO: 198 - protein, 167 aa, Chlamydia pneumoniae
MDLKQIEKLMIAMGRNGMKRFAIKREGLELELERDTREGNRQEPVFYDSRLFSGFSQERPIPTDPKKDTIKETTTENSETSTTTSSGDFISSPLVGTFYGSPAPDSPSFVKPGDIVSEDTIVCIVEAMKVMNEVKAGMSGRVLEVLITNGDPVQFGSKLFRIAKDAS

SEQ ID NO: 199 - protein, 185 aa, Chlamydia pneumoniae
MVLSSQLSVGMFISTKDGLYKVTSVSKVAGPKGESFIKVALQAADSDVVIERNFKATQEVKEAQFETRTLEYLYLEDESYLFLDLGNYEKLFIPQEIMKDNFLFLKAGVTVSAMVYDNVVFSVELPHFLELMVSKTDFPGDSLSLSGGVKKALLETGIEVMVPPFVEIGDVIKIDTRTCEYIQRV

SEQ ID NO: 200 - protein, 229 aa, Chlamydia pneumoniae
VKKQESVLVGPSIMGADLTCLGVEAKKLEQAGSDFIHIDIMDGHFVPNLTFGPGIIAAINRSTDLFLEVHAMIYNPFEFIESFVRSGADRIIVHFEASEDIKELLSYIKKCGVQAGLAFSPDTSIEFLPSFLPFCDVVVLMSVYPGFTGQSFLPNTIEKIAFARHAIKTLGLKDSCLIEVDGGIDQQSAPLCRDAGADILVTASYLFEADSLAMEDKILLLRGENYGVK

SEQ ID NO: 201 - protein, 397 aa, Chlamydia pneumoniae
PIKDKILMSSPVNNTPSAPNIPIPAPTTPGIPTTKPRSSFIEKVIIVAKYILFAIAATSGALGTILGLSGALTPGIGIALLVIFFVSMVLLGLILKDSISGGEERRLREEVSRFTSENQRLTVITTTLETEVKDLKAAKDQLTLEIEAFRNENGNLKTTAEDLEEQVSKLSEQLEALERINQLIQANAGDAQEISSELKKLISGWDSKVVEQINTSIQALKVLLGQEWVQEAQTHVKAMQEQIQALQAEILGMHNQSTALQKSVENLLVQDQALTRVVGELLESENKLSQACSALRQEIEKLAQHETSLQQRIDAMLAQEQNLAEQVTALEKMKQEAQKAESEFIACVRDRTFGRRETPPPTTPVVEGDESQEEDEGGTPPVSQPSSPVDRATGDGQ

SEQ ID NO: 202 - protein, 118 aa, Chlamydia pneumoniae
FSLVNRETSSLSLRSSPPLIESLRIKPKSTIETKKITRRAIPIPGVSAPDRPRIVPSAPDVAAIANSMYLATMITFSMKLERGFVVGIPGVVGAGIGMFGAEGVLFTGDDIRILSLIG

SEQ ID NO: 203 - protein, 217 aa, Chlamydia pneumoniae
MHSKFLSRRKKNSSHKEETSWDCIASSYNKIVQDKGHYYHRETILPQLLPSLTLGSKSSVLDIGCGQGFLERALPKECRYLGIDISSRLIALAKKMRSVNSHQFKVADLSKRLEFVEPTLFSHAVAILSLQNMEFPGEAIRNTATLLEPLGQFFIVLNHPCFRIPRASSWHYDENKKSYLSSYRSLSLPNENPNHGSPRTKRFAFYPLLSLSSKLLV

SEQ ID NO: 204 - protein, 437 aa, Chlamydia pneumoniae
  SITE 1...437: Xaa=unknown or other
KTXNSCIMFRKLFPFSKKKTGQKQRLRNNGLLQAIIQSIKVLLHNEASKEACVLSYYGLLTCVPILVFFLRLSQHLFTNLNWKEWLIIKFPDYKKPIVAIVEAAYHATESNIGLVLVGSFFVFCWAGILMLLSLEDGLNKIFRTSWTPISLKRLVSYFVITLVSPMIFIIVCGSWIYITQIMPIQYAKLFSLSHSMTALYFISRFVPYLLLYLALFCCYAFLPRVAIQKTSALISTLIIGSVWIVFQKAFFSLQVSIFNYSFTYGALVALPSFLLLLYIYTMIYLFGGALTFIIQNRGCTFIFLGDKILPSCYLQLITSTYILALTTRQFNEGLSPLTAQFIAKQSKVPIGEVSQCLDVLEKEGFLFPYNNGYQPVFNFSELTIKDIADKLLHREIFKKFNPDLGITFIENSFQNIFNQASKNKENLTLSEIARRIK

SEQ ID NO: 205 - protein, 313 aa, Chlamydia pneumoniae
  SITE 1...313: Xaa=unknown or other
ANQMKRRSWLKILGICLGSSIVLGFLIFLPQLLSTESGKYLVFSLIHKESGLSCSAEELKISWFGRQTARKIKLTGEAKDEVXSAEKFELDGSLLRLLIYKKPKGITLSGWSLKINEPASIDHPSVSHLDPGSLLTYLNDCKIISEHGFITMKTVSGSSLSVSGXYLEXSSEKFMTKCVVSEDQQSGNIFIESVLSPDVSISAQFSSVPVAFFKIFIASPFWDHLLSYEDIINLSAEATHTNDGKISMTASGEGNQIQMKLQGHIHKSTFYIVEGSSSFIELKPELASALCNQIIPLSTPITSKQIXCYGLLC

SEQ ID NO: 206 - protein, 275 aa, Chlamydia pneumoniae
  SITE 1...275: Xaa=unknown or other
NLNLSSPQLFATRSFRCPHPLLVSKSXATVSYAKIPLDITKWKHIEITSQAQLPEVAIHPKDPNLALQLRDTKLGIKKTEKXSDIRYSSSTVLGGASPSHLNGLISIDNKKHLTKFRLQQAQLPHTYLRAIFPQPFVINVPLDVAYYSLNIEGTYKNAHLEADAILDNPLLKLSCSMSGAWKNFLFKGQGTYHFNKKWQEILSPHFSYAEARFSGKAQITDTNLFFPKFSGKITARENELLIHAKFGSPNEPIKPETTSILIHGQFCSLPTQPSF

SEQ ID NO: 207 - protein, 231 aa, Chlamydia pneumoniae
  SITE 1...231: Xaa=unknown or other
NLKLPLYSSTDNFVLCQLSLVSNHLAPFHLKKLTFSFHTDGGKFVTKGNLQALIENPDYPDLNNTRILIPDLLLSLDESSTSPSSKDLKIQGSGEIFSLPLDSITKTYGKQVRLSPYFGSSGDLNFVVNYNPKDQNKLTLLSXFKSEALLGELKLVMDFSMKLSSGTQGTLQWEVSPERYASFFKNASCSPTCLLHRTANVRLDISKLSCPEETKGLSCLTLLAAEDLKVH

SEQ ID NO: 208 - protein, 415 aa, Chlamydia pneumoniae
  SITE 1...415: Xaa=unknown or other
NCKCTLRHLKTLLSRGNQRFILSHASCRRGLEGSLEATPLIFYDNVSKETFIINDFXGSLRANNLDAKIEYDLKGSCLAPRQDSKTLAEFSLEGQVDHLFSPESREFKQTANWIHIPSSFIAGIIPMSPGLKAQISSLAGPRINVSIKNAFRFGEGPVDIMVDSENLQAQIPLILNEKSILLRENLTAHLSINEDVNKAFLQEFNPLLAGGAYSQYPVTLEIDKQNFYLPIRPYSFEEFRIQSATLDMGKISIANTGTMYALFQFLDITDQKQFVESWFTPIFFSVQKGSIICKRLDALIDRRIRLALWGKTDIAHDRLFMTLGIDPEVIKKYFHNTSLKTKNFFLIKIRGSISSPEVDWSSAYARIALLKSYSLGNPFSSLADKLFSSLGDSTPPPTVHPFPWEKSNFDSIENK

SEQ ID NO: 209 - protein, 458 aa, Chlamydia pneumoniae
LLGIKLMRKRHSFDSTSTKKEAVSKAIQKIIKIMETTDPSLNVETPNAEIESILQEIKEIKQKLSKQAEDLGLLEKYCSQETLSNLENTNASLKLSIGSVIEELASLKQLVEESIEESLGQQDQLIQSVLIEISDKFLSSIGETLSGNLDMNQNVIQGLLIKENPEKSEAASVGYVQTLLEPLSKRIGETHKKVATHDVNISSLQFHMMSVAGGRFRGHIDMNGYRVLGLGEPKNGEDAVSKDYLERYVSSQLTIDKVEDKPITKPNKGKLLYSQGTSPKLEGPLPLGLLTSGISGFTWKSASKSNDGSFPFSALRHKETESDTDCFQITSTTLSGNQAGTYTWSLSLKVLVPSIFQIEKPEVQLSLVYSYEDWLPIDNIFNMSQPRTIPLALLGQTMLAGQKYDILELAAHQTNQTLMISPNCSRFSLQLKQTNQFENSPVDFYIVHAAHSCHWSGF

SEQ ID NO: 210 - protein, 226 aa, Chlamydia pneumoniae
MTIRVRNLAYSVNKKKILDGVTFSLERGHITLFVGKSGSGKTMILRALAGLVQPTQGDIWIEGEAPALVFQQPELFSHMTVLGNCTHPQIHIKGRSTEEAREKAFELLHLLDIEEVAKNYPDQLSGGQKQRVAIVRSLCMDKHTLLFDEPTSALDPFATASFRHLLETLRDQELTVGLTTHDMQFVHSCLDRIYLIDQGTVAGVYDKRDGELDSGHPLSKYIHSAQ

SEQ ID NO: 211 - protein, 220 aa, Chlamydia pneumoniae
EVGVDHWLAIARLLLRGCGYTLCVSGIGILCGSILGLLIGTVTSLYFPSKLTKLLANSYVTVIRGTPLFIQILIIYFGLPEVLPIEPTPLVAGIIALSMNSAAYLAENIRGGINSLSIGQWESAMVLGYKKYQIFVYIIYPQVFKNILPSLTNEFVSLIKESSILMVVGVPELTKVTKDIVSRELNPMEMYLICAGLYFLMTTSFSCISRLSEKRRSYDN

SEQ ID NO: 212 - protein, 147 aa, Chlamydia pneumoniae
MKKKVTIDEALKEILRLEGAATQEELCAKLLAQGFATTQSSVSRWLRKIQAVKVAGERGARYSLPSSTEKTTTRHLVLSIRHNASLIVIRTVPGSASWIAALLDQGLKDEILGTLAGDDTIFVTPIDEGRLPLLMVSIANLLQVFLD

SEQ ID NO: 213 - protein, 344 aa, Chlamydia pneumoniae
MLTLGLESSCDETACAIVNEDKQILANIIASQDIHASYGGVVPELASRAHLHIFPQVINKALQQANLLIEDMDLIAVTQTPGLIGSLSVGVHFGKGIAIGAKKSLIGVNHVEAHLYAAYMAAQNVQFPALGLVVSGAHTAAFFIENPTSYKLIGKTRDDAIGETFDKVGRFLGLPYPAGPLIEKLALEGSEDSYPFSPAKVPNYDFSFSGLKTAVLYAIKGNNSSPRSPAPEISLEKQRDIAASFQKAACTTIAQKLPTIIKEFSCRSILIGGGVAINEYFRSAIQTACNLPVYFPPAKLCSDNAAMIAGLGGENFQKNSSIPEIRICARYQWESVSPFSLASP

SEQ ID NO: 214 - protein, 514 aa, Chlamydia pneumoniae
MRKISVGICITILLSLSVVLQGCKESSHSSTSRGELAINIRDEPRSLDPRQVRLLSEISLVKHIYEGLVQENNLSGNIEPALAEDYSLSSDGLTYTFKLKSAFWSNGDPLTAEDFIESWKQVATQEVSGIYAFALNPIKNVRKIQEGHLSIDHFGVHSPNESTLVVTLESPTSHFLKLLALPVFFPVHKSQRTLQSKSLPIASGAFYPKNIKQKQWIKLSKNPHYYNQSQVETKTITIHFIPDANTAAKLFNQGKLNWQGPPWGERIPQETLSNLQSKGHLHSFDVAGTSWLTFNINKFPLNNMKLREALASALDKEALVSTIFLGRAKTADHLLPTNIHSYPEHQKQEMAQRQAYAKKLFKEALEELQITAKDLEHLNLIFPVSSSASSLLVQLIREQWKESLGFAIPIVGKEFALLQADLSSGNFSLATGGWFADFADPMAFLTIFAYPSGVPPYAINHKDFLEILQNIEQEQDHQKRSELVSQASLYLETFHIIEPIYHDAFQFAMNKKLS

SEQ ID NO: 215 - protein, 494 aa, Chlamydia pneumoniae
KEMPRSLDPGKTRLIADQTLMRHLYEGLVEEHSQNGEIKPALAESYTISEDGTRYTFKIKNILWSNGDPLTAQDFVSSWKEILKEDASSVYLYAFLPIKNARAIFDDTESPENLGVRALDKRHLEIQLETPCAHFLHFLTLPIFFPVHETLRNYSTSFEEMPITCGAFRPVSLEKGLRLHLEKNPMYHNKSRVKLHKIIVQFISNANTAAILFKHKKLDWQGPPWGEPIPPEISASLHQDDQLFSLPGASTTWLLFNIQKKPWNNAKLRKALSLAIDKDMLTKVVYQGLAEPTDHILHPRLYPGTYPERKRQNERILEAQQLFEEALDELQMTREDLEKETLTFSTFSFSYGRICQMLREQWKKVLKFTIPIVGQEFFTIQKNFLEGNYSLTVNQWTAAFIDPMSYLMIFANPGGISPYHLQDSHFQTLLIKITQEHKKHLRNQLIIEALDYLEHCHILEPLCHPNLRIALNKNIKNFNLFVRRTSDFRFIEKL

SEQ ID NO: 216 - protein, 448 aa, Chlamydia pneumoniae
LKFDSKFIKVIFKMFSRWITLFLLFISLTGCSSYSSKHKQSLIIPIHDDPVAFSPEQAKRAMDLSIAQLLFDGLTRETHRESNDLELAIASRYTVSEDFCSYTFFIKDSALWSDGTPITSEDIRNAWEYAQENSPHIQIFQGLNFSTPSSNAITIHLDSPNPDFPKLLAFPAFAIFKPENPKLFSGPYTLVEYFPGHNIHLKKNPNYYDYHCVSINSIKLLIIPDIYTAIHLLNRGKVDWVGQPWHQGIPWELHKQSQYHYYTYPVEGAFWLCLNTKSPHLNDLQNRHRLATCIDKRSIIEEALQGTQQPAETLSRGAPQPNQYKKQKPLTPQEKLVLTYPSDILRCQRIAEILKEQWKAAGIDLILEGLEYHLFVNKRKVQDYAIATQTGVAYYPGANLISEEDKLLQNFEIIPIYYLSYDYLTQDFIEGVIYNASGAVDLKYTYFP

SEQ ID NO: 217 - protein, 534 aa, Chlamydia pneumoniae
  SITE 1...534: Xaa=unknown or other
QIEYYIMKMHRLKPTLKSLIPNLLFLLLTLSSCSKQKQEPLGKHLVIAMSHDLADLDPRNAYLSRDASLAKALYEGLTRETDQGIALALAESYTLSKDHKVYTFKLRPSVWSDGTPLTAYDFEKSIKQLYFEEFSPSIHTLLGVIKNSSAIHNAQKSLETLGIQAKDDLTLVITLEQPFPYFLTLIARPVFSPVHHTLRESYKKGTPPSTYISNGPFVLKKHXHQNYLILEKNPHYYDHESVKLDRVTLKIIPDASTATKLFKSKSIDWIGSPWSAPISNEDQKVLSQEKILTYSVSSTTLLIYNLQKPLIQNKALRKAIAHAIDRKSILRLVPSGQEAVTLVPPNLSQLNLQKEISTEERQTKARAYFQEAKETLSEKELAELSILYPIDSSNSSIIAQEIQRQLKDTLGLKIKIQGMEYHCFLKKRRQGDFFIATGGWIAEYVSPVAFLSILGNPRDLTQWRNSDYEKTLEKLYLPHAYKENLKRAEMIIEEETPIIPLYHGKYIYAIHPKIQNTFGSLLGHTDLKNIDILS

SEQ ID NO: 218 - protein, 296 aa, Chlamydia pneumoniae
LSLVFSYIKNRILFNLLSLWIVLTLTFLVMKTIPGDPFNDEGCNVLSEEVLQTLKSRYGLDKPLYQQYTQYLHSIAKLDFGNSLVYKDRKVTNIISTAFPISAILGLQSLFLSIGGGIALGTIAALKKKKQRRYILGASILQISIPAFIFATLLQYVFAVKIPLLPIACWGSFTHTILPTLALAVTPMAFIIQLTYSSVSAALNKDYVLLAYAKGLSPLKVVIKHILPYAIFPTISYSAFLTTTVITGTFAIENIFCIPGLGKWFICSIKQRDYPVALGLSVFYGTYLCSLLYFLT

SEQ ID NO: 219 - protein, 284 aa, Chlamydia pneumoniae
MDNYLLNIKDLTITSTNPKRTLIENLSLQLKENRNLALVGESGSGKTTITKAILGFLPENCLIKTGSILFEDIDITKLSPKELHKIRGQKIATILQNAMGSLTPSMRIGMQIIETLRQHHKMNKEEAYNKAMQLLTDVCIPNPKYSFSQYPFELSGGMRQRVVIAIALASQPKLILADEPTTALDSMSQAQVLRILRNIQQQKQATILLVTHNLSLVKELCNDICIIKDGKLIETGTVEEIFLSPKHPYTLKLLNAVSKIPIKKTSSPILKNKFQPLMSMQGGL

SEQ ID NO: 220 - protein, 293 aa, Chlamydia pneumoniae
  SITE 1...293: Xaa=unknown or other
VPTSNEYARWFMTTLLSIKDLSLTIRGKKILNHINLNLIKGSYLTIVGPSGSGKSSLALTILDLLKPTTGTITFHMDPKIPRARKVQVIWQDIDSSLNPCMSIKGIISEPLNIIGTYSKAEQNKEIYNVLDLVNLPKSVLHLKPYKLSGGQKQRIAIAKALVSKPELLICDEPLSSLDTLNQSLILDLFQTIKKEYQNTLLFITHDMSAAYYIADTIAVMDQGSLVEHACREKIFSTPKHTTTQDLLDAIPIFSLISTEMEPSEEYELQVASKXIDLEITNSYRKIRIFDVSQ

SEQ ID NO: 221 - protein, 279 aa, Chlamydia pneumoniae
IVPLPQKNNKETSCMNTYTFSPTLQKSFSLFLLEKLDSYFFFGGTRTQILVITPTNIRLAAKKRGCKVSTIEKIIKILSFILLPLVIIAFILRYFLHKKFDKQFLCIPKVISNEDEALLGSRPQAVEKAVREISPAFFSIPRKYQLIRIDTPKDDAPSILFPIGIEIILKDLCIDTLKQSNLFLKREMDFLGHPEEKALFDSICSIEKDQEWMSLESKKLLITHFLKYLFVSGIEQLNPGFNPENGRGYFSEISTAKIHFHQHGRYGPIRSSGPIMKEI

SEQ ID NO: 222 - protein, 272 aa, Chlamydia pneumoniae
  SITE 1...272: Xaa=unknown or other
IVDRRSPACYDSINSDAIGVSLLMDISHILEDLAYDEGILPREAIEAAIVKQMQITPYLLHILHDATQRVPEIVNDGSYQGHLYAMYLLAQFRESRALPLIIKLFAFEDDTPHAIAGDVLTEDLPRILASVCNDDSLIKELIETPKINPYVKAAAISGLVTLVGAGKIPRDKVIRXFAELLNYRLEKQPSFAWDNLIAGICTLYPGELFYPISKAFDGGLVDTSFISMEDVENIIHEETVESCIHTLCSSTELINDTLEEMEKWLEDFPIEP

SEQ ID NO: 223 - protein, 246 aa, Chlamydia pneumoniae
VNKKKRFLSLLFLTAVLLGIWFSPHPASINSNAWQLFAIFTTTIMGIIFQPVPMGAIAIIGISTLLLTQTLTLEQGLSGFHNPIAWLVFLSFSIAKGIIKTGLGERIAYFFVSALGKSPLGLSYGLVITDFFLAPAIPSVTARAGGILYPVVTSLSDSFGSSAEKGTQDLIGSFLIKVAYQSSVITSAMFLTAMAGNPLVAALAGHVGVSLSWVLWAKAAIIPGLLSLFLMPIILYKLYPPKNHIL

SEQ ID NO: 224 - protein, 123 aa, Chlamydia pneumoniae
LSPRGLFPKALTKKYAIRSPSPVFMIPFAIEKERKTNHAIGLWNPDNPCSRVNVCVSSSVEIPIMAIAPMGTGWKMIPMIVVVNIAKSCQALEFIDAGWGENQMPKSTAVRKRRDKKRFFLFT

SEQ ID NO: 225 - protein, 550 aa, Chlamydia pneumoniae
MHPLYVDLDTIISSYSPPLPKEFQEAASLIAVPDTSHSKPVVPGVKTLFPQTYHLPYLKFVQGENVVHTPLKVGVMFSGGPAPGGHNVIQGLFNSLKDFHPDSSLVGFVNNGDGLTNNKSIDITEEFLSKFRNSGGFNCIGTGRKKIVTPEAKEACLKTAEALDLDGLVIIGGDGSNTATAILAEYFAKRRPKTSIVGVPKTIDGDLQHTFLDLAFGFDTATKFYSSIISNISRDALSCKAHYHFIKLMGRSASHIALECALQTHPNIALIGEEIAEKNLPLKTIIHKICSVIADRAAMEKYYGVILIPEGIIEFIPEIINLITEIESLSEYEDKISRLSPESQRLLKSFPAPIIEQILNDRDAHGNVYVSKISVDKLLIHLVSNHLQQYFPNVPFNAISHFLGYEGRSGLPTKFDNTYGYSLGYGAGILVRNHCNGYLSTIESLACPFMKWKLRAIPVVKMFTVKQQADGTLQPKIKKYLVDIGSTAFRKFKLYRKIWALEDSYRFLGPLQIETPPEMHSDNFPPLTLLLNHNFWQRHQGCIEIPDTTY

SEQ ID NO: 226 - protein, 322 aa, Chlamydia pneumoniae
  SITE 1...322: Xaa=unknown or other
YQKLWEREREYFKTIREKEHATISTMLVELEALKREFAHLKDQKPTSDQEITSLYQCLDHLEFVLLGLGQDKFLKATEDEDVLFESQKAIDAWNALLTKARDVLGLGDIGAIYQTIEFLGAYLSKVNRRAFCIASEIHFLKTAIRDLNAYYLLDFRWPLCKIEEFVDWGNDCVEIAKRKLCTFEKETKELNESLLREEHAMEKCSIQDLQRKLSDIIIELHDVSLFCFSKTPSQEEYQKDCLYQSRLRYLLLLYEYTLLCKTSTDFQEQARAKEEFIREKFSLLELEKGIKQTKELEFAIAKSKLERGCLVMRKYEXPLNIV

SEQ ID NO: 227 - protein, 101 aa, Chlamydia pneumoniae
ECVMSYPDISNVQASSIQSALLHKTSDQIQQKRCFKQSTFVILAVSLVIIGSLFLLAGVAILTVFSHGVLSLVFGVLGIVLGLLLLAGGVGLLVEEAKSLL

SEQ ID NO: 228 - protein, 398 aa, Chlamydia pneumoniae
ELSYGVVVSIYSEILSFSELTSCKHSLFPFGPIETASIRIHHVFNVVIVCLIILGTLFVCLGMVFLGVFSTYLLGMSSMILGLLLISIGLALLKFKERYGLEPKELFGVEGGFDKKLPSEIIQMQDQIADLARELDLEQKKDTLIRGFSARLDVLEGSKTEKKQILKIGVPRNLSEIQERAQEQNSILEQCKEALLFRRKSAQEIFKKLYDRKAAFWRSYREDLWCYSEIHVSKKALSNLYIGDVFEGTAPHFLMEAYAMCRTAKNLRNYVKVCVEDMRVNEEKKRAKQLSVSELLCCCTEIETDLENETNLFTSDSEDVLEEYQIHCIRVTMLHALWAIYNDEVVSRKPIDTLDRVRARMAVEDCIETFEELQMCVVHTKTLELEIAQLYVDILLEA

SEQ ID NO: 229 - protein, 413 aa, Chlamydia pneumoniae
  SITE 1...413: Xaa=unknown or other
RMYFSHVSTVVVVALFILGIFFLSGSLAFLVHTSCGVLLGAALPILCIGLVLLAVALIVFLCHKHKTRQDLDYYDQDLDSLVIHKKEIPNDISELRVTFEKLQNLFQFHTKDFSDLSQELQGKFINCMEKWLTLEDEVTKFLIVRDRFLETRRNFTTFGEQVKGIQSNIFDLHEEKSSLYLELYRLRKDLQVLLNFFLLPPGILKVDYDEIEAIKGLFIRLTSRLDKLDVKAQERKKFINEMSREFKEVEKAFDIVDRATKKLMDRAKKESPARLFMGRTESLLEMKKNEEALKNQGLDPENLSHPELFSPYQQLLILNYLNSEIVLHHYEFLISGTVTSGLTLEECENRMRAASTGLNALLVRKLQFRGAIKSAYFEKLTEIEKELRSLQDVIXSLELELIHKIKDIVTEET

SEQ ID NO: 230 - protein, 193 aa, Chlamydia pneumoniae
ICFKRRKDRTGMLSRQKESRETGGVSRSYRRELLEVLKTRLSVEKEIQLFEEVVSAFEEKLASLHRTVFSEEELQEALDKAKAELLDIQVRKSVVEDLSCEPTLIQYHLLRLYEVQCRIVEQFLTQTFSSEQEKVLEEYEALKARIRKTLRVKLDQVRANVAFVASTTDLLSESESLDGNDSVFEDAHDDFLD

SEQ ID NO: 231 - protein, 267 aa, Chlamydia pneumoniae
LTSSKKQVMSSAIARDCFPSPSPQPSSTLGVHPPKYKSLILSVSLIVLGVLLLCVGMLLLVNAIFSFSVLTVGLGGAGVFLGSLLLILGLIFFVSYHRKLSEATRSLEQKITLEYQPWADLRKELNEVQEWSNFLLDEWEDFKEVVAQHKSQFATFEGDLLLFGREVEKYETIWKELDGRDVALLTELKNIWGPLEFLRKKGDRLQCEIDKLRKEVMKVGKSGLKLACELTKFKSALKDVKIEQECYRDKRKVEKLEVFPEVIGGNY

SEQ ID NO: 232 - protein, 150 aa, Chlamydia pneumoniae
NKARTMNPVTFDRIQVDFIPEDTSLRINSYIVAGGLLILGVVLSILSVICLDIGLVGLSAGAAFTLGLGCLIFALFLFSFSLILLLSQEKRVPDVLSLYLEKEVPQYETPLYKEDLESERDMSAISERLGIIEEKLRIAEKFRYSDSVFV

SEQ ID NO: 233 - protein, 375 aa, Chlamydia pneumoniae
GSSLALKFHLIHQSKKSQARVGQIETSHGVIDTPAFVPVATHGALKGVIDHSDIPLLFCNTYHLLLHPGPEAVAKLGGLHQFMGRQAPIITDSGGFQIFSLAYGSVAEEIKSCGKKKGMSSLVKITDEGAWFKSYRDGRKLFLSPELSVQAQKDLGADIIIPLDELLPFHTDQEYFLTSCSRTYVWEKRSLEYHRKDPRHQSMYGVIHGGLDPEQRRIGVRFVEDEPFDGSAIGGSLGRNLQEMSEVVKITTSFLSKERPVHLLGIGDLPSIYAMVGFGIDSFDSSYPTKAARHGLILSKAGPIKIGQQKYSQDSSTIDPSCSCLTCLSGISRAYLRHLFKVREPNAAIWASIHNLHHMQQVMKEIREAILKDEI

SEQ ID NO: 234 - protein, 123 aa, Chlamydia pneumoniae
GEKFLKPWEKLRELNAFELTQPEEYRNRWVLMPCLKCRFCRTQHAKVWSYRCVHEASLYEKNCFLTLTYDDKHLPQYGSLVKLHLQLFLKRLRKMISPHKIRYFECGAYGTKLQRPHYHLLLS

SEQ ID NO: 235 - protein, 128 aa, Chlamydia pneumoniae
STMLIGRYSSDDQFTEATKNTPTIIKLGFVRDNLEGLTNPISEIVSETSSSIKDSVLRSLPILGSILGCARLYSTLSTNDPLDETQEKIWHTIFGALETLGLGILILLFKIIFVILHCIFHLVIGFCK

SEQ ID NO: 236 - protein, 91 aa, Chlamydia pneumoniae
YTFKNPKKNKKMKPNSIIFLENTKHYPDIFREGFVRDRHGLMEASDWLLSTEITIIRSILGAIPILGNILGAGRLYSVWYTSDEDWKKQVV

SEQ ID NO: 237 - protein, 100 aa, Chlamydia pneumoniae
RGMLPAWVTPGFLTKLAEGLKINSGRSVNPKGLEQCIASGQYNEQIKKNNLYGSQVLGGQLATPTAVVGDYLIEDPTFHEIERAIQHIRQLQAVEGDHDD

SEQ ID NO: 238 - protein, 140 aa, Chlamydia pneumoniae
  SITE 1...140: Xaa=unknown or other
QILFTSPLNKKXLVLCTAMFFIVCFGFLIHKKHTILPPKAHIPTNAKHFPTIGNPYAPINITVFEEPSCSACAEFTTEVFPLLKKHYIDTGEISFTLIPVCFIRGSKPAAQALLCIYHHDSTSGRYRRLYGIFPSYFDLS

SEQ ID NO: 239 - protein, 154 aa, Chlamydia pneumoniae
LFTYFLSYCFPNQTFSSLVRSPTRHLGYPFRLRCRRSPTIFANDTLIGFAILAVVCISPTRPEALEVGPTLPEGFSYNPSAGGRRAAVLFLSLLGWLEARYLTASSLGITSSQSSNFLLLYSSIMTVYSLLVVLSLAGSERRWHTRPKIVIATA

SEQ ID NO: 240 - protein, 94 aa, Chlamydia pneumoniae
LLAMLCLTIEPALAVVFAYDETRATLRYISQFLGDKRALTRASFFGSEYYKHTLSWEERTVRPLRKAYKQAFEGISFPINQLLAILVASFCKSQ

SEQ ID NO: 241 - protein, 234 aa, Chlamydia pneumoniae
RFKKALIYMSSQPLVTTSSSLSRYVVLTGEEKVACYKKAFNHIWHGAPAIILAAALLMFCIFGFVLGSILLGAPLEGASILYDVILPWLLPSILVFVLLVLPLNIYAYSHHKQVLALHERITQSNYKEIYDHCEKEKKTPNKKALSLYIESQVLVPEYSKRFSSMILGKTLKIIPKKDSPESLKHDELIQKALERAKENIYMNKNQREKRDEREAKKEAKNASKTNPLWEGLGT

SEQ ID NO: 242 - protein, 235 aa, Chlamydia pneumoniae
MLQAHRLCYSCDNQVILKDASFQASPGTITIILGSSGVGKTTLFRLLAGFLPLQEGELLWNGSPLNRKDVAYMQQKEALLPWRTALKNMTLSTELGINTSHNALSNERLEEIIHNFDLGQLLDRYPDELSGGQRQRIALAAQCLSLKPILLLDEPFSSLDVLLKEQLYQDIVALAKKENKTVLLVTHDFHDVSCLGDVLYVIKNKTLTPVPLDPSMRPLNNGLCFIKDLKKHLYT

SEQ ID NO: 243 - protein, 301 aa, Chlamydia pneumoniae
KKFLMRRFLFLILSSLPLVAFSADNFTILEEKQSPLSRVSIIFALPGVTPVSFDGNCSIPWFSHSKKTLEGQRIYYSGDSFGKYFVVSALWPNKVSSAVVACNMILKHRVDLILIIGSCYSRSQDSRFGSVLVSKGYINYDADVRPFFERFEIPDIKKSVFATSEVHREAILRGGEEFISTHKQEIEELLKTHGYLKSTTKTEHTLMEGLVATGESFAMSRNYFLSLQKLYPEIHGFDSVSGAVSQVCYEYSIPCLGVNILLPHPLESRSNEDWKHLQSEASKIYMDTLLKSVLKELCSSH

SEQ ID NO: 244 - protein, 233 aa, Chlamydia pneumoniae
FIMLQSCKKALLSIVVSILAFHPIPGMGVEAKSGFLGKVKGWFSKKEIQEEARILPVKDSLSWKRYDYTSSSGFSVEFPGEPDHSGQIVEVPQSEITIRYDTYVTETHPDNTVYVVSVWEYPEKVDISRPELNLQEGFSGMMQALPESQVLFMQARQIQGHKALEFWIVCEDVYFRGMLISVNHTLYQVFMVYKNKNPQALDKEYEAFSQSFKITKIREPRTIPSSVKKKVSL

SEQ ID NO: 245 - protein, 210 aa, Chlamydia pneumoniae
  SITE 1...210: Xaa=unknown or other
VFVRYLLMKPEESECLCIGVLPARWNSSRYPGKPLAKIHGKSLIQRTYENASQSSLLDKIVVATDDQHIIDHVTDFGGYAVMTSPTCSNGTERTGEVARKYFPKAEIIVNIQGDEPCLNSEVVDALVQKLRSSPEAELVTPVALTTDREEILTEKKVKCVFDSEGRALYFSRSPIPFILKKATPVYLHIGVYAFKREALFRYLTAXLXSS

SEQ ID NO: 246 - protein, 537 aa, Chlamydia pneumoniae
MPFKCIFLTGGVVSSLGKGLTAASLALILERQRLNVAMLKLDPYLNVDPGTMNPFEHGEIYVTDDGVETDLDLGHYHRFSSAALSRHSSATSGQIYARVIKREREGDYLGSTVQVIPHITNEIIQVILDAAKEHSPDVLIVEIGGTIGDIESLPFLEAIRQFRYDHSEDCLNIHMTYVPYLQAADEVKSKPTQHSVQTLRGIGIIPDAILCRSEKPLTQEVKSKISLFCNVPNRAVFNVIDVKHTIYEMPLMLAQEKIANFIGEKLKLATVPENLDDWRVLVNQLSQDLPKVKIGVVGKYVQHRDAYKSIFEALTHAALRLGHAAEIIPIDAEDENLTMELSQCDACLVPGGFGVRGWEGKIAAAKFCREQGIPYFGICLGMQVLVVEYARNVLNLDQANSLEMDPNTPHPIVYVMEGQDPLVATGGTMRLGAYPCLLKPGSKAHKAYNESSLIQERHRHRYEVNPDYIQSLEDHGLRIVGTCPPQGLCEIIEVSDHPWMIGVQFHPEFVSKLISPHPLFIAFIEAALVYSKDASHV

SEQ ID NO: 247 - protein, 154 aa, Chlamydia pneumoniae
MQAMSKPSSCKAYLGIDYGKKRIGLAYAAEPLLLTLPIGNIEAGKNLKLSAEALHKIILSRNITCVVLGNPLPMQKGLYSSLQEEVSLLAEELKKLSTVEIILWDERLSSVQAERMLKQDCGLSRKDRKGKTDSLAATLILTSFLDSLPKKLTL

SEQ ID NO: 248 - protein, 390 aa, Chlamydia pneumoniae
  SITE 1...390: Xaa=unknown or other
MTNVVQETIGGLNSPRTCPPCILVIFGATGDLTARKLLPALYHLTKEGRLSDQFVCVGFARREKSNELFRQEMKQAVIQFSPSELDIKVWEDFQQRLFYHRSEFDNNMGYTSLKDSLEDLDKTYGTRGNRLFYLSTPPQYFSRIIENLNKHKLFYKNQDQGKPWSRVIIEKPFGRDLDSAKQLQQCINENLNENSVYHIDHYLGKETVQNILTTRFANTIFESCWNSQYIDHVQISLSETIGIGSRGNFFEKSGMLRDMVQNHMMQLLCLLTMEPPTTFDADEIRKXKIKILQRISPFSEGSSIVRGQYGPGTVQGVSVLGYREEENVDKDSRVETYVALKQSLIIPVGLEFLSIYVQENDSPKNLQTFLLFLKNHPTIYLQPKNVHVVR

SEQ ID NO: 249 - protein, 132 aa, Chlamydia pneumoniae
QRFPSRDLRSFKTVINNPRWLGVPFYLRAGKRLAKKSTDISIIFKKSPYNLFAAEECSRCPIENDLLIIRIQPDEGVALKFNCKVPGTNNIVRPVKMDFRYDSYFQTTTPEAYERLLCDCIIGDRTFIYGGG

SEQ ID NO: 250 - protein, 266 aa, Chlamydia pneumoniae
MTNIGIETMATLINFNDTNKLLLTKQPSLFIDLASKDWIASANQAIKQRGAFYVALSGGKTPLEIYKDIVINKDKLIDPSKIFLFWGDERLAPITSSESNYGQAMSILRDLNIPDEQIFRMETENPDGAKKYQELIENKIPDASFDMIMLGLGEDGHTLSLFSNTSALEEENDLVVFNSVPHLETERMTLTFPCVHKGKHVVVYVQGENKKPILKSVFFSEGREEKLYPIERVGRDRSPLFWIISPESYDIADFDNISSIYKMDIL

SEQ ID NO: 251 - protein, 194 aa, Chlamydia pneumoniae
LNSFFSFNSLNSWHCLSIIFCSSWSCSRNYCGNDGVCAAGGGALLISLLGLWIAIVRKAKHQEACVGHLTNVVLHTAVSEALLHDPSHFQTNALARDLFLTDCLSHYGHLFSNEEVAQLVQGGAPGGGSRPSQHYGGSSDYQNRRGGNGNFGGSHFGGGGGFAGSHFGAGYPTAPTMPSAPPPFPPPAYDTIYG

SEQ ID NO: 252 - protein, 167 aa, Chlamydia pneumoniae
  SITE 1...167: Xaa=unknown or other
XAQNLGNLFNSFGILIMCFSQCKSCQTPEKETSAIVLGATLLFFVIALILGPTLGALVYCAYKVYTLGKMIYSLNKAKAKVLRHPAQNVFHRAAGVATIRSSEEAVKACKLYKSAMIGSLVVSLIASLALIALTAGIVLVLFFVAPGAAPVITAAMMGSALQVEALC

SEQ ID NO: 253 - protein, 106 aa, Chlamydia pneumoniae
KLAIIRRRRRRGKRRIRRVYRRIGRWRFSRNHVAATIAPLLMKQSLVTWRWRRLTVQGDFALDISILVITEELLVSSYRLSKHFFSSWSDRKVGHLNNCVTHYTTQ

SEQ ID NO: 254 - protein, 390 aa, Chlamydia pneumoniae
IFLVKFMSAMISLSSSHEASIASNTQVRDVLVSLAMDEFVEHNTEILPIKVFLARGTLSSTAIIDDLKDVVETEGEHHFQVYSNISLKMIYQRFFEKIFGIGCCPLLLVTDSHHTDPCGALITGIFAAVLFTVLAIVFGPTLGILCYSAYKIYQLTKKISSLSRTHTEVINSVQKSDPFIHRSGAVAAAAASQSTIKACKVFRQSTLIFFVLGLIITISLAALIVGLVFALFFLDPGAPAVMTAAMIGCCAAGGTGILLSVIGFLLASVYSVQKSQEGVHHMHTALLRCIVSNTIIQMPYLPITPGTKKVLTQSIRRYQQFFSDDEYRDIESEVPLNRQTTPPPSYETLFHEEGSDGSSNVIPRESPPAYSTIDSSNSPFPSSSPPPYYR

SEQ ID NO: 255 - protein, 125 aa, Chlamydia pneumoniae
TPSWLFCTLYTEASKKPITERRIPVPPAAQHPIIAAVITAGAPGSKKNRAKTRPTIKAAKDIVIIKPSTKKINVDCLNTLQALIVDCEAAAAATAPERCIKGSDFCTEFMTSVWVLDKEDIFLVS

SEQ ID NO: 256 - protein, 95 aa, Chlamydia pneumoniae
RHLKCDPRLTLSPGKALDALHNLNGNERSRNRTFKINKTTLTTAQTTAITGYNIVSTTKQAVFLTQGFIIIISLRHSKKNRTSHKNNRWFLRKLI

SEQ ID NO: 257 - protein, 291 aa, Chlamydia pneumoniae
TCQKEIMKHYLSFSPSADFFSKQGAIETQVLFGERVLVKGSTCYAYSQLFHNELLWKPYPGHSFRSTLVPCTPEFHIHPNVSVVSVDAFLDPWGIPLPFGTLLHVNSQNTVIFPKDILNHMNTIWGSGTPQCDPRHLRRLNYNFFAELLIKDADLLLNFPYVWGGRSVHESLEKPGVDCSGFINILYQAQGYNVPRNAADQYADCHWISSFENLPSGGLIFLYPKEEKRISHVMLKQDSSTLIHASGGGKKVEYFILEQDGKFLDSTYLFFRNNQRGRAFFGIPRKRKAFL

SEQ ID NO: 258 - protein, 168 aa, Chlamydia pneumoniae
VVAKSTIQESVATGRRKQAVSSVRLRPGSGKIDVNGKSFEDYFPLEIQRTTILSPLKKITEDQSQYDLIIRVSGGGIQGQVIATRLGLARALLKENEENRQDLKSCGFLLEILEGKNVKNTDIKKLVKASNSLSVKIFTVFRIVFGKSLSYYRKAFLFLGIPKNARPL

SEQ ID NO: 259 - protein, 149 aa, Chlamydia pneumoniae
MEKRKDTKTTIVKSSETTKSWYVVDAAGKTLGRLSSEVAKILRGKHKVTYTPHVAMGDGVIVINAEKVRLTGAKKGQKIYRYYTGYISGMREIPFENMMARKPNYIIEHAIKGMMPRTRLGKKQLKSLRIVKGDSYETFESQKPILLDI

SEQ ID NO: 260 - protein, 226 aa, Chlamydia pneumoniae
MSLLIEAKNLSKTIQQQNQNISILTDVSLSLHAGETISITGASGNGKTTLLHLLGTLDVPSSGSLRFFDKDLKNQDLANFRNQHIGFVFQNFYLLEDDTVLKNVLMPALIARKNISKGSPVYTRALELLDLVNLEDKVRTRCSKLSGGEKQRVAIARALINEPAILLADEPSGNLDEETSEQIHNLLLEQASALCGILIVTHNKHLASRCSREGVLSNGKLFFHNS

SEQ ID NO: 261 - protein, 506 aa, Chlamydia pneumoniae
LEVMKFEFSVALKYLIPGRGRLYSAIVSLFSVGIISLVVWLSIVFISVIHGLEQRWIEDLSQLHSPITILPSDTYYSSYYYQIDKHSSLSNYTTKTLGEKIASPQVDPYDPESDYLLPETFPLKDCDLGGQQKDPVKMTLESLGPYLQSQHGKVIEFEQGVGYLDIKTSLKLQKPQPRNLTHFLTYPSKLSYEDKVLPYDETDYTSAELNPFNRSPSGWQQDFHHLEELYRGASIILPSTYKDSGYKVGDTGVFSTYSIENEKETQYTVHVIGFYNPGLSPLGGRTVFIDPDLARSIRSQSEGLGMSNGFHLFFPNTKRIVFVKKQIENILTSLGVDDYWEISSLHDYDYFQPILDQLQSDQVLFLFVCILILIVACSNIVTMSMLLVNNKKKEIGILKAMGTSSRSLKIIFACCGAFSGACGVVIGTIFAIITLKNLQFIVKALNYLQGRETFNTAFFGQNLPNSVHPQAIYFLGLGTLLLAAVSGALPARKVAKMHVSEILKAD

SEQ ID NO: 262 - protein, 84 aa, Chlamydia pneumoniae
FSAFTMNCKFFNVIIANIVPITTPQAPENAPQQAKMIFKLRDDVPIALRMPISFFLLFTRSIDIVTMLEQATIRISMHTKRKRT

SEQ ID NO: 263 - protein, 503 aa, Chlamydia pneumoniae
LPWMSPFKKIVNRLLCYISFQKESRTLPIIIREPRMTTKSLGSFNSVISKNKIHFISLGCSRNLVDSEVMLGILLKAGYESTNEIEDADYLILNTCAFLKSARDEAKDYLDHLIDVKKENAKIIVTGCMTSNHKDELKPWMSHIHYLLGSGDVENILSAIESRESGEKISAKSYIEMGEVPRQLSTPKHYAYLKVAEGCRKRCAFCIIPSIKGKLRSKPLDQILKEFRILVNKSVKEIILIAQDLGDYGKDLSTDRSSQLESLLHELLKEPGDYWLRMLYLYPDEVSDGIIDLMQSNPKLLPYVDIPLQHINDRILKQMRRTTSREQILGFLEKLRAKVPQVYIRSSVIVGFPGETQEEFQELADFIGEGWIDNLGIFLYSQEANTPAAELPDQIPEKVKESRLKILSQIQKRNVDKHNQKLIGEKIEAVIDNYHPETNLLLTARFYGQAPEVDPCIIVNEAKLVSHFGERCFIEITGTAGYDLVGRVVKKSQNQALLKTSKA

SEQ ID NO: 264 - protein, 179 aa, Chlamydia pneumoniae
ATSTVCALWILQTYQSHDDAASCSFRRACRFGRYWLGGVNVPWNKFNQTSTQSTVINSAIYIDSSQTWMMRFQASASIPRLFRISIFMTKHGDWIDNGTGGELLLVAYEANQNPLFPDIRIELAMSTCSGTSYYRARPMQWLCSTYYAVRPGYFVLENRSYSFRVQSFSWNIATLPFVN

SEQ ID NO: 265 - protein, 175 aa, Chlamydia pneumoniae
FCGGRLMSSSIPTTQKITISIPTFVRFNIESINLTDEQKKTALTIGQNIATENTQVLGNFVDADGGLICQNDLSVGGNINITPQTFNTMVFNGRVNLSNSPFSYQDSLGNKRQDYANINTEQPQQYVPYGYYKLTRVMMMQRAALSGGHVGSGDIGWGESMYLGISSIKRQHKVQ

SEQ ID NO: 266 - protein, 264 aa, Chlamydia pneumoniae
IPMKTLGVKDQNLFIDQATLSVERNVRIENNLETRDLKVLDTTTSPCEFIVKGNVSAEGSQLNATTLSDGFNIYSKTDVSQTPVCNNISDPQSARDALTFSYYRKTGCQAANLYTYYPGNGYYVAPNTTIETHVAAITSKSVSRNATPDFSRYADIEPVVKLKQVGIYQVTMQLTRWSGQHDGDNSATLILNFVSGNNKTLLCTSDTRGGYSSDRTSVAVTAIFSVTELVSSPPYDYPWINLESTIWMNLMSLSTCGHLVSISI

SEQ ID NO: 267 - protein, 285 aa, Chlamydia pneumoniae
TLLKVIMKNNINNNECYFKLDSTVDGDLLAANLKTFDTQAQGISSTETFSVQGNATFKDQVSATGLTSGTTYNLNAQNFTSSQISIDFKNNRLSNCALPKEDCDPVPANYVRSPEYFFCSKPLIGDFDFNSGESYLPLTGSEYTLYQSRNVNSIFRFIGWKQSTRELTVGGNTAIQFLAAGTYIVSFTVGKRWGWNNGWGGAIYINNGLGQVQCESTIYSGGGYATIGTLGTSIYRASVDVAPNPNDPNASDRYRAGIFYLSNGGSSAGIGNYSFSLLYYPDDRG

SEQ ID NO: 268 - protein, 295 aa, Chlamydia pneumoniae
FCGGRLMSNPTPKTKISIPTFVRFNIQSINLTEDQKKTTFTVGGKVTTENTVVRGDLTCTDGGLTCQSDLTIQKDINIRPTSTNSMVFDGRLNLSNSPLSYKNSQGQDITDYEKMSSGKPQEYVPFGYYKRTQIMMAQRAAHSSGYVGGGSVPSGSYVPWNKFDQTSTQKTSGTEIYIDPNDSTKLVFEVNNKVPKLFRISVIMAKHGSWLDNGTGADILLAANEYEQGGGRINVTDLAMTTSRGSSYYETRPLQVVCVTYYAQNNGYFTFQNRAGGGLRVSFFSWNIVALPYVE

SEQ ID NO: 269 - protein, 290 aa, Chlamydia pneumoniae
GVVMKRRNLQKILPNASTPSTNVAENTGIKDQNLFLDQATLNVDGNVDIENFLETRDLKVADTITSPCEFTVGGGLSAESSQFKATTLSKGLEITSEDQDGRVPKFTNVSDPQSPRDALTYNYYRNTGCQALNLYTYYSSSQPTTVGKPIETVCQNPNPETYRISASAKIYDAVTRFPYIQFKAPGIYQVTIQIRRESGQHSGLDNPNLYLNLMIGNNKTLLCASDTRGYSGGHRTSIAVTGTFTLTEIVATPPHDYPWLFLETTIGLDIKSMSTCVIWFPFQANFAEVD

SEQ ID NO: 270 - protein, 134 aa, Chlamydia pneumoniae
CFSFCRLGSKFEKITLGGNTAIQLLAAGTYILTFTIGKRWGWNNGWGGSIRLFEGKYTGDGTMLCGSTVYSGGGYSTIGYLSTAVYRDHSDIDPDPNNPSDKYMNNFLFVRNGDHSAVIGNYSFTLLYFAGDKV

SEQ ID NO: 271 - protein, 197 aa, Chlamydia pneumoniae
IYFVFKRKTYNYFIEMTTTNNQDNNECYFKLDSTVDGDLLASNIQTFDKQAKGISSTETFSVQGNATFKEKVSATGLTSASTYKLNATGPAPSSITIDMKNNRLSNPALPKNPCDPVPANYVRSPQYFFCAKPIEGTFMFDGSSRYLPITGDGSNYTLYQSSKAGDVFRFVDWDQNSKKLHLGGTQPYNFLLQEPIS

SEQ ID NO: 272 - protein, 181 aa, Chlamydia pneumoniae
AYLDFSKRSCVEEDHVSKKINRNDLCPCGSNKKYKQCCLKKEEQTARYTTEGKFKFSAEVLSASEQGEAGDNCTKLFQRLSQSLTSEQKAAVGKFHQITKNKEVMSKKALKKAQAKEEKLVTEKLQQHNFEILNTGENLAPPMESTATLNQDTNFVCEDFIPTQEDFRISENSQKPPVEED

SEQ ID NO: 273 - protein, 206 aa, Chlamydia pneumoniae
MSTLLLNPPWMKAGKRIESLVRKALYTHTMLANHRKIVVALSGGKDSLTLLLMLKAISGRGFPDLDLHAVNIGGKYSCGAEVNKPYLTRICDQLCIPFRTIPSPYAPETPECYPCSQARRRLLFQAAKEIGASAIAFGHHRDDLVQTALLNLLHKAEFAGMLPVLDMVHFGVTILRPLIFTPEFWIRKFAKENASQESLAVVPWFH

SEQ ID NO: 274 - protein, 281 aa, Chlamydia pneumoniae
LVLMNKRLKIILTNDDGITAKGMSCLVSALLEANIGDIYIAAPQAEQSGKSMAISLNQVVCASPYAYPQPVKEAWAVGGSPTDCVRLGLRTLFESVSPDLVISGINCGNNICKNAWYSGTIGAAKQALVDGIPSMALSQDNHISFFQQDKAPEILKALVIYLLSQPFPCLTGLNINFPTSPGGSSWEGMRLVPPGDEFFYEEPQYLGSVNKNQYYVGKISGVRIGEHPSEELACMLENHISVSPIFSQNSPIGLMTLEEFQKTQENFNASLLSSELTTKIF

SEQ ID NO: 275 - protein, 313 aa, Chlamydia pneumoniae
LRVRPPSLAKYAFRGFRMSHGPRPTKFSFPLYFSKTLSWFILGGFLAACGVQMVLVPNELIDGGIVGLSIIASHFLGHKALPFCLVLFNLPFVFLAFKQIGKYFVIQMLTAVIIFSCSLWLIDQLPSWLGMSPFVFKGSEMETVVLGGAIIGVGCGLIIRHGGSTDGTEILGIIINKKKGYTVGQIILFVNFFIFALSGIVYKNWHTAFVSFLTYGIATKVMDMVILGLEDTKSVTIITSSPRKLGHILMETLGIGLTYIHAEGGYSGEPRNLLYVVVERLQLSQLKEIVHREDPSAFIAIENLHEVINGRRT

SEQ ID NO: 276 - protein, 192 aa, Chlamydia pneumoniae
MKRYVVGISGASGVILAVKLIKELVNAKHQVEVIISPSGRKTLYYELGCQSFDALFSEENLEYIHTHSIQAIESSLASGSCPVEATIIIPCSMTTVAAISIGLADNLLRRVADVALKERRPLILVPRETPLHTIHLENLLKLSKSGATIFPPMPMWYFKPQSVEDLENALVGKILAYLNIPSDLTKQWSNPE

SEQ ID NO: 277 - protein, 296 aa, Chlamydia pneumoniae
VRLNYFLNLVNFKYSIFSILFLSASTVFALSINEISQNLSFKEGFKISVFGAIAFVFARTTGIVVNQCIDRFIDKKNTRTSKRVLPANLVSLNFAWVLSLFCSFLFLFLCKILRIFSLGIASLTLMIVYPYMKRVTFFCHWGLGLVYTVAILMNFCAFAESGLSMRLCFLALLWGGSVGMVIAANDIIYAIEDTEFDREEGLRSVPAHYGEKKAVEIAKVNLWVSYLAYIFSGFVGSLDKEFYFTAIIPLVVILKVVRMYSNYSKKDQEGESQILFSEYCDCSIVSCKYDFVLEFE

SEQ ID NO: 278 - protein, 232 aa, Chlamydia pneumoniae
IMALDEINNQNNPSQQIASSTSQTSKINQDRKTFACTVTLLVVATLMILSGIVLLFTIGSLGLSVPLSGILGTFAVTVGAVLFITGLTILVRKSLGIEQKNEDLNFLKIKTPTPPARPLMSKFSVTCSTTSIVLGMALLIGAVVSVFFLTGYLQLGLCAGLVGLGTALFVAGLARMSPRSLADQEGSGSADSQSNIVGIGEPKAAQEQKWYKMAVVRGEDGIPTAIRLTPEK

SEQ ID NO: 279 - protein, 263 aa, Chlamydia pneumoniae
VSIMSLNKTNALLNQPEPAVCLNAWDPKYINQDRKTFACTVTLLVIATLMILTTGVIVLLAMGSPGLSVLVSTIIGTSVTTLGTALFIIGLVKLIKKSLAWIQYQKYFQEVVKQKYEPFSIPKNDNVHKLTSCLPSPLDIESPSPEASTPVSKLRIACSGVAIVLGVTLLIGAVVSVFFCTGYLQLALCVGFACLGTALFVGGLAGLRTHSLIAQGIMYLYLTYYLSSALEERNETVKDQRNEINTYLTEECRQQKREKALLE

SEQ ID NO: 280 - protein, 115 aa, Chlamydia pneumoniae
DPCSSSWLFSSVSGSRSGAGRDVGLDPEVPGLLALFCSLGCPRRGLRSSIPFSTFGVDVPGGLACAFSGSVFGRTNGSYANINSSSEGIGDKGGVGFFQFGTKDFIHSQVDVLLL

SEQ ID NO: 281 - protein, 331 aa, Chlamydia pneumoniae
VAFRCVMTIDMHCDLLSHPHFCRKDPAVRCSPEQLLSGGVRQQVCAIFVPHSRGEPNCDKQNSLFFSLPNQYPDIGLLSYEEEENGSSSQKKSLSLIRSIENASALGDDTAPLGTLLAKLIHLTKQGPLAYLGIVWKGDNRFGGGTEAPKRLSNDGKVLLDIMYELGVPIDLSHCSDKLAEDILDYTADKLPNLAVIASHSNFRSVLDHRRNLVDAHAKEIVRRKGVIGLNLVRSYVGDSLGDLEKHVLHAENLGILSSIVLGSDFFYANEDENFFFNECSSAEAHPVLNQLIHRIFSKGKAESILSSRAEKFLKQVIVEQVNPKITDVKL

SEQ ID NO: 282 - protein, 218 aa, Chlamydia pneumoniae
RIENISGYPLSPTAKKLAQLFPGAITLVVKHRNPRFPKETLAFRIVDHSVVREIVDHCGTLIGTSANLSEFPSALTAQEIFADFADHDLCIFDGPCSHGLESTVVASDPLYIYREGLISRSVIENIAGTEAKIFHRTSHAFSKHIKIYTVKNQEQLVSFLSGSLDFKGVVCEHPKPKNFYTRLREALKKKTPSIVFIYDINTSDYPELFPFLSPYYIE

SEQ ID NO: 283 - protein, 90 aa, Chlamydia pneumoniae
SIFGVIVPDKKAQITFSLPEVMSAIHQGKIVALPTDTVYGFVLSLYASEAEERLYALKDREPSKAFALYVNSIEESKTFLVIPYLLQLRN

SEQ ID NO: 284 - protein, 243 aa, Chlamydia pneumoniae
MTDYSFFRRKIGNIEAIECPGNPQDPIIILCHGYGSLADNLTFFPSICSFSKLRPTWIFPNGILPLENDFRGSRACFPLNVLLLQELSRLYANGVGNLQEKYDELFDVDLETPKEALEELILNLNRPYNEIIIGGFSQGAILATHLVLTSQNPYAGALIFAGARLFNQGWEEGLKQCAQVPFLQSHGYEDEILPYHLGAHLNDLLLTKLNGQFVSFHGGHEIPSVVFQKMQVTVPNWIDPARG

SEQ ID NO: 285 - protein, 274 aa, Chlamydia pneumoniae
FNRQSDATYATWVMHLEEENQGWEALLRKVYHQEVPPAILLHGFTLPVLQDKAEQLASEILLSSSPGSEHKVSQKIHPDIYQFFPEGKGRLHSIDLPRGIKKQIYISPFEANYKIYIIHEADRMTLAAISAFLKVFEEPPKHAVIILTTAKVQRLPKTIISRSLSIFIERGEKILCSKETFSYLFRYAQCEIPVTEVSQIIKESSETDKQVLRDKVQRFMEVLLELYRDRYTLNLGLKASALNYPEHVKEILQLPLLPLDKVLLIVESAWSVIE

SEQ ID NO: 286 - protein, 209 aa, Chlamydia pneumoniae
GSIVFIVIEGGEGSGKSSLAKALGDQLVAQDRKVLLTREPGGCLIGERLRDLILEPPHLELSRCCELFLFLGSRAQHIQEVIIPALRDGYIVICERFHDSTIVYQGIAEGLGADFVADLCSKVVGPTPFLPNFVLLLDIPADIGLQRKHRQKVFDKFEKKPLSYHNRIREGFLSLASADPSRYLVLDARESLASLIDKVMLHTQLGLCT

SEQ ID NO: 287 - protein, 834 aa, Chlamydia pneumoniae
MFNKDEIIVPKNLEEEMKESYLRYSMSVIISRALPDIRDGLKPSQRRVLYAMKQLSLSPGAKHRKCAKICGDTSGDYHPHGESVIYPTLVRMAQNWAMRYPLVDGQGNFGSIDGDPPAAMRYTEARLTHSAMYLMEDLDKDTVDIVPNYDETKHEPVVFPSKFPNLLCNGSSGIAVGMATNIPPHNLGELIEATLLLLANPQASVDEILQVMPGPDFPTGGIICGSEGIRSTYTTGRGKIKVRARLHVEENEDKHRESIIITEMPYNVNKSRLIEQIANLVNEKTLAGISDVRDESDKDGIRVVLEIKKGESSEIIINRLYKFTDVQVTFGANMLALDKNLPRTMSIHRMISAWIRHRKEVIRRRTRYELNKAETRAHVLEGYLKALSCLDALVKTIRESGNKEHAKERIIESFGFTEPQALAILELRLYQLTGLEAEKIQKEYEELLNKIAYYKQVLSDEGLVKDIIRNELQDLLKHHKVARRTTIEFDADDIRDIEDIITNESVIITISGDDYVKRMPVKVFKEQRRGGHGVTGFDMKKGAGFLKAVYSAFTKDYLLIFTNFGQCYWLKVWQLPEGERRAKGKPIINFLEGIRPGEELAAILNIKNFDNAGFLFLATKRGVVKKVSLDAFSNPRKKGIRALEIDEGDELIAACHIVSDEEKVMLFTHLGMAVRFPHEKVRPMGRTARGVRGVSLKNEEDKVVSCQIVTENQSVLIVCDQGFGKRSLVEDFRETNRGGVGVRSILINERNGNVLGAIPVTDHDSILLMSSQGQAIRINMQDVRVMGRSTQGVRLVHLKEGDALVSMEKLSSNENDDEVLSGSEEECSDTVSLR

SEQ ID NO: 288 - protein, 789 aa, Chlamydia pneumoniae
KGYKLFVSAPGCTLEIRESRVFIHLVYEVVDNSIDEAMAGYCSRIDVRILEDGGIVIVDNGRGIPIEVHERESAKQGREVSALEVVLTVLHAGGKFDKDSYKVSGGLHGVGVSCVNALSEKLVATVFKDKKCYQMEFSRGIPVTPLQYVSVSDRQGTEIVFYPDPKIFSTCTFDRSILMKRLRELAFLNRGITIVFEDDRDVSFDKVTFFYEGGIQSFVSYLNQNKESLFSEPIYICGTRVGDDGEIEFEAALQWNSGYSELVYSYANNIPTRQGGTHLTGFSTALTRVINTYIKAHNLAKNNKLALTGEDIREGLTAVISVKVPNPQFEGQTKQKLGNSDVSSVAQQVVGEALTIFFEENPQIARMIVDKVFVAAQAREAAKKARELTLRKSALDSARLPGKLIDCLEKDPEKCEMYIVEGDSAGGSAKQGRDRRFQAILPIRGKILNVEKARLQKIFQNQEIGTIIAALGCGIGADNFNLSKLRYRRIIIMTDADVDGSHIRTLLLTFFYRHMTALIENECVYIAQPPLYKVSKKKDFRYILSEKEMDSYLLMLGTNESSILFKSTERELRGEALESFINVILDVESFINTLEKKAIPFSEFLEMYKEGIGYPLYYLAPATGMQGGRYLYSDEEKEEALAQEETHKFKIIELYKVAVFVDIQNQLKEYGLDISSYLIPQKNEIVIGNEDSPSCNYSCYTLEEVINYLKNLGRKGIEIQRYKGLGEMNADQLWDTTMNPEQRTLIHVSLKDAVEADHIFTMLMGEEVPPRREFIESHALSIRINNLDI

SEQ ID NO: 289 - protein, 116 aa, Chlamydia pneumoniae
DMFLKRKKRGGSQVQNKGTASPIKHAKHYLHNYLQELQKIMAARPHDAIDAWNQVFRDKYKGMSQAIGFRDHILLVKVYNSSLYALLKQTPQNDLIMSLYQVASHVQIREIQFLLG

SEQ ID NO: 290 - protein, 200 aa, Chlamydia pneumoniae
NISIFYPKYFIEGKEVLIKNLPPLIFYGVILMIINVRAPAFGITSVQQFSTNFQAAIPILNIVIGCSRISSTYAEDIEEVAQEKLEKSTHSKSSTSVNLWAHRVRGVVEILGGGIVILALEITALVLQVIIKLIKCLIDVLCVCLFGLGVCVVAIIGAIAFCVVVVVKYLGFCSQGEELEPIEVKTLISPDKPYPTVVYV

SEQ ID NO: 291 - protein, 275 aa, Chlamydia pneumoniae
RDSMKKKLSLLVGLIFVLSSCHKEDAQNKIRIVASPTPHAELLESLQEEAKDLGIKLKILPVDDYRIPNRLLLDKQVDANYFQHQAFLDDECERYDCKGELVVIAKVHLEPQAIYSKKHSSLERLKSQKKLTIAIPVDRTNAQRALHLLEECGLIVCKGPANLNMTAKDVCGKENRSINILEVSAPLLVGSLPDVDAAVIPGNFAIAANLSPKKDSLCLEDLSVSKYTNLVVIRSEDVGSPKMIKLQKLFQSPSVQHFFDTKYHGNILTMTQDNG

SEQ ID NO: 292 - protein, 221 aa, Chlamydia pneumoniae
MQSDLIQILLKETVNTLYMVSTAFFFSCAIGGMLGLGLFCTSPKSLNPKKSLYATISMILSFLTAIPFAILIVILFPITRWIVGTSLGPTASIVPLTIGAIPFVVTIVVDAFRNSALNYLESAVALGIPKRNILFGILLPESYPQLIFSLKSLVVHLISCSTLAGFVGGGGLGQLLLQYGYYRFEWSVTTSVLVITLVLIESVRILGDFWGRRVLKYRGIL

SEQ ID NO: 293 - protein, 341 aa, Chlamydia pneumoniae
VSEQHSPIISVQDVSKKLGDHILLSKVSFSVYPGEVFGIVGHSGSGKTTLLRCLDFLDMPTSGSISVAGFDNSLPTQKFSRRNFSKKVAYISQNYGLFSSKTVFENIAYPLRIHHSEMSKSEVEEQVYDTLNFLNLYHRHDAYPGNLSGGQKQEVAIARAIVCQPEVVLCDEITSALDPKSTENIIERLLQLNQERGITLVLVSHEIDVVKKICSHVLVMHQGAVEELGTTEELFLNSENSITNELFHEDINIAALSSCYFAEDREEVLRLNFSKELAIQGIISKVIQTGLVSINILSGNINLFRKSPMGFLIIVLEGEVEQRKKAKELLIELGVVIKEFY

SEQ ID NO: 294 - protein, 357 aa, Chlamydia pneumoniae
ISLRRHTLMLNIHDILGNDDENLLSYQCKHITKDKLTLPSHDFVDKVFGLSDRNNRVLRSLQTMFSHGRLANSGYLSILPVDQGIEHSAGASFAINPIYFDPENIVKLAIESGCSAVASTYGTLSLLSRKYAHKIPFMLKLNHNELLSYPTKYHQIFFTQVEAAYSMGAVAVGATVYFGSETSNEEIVAVSNAFAKARSLGLATVLWCYLRNPAFVANGVDYHTAADLTGQADHLGATLGADIVKQKLPTCQGGFKAINFGKTDERVYSELSSNHPIDLCRYQVLNSYCGKVGLINSGGPSGKNDFTEAARTAVINKRAGGMGLILGRKAFQRPLSEGIQLLNLVQDIYLDPNITIA

SEQ ID NO: 295 - protein, 468 aa, Chlamydia pneumoniae
MHSHSKPTKPLGTFTVGMLSLAVVISLRNLPLTAKHGLSTLFFYGLAVICFMIPYALISAELASFKPQGIYIWARDALGKWWGFFAIWMQWFHNMTWYPAVLAFIASTIVYKINPELAHNKVYIATVILAGFWILTFFNFLGITSSALFSSICVIIGTLIPGVILVSLALFWIFSGNPIAISLSWGNLLPNFSNVSSLVLLAGMLLALCGLEANANLASDMVNPRKNYPKAVFIGAIATLTILVLGSLSIAIVIPKEEISLVSGLVKTFTLFFDKYNLSWMTGIVVVMTIAGSLGELNAWMFAGTKGLFISTQNDCLPRLFKKVNSKNVPTNLMLFQGIVVTIFTLLFLCLDSADLVYWILTALSVQMYLAMYICLFLAGPILRIKEPRAQRLYSVPGKFLGICTMSILGILSCAFALWVSFLPPRELAQISEGSKIGYTTFLLLAFSLNCLIPFGIYFTHKRLSKKS

SEQ ID NO: 296 - protein, 209 aa, Chlamydia pneumoniae
RGAKFCRTKKYITPFLHHLFEGDEVALLNQLSLRLDLIVPNALYPEPDPSCWQSINSEDCAKDAEDQQEDFNKTKEACKEGLKKLVLPALSITSIPQLLRARRFKQGAEILMAIDRKKMKQNPFIFLEALLESEEFSISVGKYLKLLMPIHLWDKLLHAIYLGYFQTGLICQGEIETFCRRANLNPEAFQAAIQQGRLLSFLFPKMLLD

SEQ ID NO: 297 - protein, 168 aa, Chlamydia pneumoniae
FLDMNIPAPQVPVIDEPVVNNTSSYGLSLKSSLRPITYLILAILAIATLMSVLYFCGIISVGTFVLGMLIPLSVCSVLCVAYLFYQQSSIEKTKVFSITSPSVFFSDEDLNLLLGREEDSVSAIDELLKNFPADDFRRPKMLPYSNFLDEQGRPNESREEDSHTSKIL

SEQ ID NO: 298 - protein, 517 aa, Chlamydia pneumoniae
KELFNLFFFTANKETTASHELIYRKNQSFSLSPVTILCLLAISVLLLLGVVFALVGCHVLAAPLGLLVWGCAASVCSMMAIVSLMCLYKGGKPLIEPSNEEKIDPTKDLEIKDPESLKPVPVEGQSLPKERKTVSFKAKIPSIVEDDFKPYVIQSTFYHQNKVYSKPIAERMQSLEKEITTLIVDFPRALEESSKSSGSLLRGVISEIKNLFLPRFLSRKVKYSLTACLRRLGSIVEEYASSDLLILLLTKPEPLNMVTQQLIAHLNSLKTEKRKLTPHMQKLVLSINFWFYGWSLEEKCIEKIVAYDPNLLTDELKAHLEAGNIVQFLLSFQSSEMQREFRALFPSDAQELPSAKDGSNYVPAINSSEYMYDFKDLSVLKKSLSERLAFCEKIPSPSSWNFTSSVASHYKDFSLLFTFFSNQQSVILQNPFLLIELLHENPKCQTFLKGLLEKAMPMSNWAALFRPMLMGMLCSGIARKKELKIIAEHLGVPFKEITQAIGSGKILDLLLQHLFDF

SEQ ID NO: 299 - protein, 500 aa, Chlamydia pneumoniae
SCRESKGKIMVGEQNRNEEKLDTAFSSGNLMDSRTSHLDDELSFKLEKAFTCLSTDIHSHDLSKIVIEYNPIDLAYAVSCLPSESRAILYKNLSCITAKVAFIINTDSASRWAIFRRLSDSEVCALIEQMPPDEAVWVLDDIPDRRYRRILELIDSKKALKIRDLQKHGRNTAGRLMTNEFFAFLMETTVKDVSACIRSNPGIDLTRLVFVLDFKGELQGVVTDRSLIINPPEMSLKQIMNQIEHKVLPDATREEVVDLVERYKIAALPVVDEENFLIGAITYEDVVEAIEDIADETIARMAGTTEDVGYQTCHVVQRFLLRAPWLLVTLFAGLISASVMAYFQKISPALLALIIFFIPLINGMSGNVGVQCSTILVRSMATGTLSFGRRRETIFKEMSIGLLTGVVLGILCGLVVYLMGFLGLNIFSGGGIQLGVTVATGVLGASLTATTLGVLSPFFFAKLGVDPALASGPIVTALNDIMSMIIFFLIAGGINFLFFN

SEQ ID NO: 300 - protein, 714 aa, Chlamydia pneumoniae
RRCMIRSPLPFISSKRALNMLGLQDEFSCPEDVVDFLFSEIELLAQQDEPSEGYLALSRSLLMMTHNHPKVVKRVIFYGVSYGLKHKSMSIFIDVLTYIDFLFEKLGISASDRLSLCSARTCINFELYSQTGEMKFLSEVVDNFRLIEQLLKMHPQLKNRFGWEHFRIGAKQEEVSLVASASVYQAVGRSFIELYHKHLELSDLACGMKCLALALDLSPNNAHIHADYAKGLVVLGTRQGKSLLIERGMEHFSKAIFLSFSRDGDTLAYQNYRYSYALASVKLFDLTYKKEHFDQAMNILYQTVQAFPNLSGLWMVWGELLIRSGWLNSNMKYIEVGLEKLASLQKKTNDPIALSGLLATGIAILGLYLEEPNLFKDSRHRLISAMRMFPGNSALVHALGVVQLCSALYFNEDSHFASAISCFQSCLEWDLDATGMWQKLFDAYFSWGIKKKSARLLRKAVDVASRLCSLRPEAFLFWSDRGLALKCLAEATIDEAYKEIFLSESLLHYQRAWDLSGRLEILELWGQSHYLLAELQQSLFHYDEAYTLLTKVDLTLSSSRVKLILAAVLLGKGRLLQDTDPAEEAREILEPLVEVYLEDENFLLLLGKVYLFLFWKNKNVCLGKLARTYLEKATSLGCPEAYYTLGKFYAVIKDVNKAWGMVIRSAQYGVRITEAKWLNDPYLANLREIHAFREVVENQKGRLWLGNKTEMKRN

SEQ ID NO: 301 - protein, 405 aa, Chlamydia pneumoniae
ISITIREFLFFGFECRAKFYNVIMSCFNLTSTNESLRPISPKASFPKQGWQSYFRSALRKHRSDTLSVSVCKVNKYDANLFVRLTVIALAVVGVLILFSIMLASIQGTLVITSWPLVTAAILIPTILLTGGMYILHRLGKKVDVISGVCIPPFSRRCWVPISSSHTLEKFDEKHVSACSYLDISTLSADGSGIAAVYQCPPLLFRAFPCFGIPCAMPFVALLRMIYNLIRFLVVPFYIIFRMIYEHFFCKHLPEDDRFIYKDVAREMGRSLAAFLKAPFYASACMIGAFYSLLDPLAGRVLMGSVERDWNDNVILARSVSLANEAHSLFRFEGGGGRKGLGQHAFYLMLCCQPQSVFLFDKGEIVSGAHPSIQLPERRGLDTSGRYPHISVIPDSGNDSAKNFIV

SEQ ID NO: 302 - protein, 400 aa, Chlamydia pneumoniae
NFNRLMKKQRSHYTKNNLLLLLSILVGLGLGSVQSPWIVYSAECIANTFLKFLRLLSIPLVFCALGSTITSIQNFNTMVTLGKRILYYTLLTTVIAASIGLLLFFLLRPQMITQDALATTTKCNPLGYLDVLSDTLPENIFKPFLQGNVISAACLAVLLGTASLFLQEKEKHFVNQFFNSFFSIFLNLARGGLKLLPIAMLGFSVILFKELKDQSNLTMFAEYLLCVIGANLAQGFIVLPILLKINKVSPLKVAKAMSPALVTAFFSKSSAATLPLTMELAEDDLKINKNLSRFSFPLCSVINMNGCAAFILITVLFVATSNGMIISPLMSLGWIFIATLAAIGNAGVPMGCYFLTLSLLTSMNVPLSILGLILPFYTVIDMIETSLNVWSDCCVVSLAN

SEQ ID NO: 303 - protein, 234 aa, Chlamydia pneumoniae
SWGIIIFSTCASLDILGTTQLQDGAGASSIGITFIYLPELFTRLPGGIYLTTLFSSIFFLAFSMAALSSMISMLFLLSQTLAEFGIKPYISETLATIIAFVLGIPSALSLTFFSNQDTVWGVALIVNGLIFIYAALVYGFPKLKKEVINAAPGDLRLNKAFDYIIKYLLLIEGILLLGWYFYEGLFPENGQWWNPISLYSLGSLVLQWSLGLIILWKFNKQLYLRFSRYNHEIL

SEQ ID NO: 304 - protein, 179 aa, Chlamydia pneumoniae
EKHMSAPIPTPQELSDQITCLNVQYQQVSELARENKGDIEGLKTLTAALTADAGIQPSADEIYSLQTAAALILSASEKPGSGPSGSTEGSVTVQSPCKFKKVLAVVLTIIALIAIAVLIACIIAACGGFPLLLSALNLYTIGACVSLPIIASTSVALICLCTFVANSLIKPVITVRTTR

SEQ ID NO: 305 - protein, 212 aa, Chlamydia pneumoniae
  SITE 1...212: Xaa=unknown or other
VKNTKNSDFMTSPIPFQSSGDASFLAEQPQQLPSTSESQLVTQLLTMMKHTQALSETVLQQQRDRLXTASIILQVGGAPTGGAGAPFQPGPADDHHHPIPPPVVPAQIETEITTIRSELQLMRSTLQQSTKGARTGVLVVTAILMTISLLAIIIIILAVLGFTGVLPQVALLMQGETNLIWAMVSGSIICFIALIGTLGLILTNKNTPLPAS

SEQ ID NO: 306 - protein, 907 aa, Chlamydia pneumoniae
VWSMQRVLRLLFNLHHGEEKRAFLFFLLGLVWGIGCYGTLSLAEGLFIEKLGSAELPKIYLGSSLILCVLSSLILYNLFKKHISATALFLIPVSLSILCNFYLILSSIFAIDPPRSPLFFYRIVIWSLTILSYTSFWGFVDQFFNLQDGKRHFCIFNAIIFLGDAIGSGIIASLVHTIGIQGILILFTAALVLTFPIVFYVSKSLKSLSDDHDLFIDTGHPPPLSKALKLCFYDKYTFYLLCFYFLMQLLAIATEFNYLKIFEIQFASKEEFELVAHIGKCSLWISLGNMCFALFAYSRIVKRLGVNNIILFAPLCFLSLFLFWTFKTTLSIAVLAMVVREGVTYALDDNNLQLLIYGVPNKIRNQIRIVVESFIEPIGMLVWSLVCFLSSQQYVFCLIISLIATILVCLVRSYYAKAILKNLSAQALQLTRSMQDWIKSMTVKQKRQVELFLLAHLKHPSERHQTFAFQHLLNLASRSVLPSLLAHMNKLSLPNKLKTIEMVKSSLWAKDFLTLELLKRWTSIFPHPAIASAIHLYFAEHDLLHITHIAEDLYDTVGDRLLAAILTVRRQEAYGPYRDLADKRLKELLNSDQPEDIVMGLTILKLEKNPQNFPILLDFLNTKNEDILIVTCKALHTSVRANHKPYCPELLKRLRQCSHNDEASQYLLKTISIALDISFVKDLLMTTSQLKNTSRKYAEAMIGELDKEVAPAFLQVLTDEGTHNRCRILAAKALCKIDNWLLKKHAYKIVKSKASKALFYSYHGHYIQKKYPTYNLSLLANTLNSNYYAEVNFMLSLLGILGSMEHSGVLIRALTSKNQKIKAQALESLEKNCDSHLFSLLEPFVNQPGMCYSEKYYFKCGVIPLTLKELLNMMENSPSSLNKLTAQQLKEELSYCDPDFPICKYNL

SEQ ID NO: 307 - protein, 142 aa, Chlamydia pneumoniae
IRNFFMNLIDRAFLLKKTIIFQSLDMDLLLTIADKTETIIFKPGSNVFSIGQPGFSFYIIVEGYITISKEKLESPLNLKPLDCFGEESLFNNKPREYNASANTQVRMLVLSKGQILNIVEECPSVALSFLELYAKQIKFREP

SEQ ID NO: 308 - protein, 79 aa, Chlamydia pneumoniae
MSLEDDVIAIIVEQLGVDPKEVNENSSFIEDLNADSLDLTELIMTLEEKFAFEISEEDAEKLRTVGDVFTYIKKRQAEQ

SEQ ID NO: 309 - protein, 251 aa, Chlamydia pneumoniae
MICMDITLVGKKVIVTGGSRGIGLGIVKLFLENGADVEIWGLNEERGQAVIESLTGLGGEVSFARVDVSHNGGVKDCVQKFLDKHNKIDILVNNAGITRDNLLMRMSEDDWQSVISTNLTSLYYTCSSVIRHMIKARSGSIINVASIVAKIGSAGQTNYAAAKAGIIAFTKSLAKEVAARNIRVNCLAPGFIETDMTSVLNDNLKAEWLKSIPLGRAGTPEDVARVALFLASQLSSYMTAQTLVVDGGLTY

SEQ ID NO: 310 - protein, 308 aa, Chlamydia pneumoniae
MKKRYAFLFPGQGSQYVGMGQDLYMEYPEVRELFDFANERLGFSLTSIMFEGPEDLLMETVHSQLAIYLHSMAVVKVLSQRSSIQPSLVSGLSLGEYTALVASDRISVLDGLELVRKRGQLMNEACNQSPGAMAALLGLPSEVIEENITSLGQGIWIANYNAPKQLVVAGIAEKVDQAIELFRDLGCKKAVRLKVSGAFHTPLMQVAQDGLAPDIYALCMKDSSLPLVSHVVGKSLVNTEEMRECLARQMTSPTLWYQSCYHIESEVDEFLELGPGKVLAGLNRSIGISKPITSLGTFAQIEKFLSEV

SEQ ID NO: 311 - protein, 116 aa, Chlamydia pneumoniae
LYHFLDSSTRLYFPIKRSLAQAHLGIEDVPTFDCQAACTGYLYGLSVAKAYVESGTYNHVLLIAADKLSSFVDYTDRNTCVLFGDGGAACVIGESRPGSLEINRLSLGADGKLGEY

SEQ ID NO: 312 - protein, 105 aa, Chlamydia pneumoniae
MWFSVNKNKKAAIWATGSYLPEKVLSNADLEKMVDTSDEWIVTRTGIKERRIAGPQEYTSLMGAIAAEKAIANAGLSKDQIDCIIFSTAAPDYIFPSSGVLLKHI

SEQ ID NO: 313 - protein, 230 aa, Chlamydia pneumoniae
RKKLVYYSESLYSNLNLGPRPECKNKIHITMTRYPDYLSKLIFFLRKLPGIGFKTAEKLAFELISWDSEQLKILGNAFHNVASERSHCPLCFTLKESKEADCHFCREERDNQSLCIVASPKDVFFLERSKVFKGRYHVLGSLLSPITGKHIENERLSILKSRIETLCPKEIILAIDATLEGDATALFLKQELQHFSVNISRLALGLPIGLSFDYVDSGTLARAFSGRHSY

SEQ ID NO: 314 - protein, 795 aa, Chlamydia pneumoniae
GRLLGMLIMRNKVILQISILALIQTPLTLFSTEKVKEGHVVVDSITIITEGENASNKHPLPKLKTRSGALFSQLDFDEDLRILAKEYDSVEPKVEFSEGKTNIALHLIAKPSIRNIHISGNQVVPEHKILKTLQIYRNDLFEREKFLKGLDDLRTYYLKRGYFASSVDYSLEHNQEKGHIDVLIKINEGPCGKIKQLTFSGISRSEKSDIQEFIQTKQHSTTTSWFTGAGLYHPDIVEQDSLAITNYLHNNGYADAIVNSHYDLDDKGNILLYMDIDRGSRYTLGHVHIQGFEVLPKRLIEKQSQVGPNDLYCPDKIWDGAHKIKQTYAKYGYINTNVDVLFIPHATRPIYDVTYEVSEGSPYKVGLIKITGNTHTKSDVILHETSLFPGDTFNRLKLEDTEQRLRNTGYFQSVSVYTVRSQLDPMGNADQYRDIFVEVKETTTGNLGLFLGFSSLDNLFGGIELSESNFDLFGARNIFSKGFRCLRGGGEHLFLKANFGDKVTDYTLKWTKPHFLNTPWILGIELDKSINRALSKDYAVQTYGGNVSTTYILNEHLKYGLFYRGSQTSLHEKRKFLLGPNIDSNKGFVSAAGVNLNYDSVDSPRTPTTGIRGGVTFEVSGLGGTYHFTKLSLNSSIYRKLTRKGILKIKGEAQFIKPYSNTTAEGVPVSERFFLGGETTVRGYKSFIIGPKYSATEPQGGLSSLLISEEFQYPLIRQPNISAFVFLDSGFVGLQEYKISLKDLRSSAGFGLRFDVMNNVPVMLGFGWPFRPTETLNGEKIDVSQRFFFALGGMF

SEQ ID NO: 315 - protein, 158 aa, Chlamydia pneumoniae
  SITE 1...158: Xaa=unknown or other
DQQAQLNANLGYVNLKRCLEESDLGKKETEELEAXKQQFVKNAEKIEEELTSIYNKLQDEDYMESLSDSASEELRKKFEDLSGEYNAYQSQYYQSINQSNVKRIQKLIQEVKIAAESVRSKEKLEAILNEEAVLAIAPGTDKTTEIIAILNESFKKQN

SEQ ID NO: 316 - protein, 367 aa, Chlamydia pneumoniae
SKFKEFSMSEAPVYTLKQLAELLQVEVQGNIETPISGVEDISQAQPHHIAFLDNEKYSSFLKNTKAGAIILSRSQAMQHAHLKKNFLITNESPSLTFQKCIELFIEPVTSGFPGIHPTAVIHPTARIEKNVTIEPYVVISQHAHIGSDTYIGAGSVIGAHSVLGANCLIHPKVVIRERVLMGNRVVVQPGAVLGSCGFGYITNAFGHHKPLKHLGYVIVGDDVEIGANTTIDRGRFKNTVIHEGTKIDNQVQVAHHVEIGKHSIIVAQAGIAGSTKIGEHVIIGGQTGITGHISIADHVIMIAQTGVTKSITSPGIYGGAPARPYQETHRLIAKIRNLPKTEERLSKLEKQVRDLSTPSLAEIPSEI

SEQ ID NO: 317 - protein, 354 aa, Chlamydia pneumoniae
REQKGLHHMDVSRKINRHTQFYVDSIDGVIKNFDHKPSEDKSRDHEELEEKLLTITKRIVASAQEFQNRKTDSKNYYLKKTQWLPFKNEELEQTKELFAMLTSMDKKIAQLFFYSPGCSSDWVEFTEVICHLNDSIGLGGVLLCCGLFEQQCEHVVTVNKKLDLPLLLGTTVVNSLRYYLTYRNISLLNCQSMSELGKELGDVLKQHGVAFTLIFKEIVDIDLLNYVKLIQGLKRSGNIQARIYDNDVPTLPSVSSSPIALRYSLANTIRGLALHVDFSSLKFISPSILSNTEHTAKALNSGGECFIFSNLDEFNLGMKIVMQLLRTGKISPEILNKNIMKILMIKRRVRSLYI

SEQ ID NO: 318 - protein, 342 aa, Chlamydia pneumoniae
MDSSAPYNIASQGTEKSTVERILDLYGPASCIKFLKQMVLIREFEARGEEAYLEGLVGGFYHSYAGQEAVATAAIANTGLDPWVFSSYRCHALAILLNIPLQEIAAELLGKETGCALGRGGSMHMCGPNFPGGFGIVGGQIPLAAGAAFTIKYQEQKNRVSLCFIGDGAVAQGVFHETLNFVSLHQLPLMLIIENNGWSMGTSLNRAVAKQPIAESQGSSYDIRAVTVNGFDLFNSLLGFREAYRYMVDTESPVLVECLCSRFRGHSISDPNLYRSKEEMQCLFKKDPIVLAKDWLIRLEVLTEEEFQNIRQECKTAVLEAFSNAKLSSDPSVTTLEEGVYA

SEQ ID NO: 319 - protein, 161 aa, Chlamydia pneumoniae
RKESMPKHKTLEIREALREAIDEEMSRDPNVCILGEEVGDYNGAYKVTKGLLDKWGPKRVIDAPISEAAFSGIGIGAALSGLRPIIEFMSWNFSFVALDQIISHAAKMHFMTGGKFSVPIVFRGPNGAAAQVSCQHSHCVESLYANIPGLNYYSPFEPLRR

SEQ ID NO: 320 - protein, 150 aa, Chlamydia pneumoniae
NITLKGEVPTEEYLVPIGKAHRVQEGNDLTIITYSRMVSITKEACSLAKKRWGLSIEIIDLRTIKPLDISTILSSVRKTSRCIVIEEGHYFAGISSEIIALITEHVFDSLDAPPLRVCQKETPMPYSKILEQATLPNVNRILDTIEKVMR

SEQ ID NO: 321 - protein, 432 aa, Chlamydia pneumoniae
GKFVISLLKMPKLSPTMEVGTIVKWHKKSNDQVSFGDVIVEISTDKAILEHTANEDGWIREILRHEGEKIVIGTPIAVLSTEANEPFNLEELLPKTEPSNLEASPKGSSEEVSPATTPQAASATFTAVTFKPEPPLSSPLVFKHVGTTNNLSPLARQLAKEKNIDVSSIQGSGPGGRIVKKDLEKAPPKSIAGFGYPESPEVPPGSYHEENLSPIREVIAARLQAAKISIPHFYVRQQVYASPLLNLLKELQAQGIKLSINDCIVRACALALKEFPSINSGFNSVDNKIVRFDTIDISIAVAIPDGIITPIIRCADRKNLGMISAEIKSLALKARNQSLQDTEYKGGSFCVSNLGMTGITEFTAIVNPPQAAILAVGSVTEQALVLDGEITIGSTCNLTLSVDHRVIDGYPAAMFMKRLQKILEAPAVLLLN

SEQ ID NO: 322 - protein, 104 aa, Chlamydia pneumoniae
IDETSMFFSFASCLANGERLFVVPTCLKTKGEERGGSGLKVTAVNVAEAACGVVAGETSSEEPFGDASRLEGSVLGRSSSRLKGSLASVESTAIGVPITIFSPS

SEQ ID NO: 323 - protein, 828 aa, Chlamydia pneumoniae
NGCIVEDFSSFDKNKVSVDSMKRAILDRLYLSVVQSPESASPRDIFTAVAKTVMEWLAKGWLKTQNGYYKNDVKRVYYLSMEFLLGRSLTSNLLNLGILDLVRKALKTLNYDFDHLVEMESDAGLGNGGLGRLAACYLDSMATLAVPAYGYGIRYDYGIFDQRIVNGYQEEAPDEWLRYGNPWEICRGEYLYPVRFYGRVIHYTDSRGKQVADLVDTQEVLAMAYDIPIPGYGNDTVNSLRLWQAQSPRGFEFSYFNHGNYIQAIEDIALIENISRVLYPNDSITEGQELRLKQEYFLVSATIQDIIRRYTKTHICLDNLADKVVVQLNDTHPALGIAEMMHILVDREELPWDKAWEMTTVIFNYTNHTILPEALERWPLDLFSKLLPRHLEIIYEINSRWLEKVGSRYPKNDDKRRSLSIVEEGYQKRINMANLAVVGSAKVNGVSSFHSQLIKDTLFKEFYEFFPEKFINVTNGVTPRRWIALCNPRLSKLLNETIGDRYIIDLSHLSLIRSFAEDSGFRDHWKGVKLKNKQDLTSRIYNEVGEIVDPNSLFDCHIKRIHEYKRQLMNILRVIYVYNDLKENPNQDVVPTTVIFSGKAAPGYVMAKLIIKLINSVADVVNQDSRVNDKLKVLFLPNYRVSMAEHIIPGTDLSEQISTAGMEASGTGNMKFALNGALTIGTMDGANIEMAEHIGKENMFIFGLLEEQIVQLRREYCPQTICDKNPKIRQVLDLLEQGFFNSNDKDLFKPIVHRLLHEGDPFFVLADLESYIAAHENVNKLFKEPDSWTKISIYNTAGMGFFSSDRAIQDYARDIWHVPTKSCSGEGN

SEQ ID NO: 324 - protein, 86 aa, Chlamydia pneumoniae
VFSHPLANHSITVFATAVKISLGDADSGDCTTLKYRRSKIARFIESTLTLFLSKLEKSSTMQPFQIPSRTLHMRNLKKKKELRLGK

SEQ ID NO: 325 - protein, 128 aa, Chlamydia pneumoniae
FFTQENNMATVAQTPQTTQPQPSVSHKATHRYCSWVFFKPILVSLGLLLASLTTLGLVIASGVTLSLGIGHCSCYTDSTAGIALVLAFNHIRQFKQARTAELNSMKMISAPAAATVQKQKLEDRYSSK

SEQ ID NO: 326 - protein, 448 aa, Chlamydia pneumoniae
  SITE 1...448: Xaa=unknown or other
FMRAWEEFLLLQEKEIGTNTVDKWLRSLKVLCFDACNLYLEAQDSFQITWFEEHIRHKVKSGLVNNNNKPIRVHVTSVDKAAPFYKEKQMQQEKTAYFTMHYGSVNPEMTFSNFLVTPENDLPFRVLQEFTKSPDENGGVTFNPIYLFGPEGSGKTHLMQSAISVLRESGGKILYVSSDLFTEHLVSAIRSGEMQKFRSFYRNIDALFIEDIEVFSGKSATQEEFFHTFNSLHSEGKLIVVSSSYAPVDLVAVEDRLISRFEWGVAIPIHPLVQEGLRSFLMRQVERLSIRIQETALDFLIYALSSNVKTLLHALNLLAKRVMYKKLSHQLLYEDDVKTLLKDVLEAAGSVRLTPLKIIRNVAQYYGVSQESILGRSQSREYVLPRQVAMYFCRQKLSLSYVRIGDVFSRDHSTVISSIRLIEQKIEENSHDIHMAIQDISXEFKFLA

SEQ ID NO: 327 - protein, 808 aa, Chlamydia pneumoniae
  SITE 1...808: Xaa=unknown or other
YFDLLSLIFRVYQMNKRTLLFVSLIGIAFVGCQIFFGYNEFRSCKNLAEKQRKISEQTLAAVESVGLSVASWDTDVNGEEHKNNYAVRVGDKLFLLHNGEAAQSVYSSGESWSFVDHKCGFDNIHLALYRQQGSSFNPTNTGKVFLPTNHEGLPVLVVEFRNNKEPLVFLGEYAQGRISNKDSTIFGTALVFWRSGSDYIPLGLYDSREEKLVSLDLPITRAVIFGNDQDSAKSSDTANHYVLFNDYMQIIVSEESGSIEGINLPFASTNNKSIVNEIGFDRDLASEKSPEALFPGLSSKLPDGQQAKNSIGGYYPLLRRGLLSDSKKLLPLEYHALNVVSGRELATPVALRYRVLSYTPHSIQLESLDRSVQKVYKLPENPEEKPYVFETAITLTKETEDVWVTSGVPEVEIMSNASAPTIKYRVIKKNKGSLDKVKLPKVKEPLAVRRGVYPQWILNSNGYFGIILTPLSEIASGYGSLYISGSTAPTRLSAISPKNQLYPVSKYPGYETLLPLPKDAGTHRFLVYAGPLAEPTLKVLDKTITQEKGENPEYLDSISFRGVFAFITAPFAALLFIIMKFFKLVTGSWGISIILLTVFLKLLLYPLSAWSIRSXRRMXILSPYIQQIQQKYKNEPKRAQMEIMGLYKTNKVNPITGCLPLLIQLPFLIAMFDLLKSSFLLRGASFIPGWIDNLTAPDVLFSWQTSIWFIGNEFHLLPILLGIVMFLQQKVTSLHKKGPVTDQQKQQQVMGNMMAILFTAMFYNFPSGLNIYWLSSMILGVVQQWITNKILDSKHLKNEVVLNNKKHR

SEQ ID NO: 328 - protein, 203 aa, Chlamydia pneumoniae
FFMDGVFTYNILKRSFKYGTEACRVMEAFFGFLLWAAIFSWIYKKKISKLTFLFLTDLCGSVFGIAAFFIRLGNFWNQEIVGTPTSLPWGVVFSDPMQGVQGVPVHPVQLYEGISYLVVSGILYFLSYKRYLHLGKGYVTSIACISVAFIRFFAEYVKSHQGKVLAEDCLLTIGQILSIPLFLFGVALLIICSLKARRHRSHI

SEQ ID NO: 329 - protein, 153 aa, Chlamydia pneumoniae
CTMARNIKYFLILFPGILWISAGMKLLLKATAIALDPLSSFFTYCLLSMVSWGLASLKHRYLLSKTIRKQLSLSSEFFSQKITWIAYIKQTFISRRFLIMVIMIAFSLVLRRYISNPQALFVIRATVGYALIKTAIAYFSKLQNALMENPEGN

SEQ ID NO: 330 - protein, 122 aa, Chlamydia pneumoniae
MEIIHIGTDIIEISRIREAIATHGNRLLNRIFTEAEQKYCLEKTDPIPSFAGRFAGKEAVAKALGTGIGSVVAWKDIEVFKVSHGPEVLLPSHVYAKIGISKVILSISHCKEYATATAIALA

SEQ ID NO: 331 - protein, 311 aa, Chlamydia pneumoniae
MIHSRLIIIGSGPSGYTAAIYASRALLHPLLFEGFFSGISGGQLMTTTEVENFPGFPEGILGPKLMNNMKEQAVRFGTKTLAQDIISVDFSVRPFILKSKEETYSCDACIIATGASAKRLEIPGAGNDEFWQKGVTACAVCDGASPIFKNKDLYVIGGGDSALEEALYLTRYGSHVYVVHRRDKLRASKAMEARAQNNEKITFLWNSEIVKISGDSIVRSVDIKNVQTQEITTREAAGVFFAIGHKPNTDFLGGQLTLDESGYIVTEKGTSKTSVPGVFAAGDVQDKYYRQAVTSAGGGCIAALDAERFLG

SEQ ID NO: 332 - protein, 580 aa, Chlamydia pneumoniae
MPKQAEYTWGSKKILDNIECLTEDVAEFKDLLYTAHRITSSEEESDNEIQPGAILKGTVVDINKDFVVVDVGLKSEGVIPMSEFIDSSEGLVLGAEVEVYLDQAEDEEGKVVLSREKATRQRQWEYILAHCEEGSIVKGQITRKVKGGLIVDIGMEAFLPGSQIDNKKIKNLDDYVGKVCEFKILKINVERRNIVVSRRELLEAERISKKAELIEQISIGEYRKGVVKNITDFGVFLDLDGIDGLLHITDMTWKRIRHPSEMVELNQELEVIILSVDKEKGRVALGLKQKEHNPWEDIEKKYPPGKRVLGKIVKLLPYGAFIEIEEGIEGLIHISEMSWVKNIVDPSEVVNKGDEVEAIVLSIQKDEGKISLGLKQTERNPWDNIEEKYPIGLHVNAEIKNLTNYGAFVELEPGIEGLIHISDMSWIKKVSHPSELFKKGNSVEAVILSVDKESKKITLGVKQLSSNPWNEIEAMFPAGTVISGVVTKITAFGAFVELQNGIEGLIHVSELSDKPFAKIEDIISIGENVSAKVIKLDPDHKKVSLSVKEYLADNAYDQDSRTELDFKDSQGPKERKKKGK

SEQ ID NO: 333 - protein, 225 aa, Chlamydia pneumoniae
MNKNLVAIFDYMEKEKGIQRSTIIGAIESALKIAAKKTLRDDANISVNINSRTGDIEVFCEKEIVEICQNPSKEIPLDKAREYDPDCQIGQYMDVPFVSDNFGRIAAHAARQIIGQKLRHAERDVIYEEYRHRVNETLSGVVKRFAKGSNLIIDLGKVEAILPTRFYPKTEKHKIGDKIYALLYEVQESENGGAEVILSRSHAEFVKQLFISRSPRTRRRFCGDC

SEQ ID NO: 334 - protein, 174 aa, Chlamydia pneumoniae
KISFRELNDEKIDIVNYSPVSTELLQNLLYPIEIQKIAILEDDKVIAIVVNDADYATVIGKRGINARLISHILDYELEVQRMSEYNKLLEIQRLQLAEFDSPHLDQPLEMEGISKLVIQNLEHAGYDTIRRVLLASANDLASVPGISLELAYKILEQVSKYGESKVDEKPEIED

SEQ ID NO: 335 - protein, 761 aa, Chlamydia pneumoniae
  SITE 1...761: Xaa=unknown or other
LLIRSLSKSANMEKVKLTKNLKLKIKNAQLTKAAGLDKLKQKLAQAGSSEAKSSSEKPSAKEKSVKVALAATSTPTASAEQASPESTSRRIRAKNRSSFSSSEEESSAHIPVDTSEPAPVSIADPEPELEVVDEVCDESPEVHPVAEVLPEQPVLPETPPQEKELEPKPVKPAEPKSVVMIKSKFGPTGKHINHLLAKTFKAPAKEEKVVAGSKSTKPVASDKTGKPGTSEGGEQNNREKQFNPANRSPASGPKRDAGKKNLTDFRDRSKKSDESLKAFTGRDRYGLNEGGEEDRWRKKRVYKPKKHYDEASIQRPTHIKISLPITVKDLATEMKLKASEVIQKLFIHGMTYVVNDILDSETAVQFIGLEFGCTIDIDYSEQDKLCLSNDTVRDEIQSTDPSKLVIRSPIVAFMGHVDHGKTTLIDSLRKSNVAATEAGAITQHMGAFCCSTPVGDITILDTPGHEAFSAMRARGAEVCDIVVLVVAGDEGIKXQTLEAIEHAKAADIAIVVAINKCDKPNFNSETIYRQLSEINLLPEAWGGSTVTVNTSAKTGEGLSELLEMLALQAEVLELKADPSARARGLVIESELHKGLGPVATVLIQNGSLKLGEALVFNDCYGKVKTMHNEHNELMKEAGPSIPVLITGLSDIPKAGDPFFVVKNEKTARDIIEARSAGQQRFALQQKKRPNFDSMLQNKKTLKLMIKADVQGSIEALVSSISKIKSEKVDVEILTNSVGEISESDIRLLPPLKQFSSVSIQE

SEQ ID NO: 336 - protein, 170 aa, Chlamydia pneumoniae
NFNKQCRRNFRIRHSFTAASKAVLIGFHTGIESHAEPLIKSLGVRVELFTVIYHAIDAIKEIMTSLLDPIAEEKDEGSAEIKEIFRSSQVGSIYGCIVTEGIMTRNHKVRVLRNKEILWKGTLSSLKRVKEDVKEVRKGLECGILLEGYQQAQIGDVLQCYEVIYHPQKL

SEQ ID NO: 337 - protein, 141 aa, Chlamydia pneumoniae
VMSYNVMKLSIIHKNYNLKYCMTENRRIKRVNALLQEAIAKVILKDVKHPKISNLWITVTRVSLSKDLHSARVYVSVMPHENTKEEALEALKVSAGFIAHRASKNVVLKYFPELHFYLDDIFSPQDYIENLLWQIQEKEKS

SEQ ID NO: 338 - protein, 243 aa, Chlamydia pneumoniae
LNTIKDMTMDLAVELKEGILLVDKPQGRTSFSLIRALTKLIGVKKIGHAGTLDPFATGVMVMLIGRKFTRLSDILLFEDKEYEAIAHLGTTTDSYDCDGKVVGRSKKIPSLEEVLSAAEYFQGEIQQLPPMFSAKKVQGKKLYEYARKGLSIERHHSTVQVHLQITKYEYPLLHFVVSCSKGTYIRSIAHELGTMLGCGAYLEQLRRLRSGRFSIDECIDGNLLDHPDFDISPYLRDAHGNSL

SEQ ID NO: 339 - protein, 308 aa, Chlamydia pneumoniae
MPMEIAYSLTSSFSVDSVTVGFFDGCHLGHSNLLSILTSYSGSSGVITFDSHPQTVLSLNHTKLINTKEERLQLLQTFPIDWLGVLTFDLNFANQSAEEFLTLLHRNLKCKRLILGYDSCIGKEQQSNTEALDTIGKPLGIEVIKIPPYRMDNIVVSSKAIRQFLSAGNLECAHRFLGHPYAISGKITEGSGIGGSLGFATINLPREESLIPLGVYACEIRYDSTTCQGVMNLGTAPTFGRESLYAEAHIFSFAENLYGKEVSIIPRKFLREEKKFQSKETLIRAIEKDILDAQDWFAKGSFNYEGTA

SEQ ID NO: 340 - protein, 198 aa, Chlamydia pneumoniae
YNYCSLRKGLPLRTLELTPEQIVALKPYPFLTMKPMFYIANVDESSLPDMDNDYVAAVREVAAKENSKVVPICVRIEEEIVSLPIEERLEFLMSLGLEKSGLHRLVRAAYDTLGLISYFTTGPQESRAWTVVRGSSAWEAAGEIHTDIQKGFIRAEVITFEDMIECQGRAAARELGKLHIEGRDYIVQDGDTMLFLHN

SEQ ID NO: 341 - protein, 180 aa, Chlamydia pneumoniae
MSHTECGIVGLPNVGKSGLFNALTGAQVASCNYPFCTIDPNVGIVPVIDERLEALAKISNSQKIIYADMKFVDIAGLVKGASDGAGLGNRFLSHIRETHAIAHVVRCFDDPDVTHVSGKVNPVEDIEVINLELIFSDFSSAKNIHSKLEKLAKGKREVGALLPLFDTIIAHLEKGCRYVL

SEQ ID NO: 342 - protein, 360 aa, Chlamydia pneumoniae
MGEKTEKATPKRLRDARKKGQVAKSQDFPSAVTFIVSMFTAFSLSTFFFKHLGGFLVSMLSQAPTRHDPVITLFYLKNCLMLILTASLPLLGAVAVVGVIVGFLIVGPTFSTEVFKPDIKKFNPIENIKQKFKIKTLIELIKSILKIFGAALILYITLKSKVSLIIETAGVSPIITAQIFKEIFYKAVTSIGIFFLIVAILDLVYQRHNFAKELKMEKFEVKQEFKDTEGNPEIKGRRRQIAQEIAYEDSSSQVKHASTVVSNPKDIAVAIGYMPEKYKAPWIIAMGINLRAKRILDEAEKYGIPIMRNVPLAHQLLDEGKELKFIPESTYEAIGEILLYITSLNAQNPNNKNTNQPDHL

SEQ ID NO: 343 - protein, 606 aa, Chlamydia pneumoniae
SVCGSCHSGFGDFVVGGNYVVGFIIFLIITIIQFIVVTKGAERVAEVAARFRLDAMPGKQMAIDADLRAGMIDATQARDKRAQIQKESELYGAMDGAMKFIKGDVIAGIVISLINIVGGLTIGVAMHGMDLAQAAHVYTLLSIGDGLVSQIPSLLIALTAGIVTTRVSSDKNTNLGKEISTQLVKEPRALLLAGAATLGVGFFKGFPLWSFSILALIFVALGILLLTKKSAAGKKGGGSGASTTVGAAGDGAATVGDNPDDYSLTLPVILELGKDLSKLIQHKTKSGQSFVDDMIPKMRQALYQDIGIRYPGIHVRTDSPSLEGYDYMILLNEVPYVRGKIPPHHVLTNEVEDNLSRYNLPFITYKNAAGLPSAWVSEDAKAILEKAAIKYWTPLEVIILHLSYFFHKSSQEFLGIQEVRSMIEFMERSFPDLVKEVTRLIPLQKLTEIFKRLVQEQISIKDLRTILESLSEWAQTEKDTVLLTEYVRSSLKLYISFKFSQGQSAISVYLLDPEIEEMIRGAIKQTSAGSYLALDPDSVNLILKSMRNTITPTPAGGQPPVLLTAIDVRRYVRKLIETEFPDIAVISYQEILPEIRIQPLGRIQIF

SEQ ID NO: 344 - protein, 215 aa, Chlamydia pneumoniae
YVVAHRRHMAASGGTGGLGGTQGVNLAAVEAAAAKADAAEVVASQEGSEMNMIQQSQDLTNPAAATRTKKKEEKFQTLESRKKGEAGKAEKKSESTEEKPDTDLADKYASGNSEISGQELRGLRDAIGDDASPEDILALVQEKIKDPALQSTALDYLVQTTPPSQGKLKEALIQARNTHTEQFGRTAIGAKNILFASQEYADQLNVSPSGFALCT

SEQ ID NO: 345 - protein, 240 aa, Chlamydia pneumoniae
  SITE 1...240: Xaa=unknown or other
IKRSAYPSKEYSYGAIRTNCYWCEKHLICLSRICRPTECFSFRXRSLYLEVTGDTHTCDQLLSMLQDRYTYQDMAIVSSFLMKGMATELKRQGPYVPSAQLQVLMTETRNLQAVLTSYDYFESRVPILLDSLKAEGIQTPSDLNFVKIAESYHKIINDKFPTASKVEREVRNLIGDDVDSVTGVLNLFFSALRQTSSRLFSSADKRQQLGAMIANALDAVNINNEDYPKASDFPKPYPWS

SEQ ID NO: 346 - protein, 151 aa, Chlamydia pneumoniae
KRIAMQNQYEQLLESLAPLLNTTLAPDKNNSCLIRFSDTHVPVQIEEDGNSGDLAVSTLLGTLPENVFRERIFKAALSVNGSFQSSIKGILGYGEVTQQLYLSDILSMNYLNGEKLFEYLKLFSLHAKIWMESLRTGNLPDLHVLGIYYVA

SEQ ID NO: 347 - protein, 526 aa, Chlamydia pneumoniae
VNVLKYTKHSPSAHAWKLIGTSPKHGIYLPLFSIHTKNSCGIGEFLDLIPLISWCQKQGFSVIQLLPLNDTGEDTSPYNSISSVALNPLFLSLSSLPNIDTIPEVAKKLQDMHELCSTPSVSYTQVKEKKWAFLREYYQKCCKSSLEGNSNFSEFLESERYWLYPYGTFRAIKHHMHGEPINNWPKSLTDQENFPDLTKKFHDEVLFFSYLQFLCYQQLCEVKAYADQHHVLLKGDLPILISKDSCDVWYFRDYFSSSRSVGAPPDLYNSEGQNWHLPIYNFSQLAKDDYIWWKERLRYAQNFYSVYRLDHIIGFFRLWIWDSSGRGRFIPDNPKDYIKQGTEILSTMLGASSMLPIGEDLGIIPQDVKTTLTHLGICGTRIPRWERNWESDSAFIPLKDYNPLSVTTLSTHDSDTFAQWWLNSPKEAKQFAKFLHLPFQKTLTTETQIDILKLSHESASIFHINLFNDYLALCPDLVSKNLQRERINTPGTISKKNWSYRVRPSLEELAIHKKFNGYIEKILTGL

SEQ ID NO: 348 - protein, 89 aa, Chlamydia pneumoniae
MSRKCPLTGKRPRRGYSYTLRGIAKKKKGIGLKVTGKTKRRFFPNMLTKRLWSTEENRFLKLKISASALRHIDKLGLEKVLERAKSKNF

SEQ ID NO: 349 - protein, 584 aa, Chlamydia pneumoniae
MSFLRRHISLFRSQKQLIDVFAPVSPNLELAEIHRRVIEDQGPALLFHNVIGSSFPVLTNLFGTKHRVDQLFSQAPDNLIARVAHLISSTPKLSSLWKSRDLLKRISSLGLKKARFRRFPFVSMSSVNLDHLPLLTSWPEDGGAFLTLPLVYTESPTLTTPNLGMYRVQRFNQNTMGLHFQIQKGGGMHLYEAEQKKQNLPVSVFLSGNPFLTLSAIAPLPENVSELLFATFLQGAKLLYKKTNDHPHPLLYDAEFILVGESPAGKRRPEGPFGDHFGYYSLQHDFPEFHCHKIYHRKDAIYPATVVGKPYQEDFYIGNKLQEYLSPLFPLVMPGVRRLKSYGESGFHALTAAVVKERYWRESLTTALRILGEGQLSLTKFLMVTDQEVPLDRFSVVLETILERLQPDRDLIIFSETANDTLDYTGPSLNKGSKGIFMGIGKAIRDLPHGYQGGKIHGVQDIAPFCRGCLVLETSLEDRCIKSLLHHPDLKSWPLIILADNLRETIQSEKDFLWRTFTRCAPANDLHALHSHFATHRPNYNFPFVIDALMKPSYPKEVEVDPSTKQKVSERWHAYFPNKETFYI

SEQ ID NO: 350 - protein, 354 aa, Chlamydia pneumoniae
KMNKRQKDKLKICVIISTLILVGIFARAPRGDTFKTFLKSEEAIIYSNQCNEDMRKILCDAIEHADEEIFLRIYNLSEPKIQQSLTRQAQAKNKVTIYYQKFKIPQILKQASNVTLVEQPPAGRKLMHQKALSIDKKDAWLGSANYTNLSLRLDNNLILGMHSSELCDLIITNTSGDFSIKDQTGKYFVLPQDRKIAIQAVLEKIQTAQKTIQVAMFALTHSEIIQALHQAKQRGIHVDIIIDRSHSKLTFKQLRQLNINKDFVSINTAPCTLHHKFAVIDNKTLLAGSINWSKGRFSLNDESLIILENLTKQQNQKLRMIWKDLAKHSEHPTVDDEEKEIIEKSLPVEEQEAA

SEQ ID NO: 351 - protein, 243 aa, Chlamydia pneumoniae
FISIEMLLLSRQLFSVLPSRFQDLHVYRFKESLKLLQFMTMVGGEIVVVLAEIKEEDLRARKLPVRKRREKNYLRIFRVLSRFDVMRIIRFDPYGALSAQSIAKDSRQNSPLVEKISEEIATNEAIRLALLAIGDREQEEKKQRHRYKLLGQKQAKVLLSQLRHVHLDFKKLYCDSKKKEDQEKDEKNKQKRSIKVTKKKKGISLGAAASQAIAAAAEAWVIARNKGVLETASTLFYQKDEEA

SEQ ID NO: 352 - protein, 584 aa, Chlamydia pneumoniae
  SITE 1...584: Xaa=unknown or other
IQRIIMAVSGGGGVQPSSDPGKWNPALQGEQAEGPSPLKESIFSETKQASSAAKQESLVRSGSTGMYATESQINKAKYRKAQDRSSTSPKSKLKGTFSKMRASVQGFMSGFGSRASRVSAKRASDSGEGTSLLPTEMDVALKKGNRISPEMQGFFLDASGMGGSSSDISQLSLEALKSSAFSGARSLSLSSSESSSVASFGSFQKAIEPMSEEKVNAWTVARLGGEMVSSLLDPNVETSSLVRRAMATGNEGMIDLSDLGQEEXSTAMTSPRAVEGKVKVSSSDSPEANPTGIPNSNTLERAEKEAEKQESREQLSEDQMMLARAMAGLLTGAAPQEVLSNSVWSGPSTVFPPPKFSGTLPTQRSGDKSKHKSPGIEKSTNHTNFSPLREGTVKSAEVKSLPHPESMYRFPKDSIVSREEPEAVVKESTAFKNPENSSQNFLPIAVESVFPKESGTGGALGSDAVSSSYHFLAQRGVSLLAPLPRATDDYKEKLEAHKGPGGPPDPLIYQYRNVAVEPPIVLRSPQPFSGSSRLSVQGKPEAASVHDDGGGGNSGGFSGDQRRGSSGQKASRQEKKGKKLSTDI

SEQ ID NO: 353 - protein, 271 aa, Chlamydia pneumoniae
EIGMLLRGIPAAEKILQRLKEEISQSPTSPGLAVVLIGNDPASEVYVGMKVKKATEIGIISKAHKLPSDSTLSSVLKLIERLNQDPSIHGILVQLPLPKHLDSEVILQAISPDKDVDGLHPVNMGKLLLGNFDGLLPCTPAGIIELLNYYEIPLRGRHAAIVGRSNIVGKPLAALMMQKHPQTNCTVTVLHSQSENLPEILKTADIIIAALGAPLFIKETMVAPHAVIVDVGTTRVPADNAKGYTLLGDVDFNNVVTKCAESLQFLEALVP

SEQ ID NO: 354 - protein, 300 aa, Chlamydia pneumoniae
RRWSHDCRYAHEQYMAMLPKFFLVLLCLGLCSCSQKTTTIEGEQMTIFYRIVLGTSLSAKEKASLSQQIDRCFHKIDSIYNNWNPYSELSIINRAPADVPITLSVELSEFLDQVDTLYKLSEGRFDPTVGPLKTLWLLHLKSQTLPPKDVWEQHYKDMGWQHLEFQSNTKTLIKKNPHVQIDLCGVVKGYAVDCLNEICNTFCPNNYVEWGGEIKTSGHHPSGRPWRIFSEAAGTILDIDDMAIATSGNHIQKWCVEGKIYTHILDTRTGKPLELSSYPIQSVSVVHPTAHTPTLLPQSS

SEQ ID NO: 355 - protein, 165 aa, Chlamydia pneumoniae
LLYWFLSPIMGEDLMAQKEIVSNRKALRNYEVIETLEAGIVLTGTEIKSLRDHGGNLGDAYVIVSKGEGWLLNASIAPYRFGNIYNHEERRKRKLLLHRYELRKLEGKIAQKGMTLIPLGMFLSRGYVKVRLGCCRGKKAYDKRRTIIEREKEREVAAAMKRRHH

SEQ ID NO: 356 - protein, 135 aa, Chlamydia pneumoniae
ENMKFVVSRNELGNLIKKIQSVVPQNTPIPVLTHVLIETYNDELVFTATDLTVSTRCVTKAKVYEKGAISIPSKRFFQLVKELTEANLEISSSAGEMAQITSGSSYFAYSAWKKKTSPCSLIYKMLCVFPCLQSS

SEQ ID NO: 357 - protein, 303 aa, Chlamydia pneumoniae
ERRYFHSLQEIFSISKRINRGKFRNFLFSRGNGTNHLGIFIFRLLSMEKEDFPMLPDIQNALRFSLPAEQLKTMLQRTSFAVSREESRYVLTGVLLAIANGVATIVGTDGKRLAKIDAEVTLDKSFSGEYIIPIKAVEEIIKMCSDEGEATIFLDQDKIAVECDNTLLITKLLSGEFPDFSPVISTESNVKLDLHREELITLLKQVALFTNESSHSVKFSFLPGELTLTANCTKVGEGKVSMAVNYSGELLEIAFNPFFFLDILKHSKDELVSLGISDSYNPGIITDSASGLFVIMPMRLHDD

SEQ ID NO: 358 - protein, 218 aa, Chlamydia pneumoniae
PLYPLLIVLSSRSSAEKCSLKKQANLNRGLWDEQLVKHGTYLSIQRFLCSQKLSDLSKELWSNNLKEQLALKFKSSLIKNSDISETAVAEEFHKQLSISLPRDLEWGSTSVGPHREDFLLTMNQMPVSQFSSEGQKHSLLAILRLAECLYLKQSHHVSPLVCLDDIHAGLDNERVGQLLDPAPTLGQTLITSTHMHGELPKTSLVLSIENAQVSEQII

SEQ ID NO: 359 - protein, 127 aa, Chlamydia pneumoniae
HMKKFLLTILFLAVGNPLFSETSVIQTLPSGIGGLKETSKQKESVVCVHAFLRSYTSLKPIARVLEKEHYDVFIWNYETRKFTLEKHAEHLNRLLKKIAELKPGVPINFVTHSIGGVIVRALAEKNS

SEQ ID NO: 360 - protein, 244 aa, Chlamydia pneumoniae
LILLEESLFVRLLKKIAELKPGVPINFVTHSIGGVIVRVALAHPDCPEEAKKGKAILMAPPNAGSTLARRYRCVKFVQFVFGGKLGRQLLTYCPTKMLNVGKLPSSLDVLILSGNRHSKFLPFRLPYENDGKVCTIETKLDTPHKAYVIHTSHTYIITNRKSLYLMKEFLKEGNTTPIIEHVPEAALEQTVMEDKQKNSRLKPYPNQDIYVIHCFGSRPYNLYGFPKKWSLNQKNEINPEKLEK

SEQ ID NO: 361 - protein, 621 aa, Chlamydia pneumoniae
MTIIYFILAALALGILVLIHELGHLVVAKAVGMAVESFSIGFGPALFKKRIGGIEYRIGCIPFGGYVRIRGMERTKEKGEKGKIDSVYDIPQGFFSKSPWKRILVLVAGPLANILLAVLAFSILYMNGGRSKNYSDCSKVVGWVHPVLQAEGLLPGDEILTCNGKPYVGDKDMLTTSLLEGHLNLEIKRPGYLTVPSKEFAIDVEFDPTKFGVPCSGASYLLYGNQVPLTKNSPMENSELRPNDRFVWMDGTLLFSMAQISQILNESYAFVKVARNDKIFFSRQPRVLASVLHYTPYLRNELIDTQYEAGLKGKWSSLYTLPYVINSYGYIEGELTAIDPESPLPQPQERLQLGDRILAIDGTPVSGSVDILRLVQNHRVSIIVQQMSPQELEEVNSRDADKRFIASYHSEDLLQILNHLGESHPVEVAGPYRLLDPVQPRPWIDVYSSESLDKQLEVAKKIKNKDKQRYYLERLDAEKQKPSLGISLKDLKVRYNPSPVVMLSNITKESLITLKALVTGHLSPQWLSGPVGIVQVLHTGWSVGFSEVLFWIGLISMNLAVLNLLPIPVLDGGYILLCLWEIVTRRRLNMKIVERILVPFTFLLIIFFIFLTFQDLFRFFG

SEQ ID NO: 362 - protein, 340 aa, Chlamydia pneumoniae
SKVIFQQLQEFAPLAAAVYNEEVYNEACQRFPHMQFFLGQEGLTQLCIMDTVTTVVAASSGIEALPAILESMKKGKALALANKEILVCAGELVSKTAKENGIKVLPIDSEHNALYQCLEGRTIEGIKKLILTASGGPLLNKSLEELSCVTKQDVLNHPIWNMGSKVTVDSSTLVNKGLEIIEAYWLFGLENVEILAVIHPQSLIHGMVEFLDGSVISIMNPPDMLFPIQYALTAPERFASPRDGMDFSKKQTLEFFPVDEERFPSIRLAQQVLEKQGSSGSFFNAANEVLVRRFLCEEISWCDILRKLTTLMECHKVYACHSLEDILEVDGEARALAQEI

SEQ ID NO: 363 - protein, 329 aa, Chlamydia pneumoniae
  SITE 1...329: Xaa=unknown or other
KKGSLMALGPSPYYGVSFFQFFSVFFSRLFSGSLFTGSLYIDDIQIIVFLAISCSGAFAGTFLVLRKMAMYANAVSHTVLFGLVCVCLFTHQLTTLSLGTLTLAAMATAMLTGFLIYFIRNTFKVSEESSTALVFSLLFSLSLVLLVFMTKNAHIGTELVLGNADSLTKEDIFPVTIVILANAVITIFAFRSLVCSSFDSVFASSLGIPIRLVDYLIIFQLSACLVGAFKAVGVLMALAFLIIPSLIAKVIAKSIRSLMAWSLVFSIXTAFLAPASSRAILSAYDLGLSTSGISVVFLTMMYIVVKFISYFRGYFSKNFEKISEKSSQY

SEQ ID NO: 364 - protein, 391 aa, Chlamydia pneumoniae
WRNMFSHCKLLFFGLCCLGVLLRYLVMGIIVFLGKVCKLHKDSALCFVLVVFFAIGVILASYVKESSPTLYNRINAYLYGQAATLGFLEATLAAIVFCASLFALWWWYRQIVVTTFDKDFAVTCGLKTVLYEALSLIFISLVIVSGVRSVGIVLISAMFVAPSLGARQLSDRLSTILILSAFFGGISGALGSYISVAFTCRAIIGQQAVPVTLPTGPLVVICAGLLAGLCLLFSPKSGWVIRFVRRKHFSFSKDQEHLLKVFWHISHNRLENISVRDFVCSYKYQEYFGPKPFPRWRVQILEWRGYVKKEQDYYRLTKKGRSEALRLVRAHRLWESYLVNSLDFSKESVHELAEEIEHVLTEELDHTLTEILNDPCYDPHRQIIPNKKKEV

SEQ ID NO: 365 - protein, 113 aa, Chlamydia pneumoniae
TFGTNPEALSRKTIWIVLIMLSCVFSDTIFLSSFLAVTLICMTTALWGTILLISKQPLLSESLSHASYPGLLVGALMAQYVFSLQASIFWIVLFGCAASVFGYGDHCFLRESM

SEQ ID NO: 366 - protein, 259 aa, Chlamydia pneumoniae
LNVKDETFWSVHNLCVNYEHAAVLYHISFSLGKGSLTAILGPNGAGKSTLLKASLGLIKPSSGTVYFFNQKFKKVRQRIAYMPQRASVDWDFPMTVLDLALMGCYSYKGMWGRISSDDRREAFHILERVGLESVADRQIGQLSGGQQQRAFLARALMQKADLYLMDELFSAIDMASFKTSVGVLQELRDQGKTIVVVHHDLSHVRQLFDHVVLLNKRLICCGPTDECLNGDTIFQTYGCEIELLEQTLKLSRGKQFGSC

SEQ ID NO: 367 - protein, 336 aa, Chlamydia pneumoniae
WILKNASREMDAKMGYIFKVMRWIFCFVACGITFGCTNSGFQNANSRPCILSMNRMIHDCVERVVGNRLATAVLIKGSLDPHAYEMVKGDKDKIAGSAVIFCNGLGLEHTLSLRKHLENNPNSVKLGERLIARGAFVPLEEDGICDPHIWMDLSIWKEAVIEITEVLIEKFPEWSAEFKANSEELVCEMSILDSWAKQCLSTIPENLRYLVSGHNAFSYFTRRYLATPEEVASGAWRSRCISPEGLSPEAQISVRDIMAVVDYINEHDVSVVFPEDTLNQDALKKIVSSLKKSHLVRLAQKPLYSDNVDDNYFSTFKHNVCLITEELGGVALECQR

SEQ ID NO: 368 - protein, 172 aa, Chlamydia pneumoniae
KVGFMAVEQSHIKEEIEKLIGKAIKRVCGNKENDLCRYLPGPSGGYMHHFTLKKMKSAAPEQLLKMLKTFILESETPRTINPKPRAPRGSKKRRDFINFTKTDIERVLELARQVGDKDLLARFSPKKPLTSLKRELIRSIRNGIVSVELWNAYVEAVKAVSSPNLEVTSPFV

SEQ ID NO: 369 - protein, 524 aa, Chlamydia pneumoniae
KIKVFQRVNMTKTEEKPFGKLRSFLWPIHTHELKKVLPMFLMFFCITFNYTVLRDTKDTLIVGAPGSGAEAIPFIKFWLVVPCAIIFMLIYAKLSNILSKQALFYAVGTPFLIFFALFPTVIYPLRDVLHPTEFADRLQAILPPGLLGLVAILRNWTFAAFYVLAELWGSVMLSLMFWGFANEITKIHEAKRFYALFGIGANISLLASGRAIVWASKLRASVSEGVDPWGISLRLLMAMTIVSGLVLMASYWWINKNVLTDPRFYNPEEMQKGKKGAKPKMNMKDSFLYLARSPYILLLALLVIAYGICINLIEVTWKSQLKLQYPNMNDYSEFMGNFSFWTGVVSVLIMLFVGGNVIRKFGWLTGALVTPVMVLLTGIVFFALVIFRNQASGLVAMFGTTPLMLAVVVGAIQNILSKSTKYALFDSTKEMAYIPLDQEQKVKGKAAIDVVAARFGKSGGALIQQGLLVICGSIGAMTPYLAVILLFIIAIWLVSATKLNKLFLAQSALKEQEVAQEDSAPASS

SEQ ID NO: 370 - protein, 448 aa, Chlamydia pneumoniae
LPFHEFVRFFQSKKVIITVRHSGCTMKCSPLTLVPHIFLKNDCECHRSCSLKIRTIARLILGLVLALVSALSFVFLAAPISYAIGGTLALAAIVILIITLVVALLAKSKVLPIPNELQKIIYNRYPKEVFYFVKTHSLTVNELKIFINCWKSGTDLPPNLHKKAEAFGIDILKSIDLTLFPEFEEILLQNCPLYWLSHFIDKTESVAGEIGLNKTQKVYGLLGPLAFHKGYTTIFHSYTRPLLTLISESQYKFLYSKASKNQWDSPSVKKTCEEIFKELPHNMIFRKDVQGISQFLFLFFSHGITWEQAQMIQLINPDNWKMLCQFDKAGGHCSMATFGGFLNTETNMFDPVSSNYEPTVNFMTWKELKVLLEKVKESPMHPASALVQKICVNTTHHQNLLKRWQFVRNTSSQWTSSLPQYAFHAQTYKLEKKNRKQSPYTIFPIRGV

SEQ ID NO: 371 - protein, 365 aa, Chlamydia pneumoniae
IKEFNHYSYCYQCHLTLRTLIAFLCVAAPVSYILSGALLGLGLLIALIGVILGIKKITPMISSKEQVFPQELVNRIRAHYPKFVSDFVSEAKPNLKDLISFIDLLNQLHSEVGSSTNYNVSEELQQKIDTFEGIARLKNEVRTASLKRLESAASSRPLFPSLPKILQKVFPFFWLGEFISAGSKVVELHRVKKIGGSLEEDLSDYIKPEMLPTYWLIPLDFRPTNSSILNLHTLVLARVLTRDVFQHLKYAALNGEWNLNHSDLNTMKQQLFAKYHAAYQSYKHLSQPSLQEDEFYNLLLCIFKHRYSWKQMSLIKTVPADLWENLCCLTLDHTGRPQDMEFASLIGTLYTQGLIHKESEHFFLH

SEQ ID NO: 372 - protein, 455 aa, Chlamydia pneumoniae
IRDFYLHIIYTAFNRSISKELAMSMTIVPHALFKNHCECHSTFPLSSRTIVRIAIASLFCIGALAALGCLAPPVSYIVGSVLAFIAFVILSLVILALIFGEKKLPPTPRIIPDRFTHVIDEAYGLSISAFVREQQVTLAEFRQFSTALLCNISPEEKIKQLPSELRSKVESFGISRLAGDLEKNNWPIFEDLLSQTCPLYWLQKFISAGDPQVCRDLGVPRECYGYYWLGPLGYSTAKATIFCKETHHILQQLTKEDVLLLKNKALQEKWDTDEVKAIVERIYTTYTARGTLKTEAGGLTKETISKELLLLSLHGYSFDQLQLITQLPRDAWDWLCFVDNSTAYNLQLCALVGALSSQNLLDESSIDFDVNLGLYVIQDLKEAVQAFSASDEPKKELGKFLLRHLSSVSKRLESVLRQGLHRIALEHGNARARVYDVNFVTGARIHRKTSIFFKD

SEQ ID NO: 373 - protein, 291 aa, Chlamydia pneumoniae
YSSHNGASMVNIQPVYRNTQVNYSQATQFSVCQPALSLIIVSVVAAVLAIVALVCSQSLLSIELGTALVLVSLILFASAMFMIYKMRQEPKELLIPKKIMELIQEHYPSIVVDFIRDQEVSIYEIHHLISILNKTNVFDKAPVYLQEKLLQFGIEKFKDVHPSKLPNFEEILLQHCPLHWLGRLVYPMVSDVTPGTYGYYWCGPLGLYENAPSLFERRSLLLLKKISFGEFALLEDGLKKNTWSSSELVQIRQNLFTRYYADKEEVDEAELNADYEQFDSLLHLIFSHKLS

SEQ ID NO: 374 - protein, 607 aa, Chlamydia pneumoniae
TLQYILKEYKIENIRNFSIIAHIDHGKSTIADRLLESTSTVEEREMREQLLDSMDLERERGITIKAHPVTMTYLYEGEVYQLNLIDTPGHVDFSYEVSRSLSACEGALLIVDAAQGVQAQSLANVYLALERDLEIIPVLNKIDLPAADPVRIAQQIEDYIGLDTTNIIACSAKTGQGIPAILKAIIDLVPPPKAPAETELKALVFDSHYDPYVGIMVYVRIISGELKKGDRITFMAAKGSSFEVLGIGAFLPKATFIEGSLRPGQVGFFIANLKKVKDVKIGDTVTKTKHPAKTPLEGFKEINPVVFAGIYPIDSSDFDTLKDALGRLQLNDSALTIEQESSHSLGFGFRCGFLGLLHLEIIFERIIREFDLDIIATAPSVIYKVVLKNGKVLDIDNPSGYPDPAIIEHVEEPWVHVNIITPQEYLSNIMNLCLDKRGICVKTEMLDQHRLVLAYELPLNEIVSDFNDKLKSVTKGYGSFDYRLGDYRKGSIIKLEVLINEEPIDAFSCLVHRDKAESRGRSICEKLVDVIPQQLFKIPIQAAINKKVIARETIRALSKNVTAKCYGGDITRKRKLWEKQKKGKKRMKEFGKVSIPNTAFIEVLKLD

SEQ ID NO: 375 - protein, 332 aa, Chlamydia pneumoniae
GVAISGSYFSINSSKSTGPSLLFLGRNWRCRPLCKGCSQWYRIRRYPVDMRTYGILRDFLKLSATAVATILKEWNTLELESYLIRIASEVLALKDPEGIPVIDTILDVVGQKGTGKWTAIDALNSGVPLSLIIGAVLARFLSSWKEIREQAARNYPGTPLIFEMPHDPSVFIQDVFHALYASKIISYAQGFMLLGEASKEYNWGLDLGEIALMWRGGCIIQSAFLDVIHKGFAANPENTSLIFQEYFRGALRHAEMGWRRTVVTAIGAGLPIPCLAAAITFYDGYRTASSSMSLAQGLRDYFGAHTYERNDRPRGEFYHTDWVHTKTTERVK

SEQ ID NO: 376 - protein, 204 aa, Chlamydia pneumoniae
VALQTNIGLIGLAVMGKNLVLNMIDHGFSVSVYNRTPEKTRDFLKEYPNHRELVGFESLEDFVNSLERPRKIMLMIQAGKPVDQSIHALLPFLEPGDVIIDGGNSYFKDSERRCKELQEKGILFLGVGISGGEEGARHGPSIMPGGNPEAWPLVAPIFQSIAAKVQGRPCCSWVGTGGAGHYVKAVHNGIEYGDIQLICELTVS

SEQ ID NO: 377 - protein, 422 aa, Chlamydia pneumoniae
LAILNYVRSLMQSWLQSLQERNILENFTAGLESVEGPIAAYLGFDPTAPALHIGHWIGICFLKRLAALGITPIALVGGATGMVGDPSGKQSERSLLQTSEVFDNSQKITACLQRYLPGVTLVNNADWLQEISLIDFLRDIGKHFRLGQMLVKDTIKQRVHSDEGISYTEFSYLILQSYDFYHLFKNYGTILQCGGSDQWGNITSGIDFIRRKGLGQAYGLTYPLLTNAQGKKIGKTESGTVWLDSDLTSPFELYQYLLRLPDDTIPKIARTLTLLSNEEIQDIDRRVQTDPVAVKEFVAQDILSAIHGDLGLEEALSVTRSMHPGNLSSLSEKDFHELFAGGMGASLDKSEVLGKRWLDLFLVLGLCKSKGEIRRLIEQKGVYINNVPIANEHSVCEEQDICYGHYVLLAQGKKRKLVLYLN

SEQ ID NO: 378 - protein, 103 aa, Chlamydia pneumoniae
VAMSTSPIGVPSMLNAATSLNATTSKAPLPTSTLAERIKEWLPRILLLIVGAIFTIAGCIVMALTKQILYGLLCVVGGLLLALGLLLKPENCIYRNAESLREA

SEQ ID NO: 379 - protein, 291 aa, Chlamydia pneumoniae
LDKKKFVKTQQTQNIIEVWNFYWETQEIEYRDSLIEFYLPLVKSVVHRLISGMPSHVKTEDLYASGVEGLVRAVERYNPERSRRFEGYAVFLIKAAIIDDLRKQDWVPRSVHQKANKLSGAMDSLRQSLGKEPTDLELCEYLNISQQELSGWFVSARPALIVSLNEEWPSQSDEGAGMALEERIPDERAETGYDVVDKQEFSLCLANAIQELEEKERKVMALYYYEELVLKEIGKVLGVSESRVSQIHSKALLKLRADSLHFDKYSSQVLRAVLELGEALLRHRVIRKEFV

SEQ ID NO: 380 - protein, 544 aa, Chlamydia pneumoniae
  SITE 1...544: Xaa=unknown or other
FCIVFTNGLLGLYLKFKQFSEVFPPFFLYLCLLRLGLNLASTRWIVSSGTASSLIVSLGSFFSLGSLWAATFACLLLFFVNFLMVSKGSERIAEVRSRFFLEALPAKQMALDSDLVSGRASYKAVKKQKNALIEEGDFFSAMEGVFRFVKGDAIISCILLLVNVVSVTCLYYTSGYALEQMWFTVLGDALVSQVPALLTSCAAATLISKIDKEESLLNYLFEYYKQLRQHFRVVSLLIFSLCCIPSSPKFPIVLLASLLWLAYRKEEPASEDSCIERAFSYVEGACPKEQESQFYQVYRAASEEVFEDLGVRLPVLTSLRIEERPWLRVFGQNVYLDEMTPEAVLPFLRNIAHEALNAEVVQKYLEESERVFGIAVEDIVPKKISLSSLVVLSRLLVRERVSLKLXPKILEAVAVYQNSGDSLEILAEKVRKSLGYWIGRSLWDQKQTLEVITIDFHVEELINSSYSKSNPVMQENVIRRVDSLLERSVFKDFRAIVTSCETRFEMKKMLDPHFPDLLVLSHDELPKEIPISFLGIVSDEVLVP

SEQ ID NO: 381 - protein, 91 aa, Chlamydia pneumoniae
MAKLVITSDDEQQEFELEDNSEIAEPCESMGIPFACTEGVCGTCVIEVLEGRENLSEFTEPEYDFLGEPEDSNERLACQCRIKGGCVKVTF

SEQ ID NO: 382 - protein, 191 aa, Chlamydia pneumoniae
FKGTQVNSLIMATISPISLTVDHPLVDTKKKSCSNFDKIQSRILLITAIFAVLVTIGTLLIGLLLNIPVIYFLTGISFIAVVLSNFILYKRATTLLKPRACGKHKEIKPKRVSTNLQYSSISIAINRSKENWEHQPKDLQNLPAPSALLTDNPYEIWKAKHSLFSLVSLLPGGNPKTSLKFKLPKIYERLC

SEQ ID NO: 383 - protein, 158 aa, Chlamydia pneumoniae
LKKPRKMRLYPPYVDTTPSPKSLLNEAIQETRVEINTELPAGDSGERLYWQPDFRGRVFLPQIPTTPEAIYQYYYALYVTYIQTAINTNTQIIQIPLYSLREHLYSRELPPQSRMQQSLAMITAVKYMAELHPEYPLTIACVERSLAQLPQESIEDLS

SEQ ID NO: 384 - protein, 155 aa, Chlamydia pneumoniae
MGYLPVSATDVLFESPAAPLINSANTQNQKLIELKGKQQAESSPRTITSVILEVLLVIGCCLIVLSLLAIRPALQFTLETGHPAAIAVLAVSGTILLVAVIILFCFLAAVPFAAKKTYKYVKTVDDYASWHSHQQTPTLGTIFSGIVYAESQAQL

SEQ ID NO: 385 - protein, 253 aa, Chlamydia pneumoniae
SFPLNRYFMTKTTSIPDVHENQSHLSVDERLISESPVLTKKEVIAKIIKLTALILALAIAVGTAVVAGVLGMPLMAIATGAALLAAVVLSCLLLRRREPSKPTEELLGPQKHVPKDIAAQVQPSVPLDYQKLLRNEWTLVNTLSEINISWTLQDPNQRYYVWEHQGAPITLVATTGDIAKPRLKTSGRVMIVNAANSNMQSGGAGTNAALSAATHPTCWNNTRTSGGKINTGKGLSVGECRSAPWINRDWTNK

SEQ ID NO: 386 - protein, 114 aa, Chlamydia pneumoniae
TLAKDYLWVNAAQHPGSIETGRINDTNPGEAHFLAQLLGPKYEGELKAHPEKLSNVIKKAYLNCFDEALNNQATVVQVPLISSSIYSPGGKLELEPVNQTKPNSSAYKLYHIRT

SEQ ID NO: 387 - protein, 406 aa, Chlamydia pneumoniae
NIMTDSNPLPSYTDASLYRTPAKHSYPIRLPLNRTDRIEKILKIVTLTLALACALGFSIAAGILAMPIFSAVVVITLAIAAVSLYSLLKKPKLYEILPQIEPESEQSSLSPSPQPPEQQDLPLQIDPLPDPESLPEVSLADLTTPPEELTAITVTPGYEALLEQNWDLLPSLAAVDPSFTTETPQQPCFIWKLKDSKLIFISTSGDIAVPRIKTQGRVMIVNAANENISREGGGTNKALSLATSLQCWNASRLPRAHSRSGSQLQPGECRSAKWENSDHTSNDHVPGKAHFLAQLLGPEAAKCNNDPKQAFEVSKKAFHNLFQEAEIIGVDVIQLPLIGCNLFAPSRLLNLGKTRAEWIEAIKLALITSLQDFGWEQDNQEEQKIIILTDKDQPPIIPPRFDLTTP

SEQ ID NO: 388 - protein, 386 aa, Chlamydia pneumoniae
KRIFFKLFVFYLKSFMSTTEPNLTNVNLTMLISSESMPTQLASHKLKGLDLVAFILIIGIAVSSGTAAIILGIPLLFILTALAVLAFSILLYFLLREPKSPISVTHQPTPIIKDTDLPPVPPLALTPVPTEAVLEEPPLPSPRTHQTLLQENWDRIPDLQANTDMPFIAADNQTGYAWHLKNSNLTLISTLGPIEKPRYKTQGIVMIVNAATPNMANNVKGTSLALAKATSVRCWENSKKSPDPLRSKQPLQLGECRSAKWENLNGTTNAGKAGLPQFLGQLLGPKASDYNYNPNDAFTFCRQAYLNCLNEAKRRKTTVVQLPLLSSHFPGSPKDEETTSLRLQWIDGVKLALIDALQTFGSEAENQNQPWVIILTTLARHPLITP

SEQ ID NO: 389 - protein, 621 aa, Chlamydia pneumoniae
NSEIFEIFMTLITPAINSSRRKTHTVRIGNLYIGSDHSIKTQSMTTTLTTDIDSTVEQIYALAEHNCDIVRVTVQGIKEAQACEKIKERLIALGLNIPLVADIHFFPQAAMLVADFADKVRINPGNYIDKRNMFKGTKIYTEASYAQSLLRLEEKFAPLVEKCKRLGKAMRIGVNHGSLSERIMQKYGDTIEGMVASAIEYIAVCEKLNYRDVVFSMKSSNPKIMVTAYRQLAKDLDARGWLYPLHLGVTEAGMGVDGIIKSAVGIGTLLAEGLGDTIRCSLTGCPTTEIPVCDSLLRHTKIYLDLPEKKNPFSLQHSENFVSAAEKPAKTTLWGDVYGVFLKLYPHHLTDFTPEELLEHLGVNPVTKEKAFTTPEGVVVPPELKDAPITDVLREHFLVFHHHQVPCLYEHNEEIWDSPAVHQAPFVHFHASDPFIHTSRDFFEKQGHQGKPTKLVFSRDFDNKEEAAISIATEFGALLLDGLGEAVVLDLPNLPLQDVLKIAFGTLQNAGVRLVKTEYISCPMCGRTLFDLEEVTTRIRKRTQHLPGLKIAIMGCIVNGPGEMADADFGFVGSKTGMIDLYVKHTCVKAHIPMEDAEEELIRLLQEHGVWKDPEETKLTV

SEQ ID NO: 390 - protein, 251 aa, Chlamydia pneumoniae
VDSMTLSFHTHPLNYWTFEEFDGLPIRHGVFSKQKDAEGTVFAAKNPEIASALQSPKYCDLHQRHGTSVRCVTPTSPTYQPADGLCTQSPLLSLHIRHSDCQAAIFYDREHHAIANVHSGWRGLLGNIYAVTVGTMKKLFHTKPQDLFVAIGPSIGPDYAIYPDYATLFPRSFLPFMNPKNHFDLRAIARKQLTNLGISKDRIFISDLCTYTEHDAFFSSRYLAHHPDPNLTGQHSKNRNNVTAVLLLPRD

SEQ ID NO: 391 - protein, 168 aa, Chlamydia pneumoniae
  SITE 1...168: Xaa=unknown or other
RLSMKLGASTNHKVHEPVKPKKAKLAEIEAXKTQATEGTLRSKSLALQIARAVLYILFAALMLAAGITFVTFEALGFPLIQAYSIAGIITLVGLAIGLVLLILSLLPKEDEEADALSRNALLPLTIIVIEQQPITPKPEIPYSYLTKLALLTSLFLTLRRSSSQRKTH

SEQ ID NO: 392 - protein, 205 aa, Chlamydia pneumoniae
FKVVTAKAPNLTEIRDHGARVPSLFLLSPETSHWKGDKEVSAPLKQLQDLLGEEQWEAMKTKMNSRKKAGQWAIFNSPTPGVSSTLVLAWTPWGYYDKDVQDILERKDPMSSSLSEKDSKEFLKNLFVDLLENGFTSVHIHAEEAFTPLDHTGKPHFKRDNVYLPGKLLGALNEAAVQANVSADTQFTLFLTQDECNPFHDKKRG

SEQ ID NO: 393 - protein, 147 aa, Chlamydia pneumoniae
WRGDCYRHYYDISIAVGIDRGLVVPVIRDCDKLSNGEIEQKLADLSLRAREGLLAIAELEGGGFTITNGGVYGSLLSTPIINPPQVGILGMHKIEKRPVVLDNEIVIADMMYVALSYDHRLIDGKEAVGFLVKVKEGLENPASLLDL

SEQ ID NO: 394 - protein, 233 aa, Chlamydia pneumoniae
IMTTEVRIPNIAESISEVTVASLLVTEGALIQENQGLLEIESDKVNQLIYAPVSGRIFWEVSEGDVVPVGGVVGKIEPAGEGEELGDSQSKETIEAEIICFPQSGVRQSPPENKTFIPLRDQMDQGSQGLSAGDRGETRERMTSIRKTISRRLLSALHESAMLTTFNEVYMTPLFHLRKEKQEEFLSRYGVKLGFMSFFVKAVLEALKAYPRVNAYIDGEEIVTVTIMTFLLL

SEQ ID NO: 395 - protein, 915 aa, Chlamydia pneumoniae
IVFIEFNYFMDSEFVGQVYSSDMDWIESMYQRFMNHETLDPSWKYFFEGYQLGQAASPSEASTKISGNETIAMLQEQKSQFLCTIYRYYGYLQSQISTLAPTTDSRFIQEKIAKIDLDEQVPSAGLLPKAQVSVRELIEALKKCYCGSLTLETLTCTPELQEFVWNLMEKRQVERFAEQLLRSYKDLCKATFFEEFLQIKFTGQKRFSLEGGETLVPMLEHLVHYGSALGISNYVLGMAHRGRLNVLTNVLGKPYRYVFMEFEDDPAARGLESVGDVKYHKGYVLKSHQKDRETTFVMLPNASHLESVDPIVEGVVAALQHQGHAGKEQSSLAILVHGDAAFSGQGVVYETLQLSRVPGYSTEGTLHIVVNNYIGFTAVPRESRSTPYCTDIAKMLGIPVFRVNSEDVVACIEAIEYALQVRERFSCDVIIDLCCYRKYGHNESDDPSVTAPLLYDQIKRKKSIRELFRQYLLEGQFADISEETLASIEKEIQESLNREFQVLKGTDPEPFPKKECHHCDRLNNGELILHDCDVSLDRETLFHMSSRLCGFPDNFHPHPKIKTLLEKRMKMAEGGVGYDWAMAEELAFASLLIEGYNLRLSGQDSIRGTFSQRHLVWSDTVTGDTYSPLYHLSAEQGSVEMYNSPLSEYAILGFEYGYAQQALKTLVLWEAQFGDFANGAQIIFDQYISSGIQKWDLHSDIVLLLPHGYEGQGPEHSSSRIERYLQLAANWNFQVVLPSTPVQYFRILREHAKRDLSLPLVIFTPKLLLRYPQCVSSIEEFTEPGGFRAILEDADPNYDASILVLCSGKIYYDYAEMLPQDRRKDFSCLRIESLYPLALEDLVSLIDKYSHLKHFVWLQEESKNMGAYDYMFMALQDILPEKLLYIGRPRSSSTASGSAKSVVKSWSRVWKPSFL

SEQ ID NO: 396 - protein, 394 aa, Chlamydia pneumoniae
MKTLSAIAIAGDAVVSLIPMLMNGKAPLALYIHIPFCTKKCRYCSFYTIPYKSESVSLYCNAVIQEGLRKLAPIQETHFIETVFFGGGTPSLVSPLDLKRILKELAPHAREITLEANPENLTVSYLRQLQETPINRISVGVQTFDDSILQLLGRTHSSSAAITALQECQNHGFSNLSIDLIYGLPTQSLEIFLSDLHQALTLPITHISLYNLTIDPHTSFYKHRKILVPTIAQEEILAEMSLLAENLLLSQGFQRYELASYAKPDYPAKHNLYYWTDRPFLGLGVSASQYLHGERSKNYSHISHYLRAVRKNLPTQETSEILPKKERIKEALALRLRLLEGADLAEFPSTLISMLTQDVKLQNLFSVHGQCLALNRQGRLFHDTIAEEIMGYSF

SEQ ID NO: 397 - protein, 600 aa, Chlamydia pneumoniae
SLPNKFRALMTAPTESRSSPPTLLEETEPLSPNPIPADIQIPRITISPPSLDVSTVASSAEDISVFIAGGPRSSSSASVASDVYELVCLCGGDEDPEPPDSEVRTLYVNGSWQTHQEAVQELLYISEVRGEAVRLLYNDGSGMSPWPISPCRTLPTLDHPLCQALLTVWEQFFSAPENQNREFLVIFYGDASPYIQQALTQSRHSPRIVVVGISPTVFIQGDFRVHNYRVSGDFFSSLDCRGTRAENTTILPYSSGLEGVFLPSIRCPSFTWAVRFGEQCLVANRGEDVEDRGGLSQDAERSQLPHSERDLAVVIDSTDPSSMSRLVEWLNQGSPSSDMEINPYPQRCPDVALSALYAISRVSGLAQEWILASVHEGLDLQICYSLILMHTTFAVRYFFLLFTNYPQSRERFRTARIVAQSLYLPSILVLVFDCGNVLRKLWMPQEILRAIFISASTISGSIVFVECTRWMGRGLRHRVQQFVQQRVIGSGLPVGTVRASYRDRAGFIIGFLQTVHGGLYLPVSIMVLNQIAIQVPRILVRPNNTAVYDLHNKSAEENWSSGDVLAVGQTLNFILCAFVLFVNLWFFVKSVLRHSRRRRR

SEQ ID NO: 398 - protein, 115 aa, Chlamydia pneumoniae
RVRTSESGGSGSSSPPQRQTNSYTSEATEADEELLGPPAMKTEISSAEDATVDTSREGGDIVILGIWISAGIGFGDRGSVSSSSVGGEDRDSVGAVINALNLFGKDYKISIDNTQ

SEQ ID NO: 399 - protein, 239 aa, Chlamydia pneumoniae
PVTLYLLPNTLGTRAVETLPSVIGELVHRLDGLIVESDRGGRAFLSLWKIPEVHKFPLAILSKHARLPKAWDFYLEPIVKHGENWGLISDAGLPCIADPGASLVRRARALGIPVQAFSGPCSITLALMLSGLPSQSFTFLGYLPQSPKERVKSIKKAATSKEVSTSVCIETPYRNVYTFESLLDTLPSYAELCVASDLSGPSELVLTRQVQSWRTTEDLGSVKQSITKVPTIFLFHIPN

SEQ ID NO: 400 - protein, 98 aa, Chlamydia pneumoniae
GVSIHTEVDTSLEVAAFFIDFTRSLGLCGRYPKNVKLWEGKPESMSANVIEQGPEKACTGIPKARARRTKLAPGSAIQGRPASEISPQFSPCFTIGSR

SEQ ID NO: 401 - protein, 321 aa, Chlamydia pneumoniae
VQDTTFLTLPMQKSLTSFDDFSQAYAEKVPAIALIGSALEDDKDALIELLVSESFKELGGQGLMPATLMSWTETFALFQEHETLGIIHAEKFPLATKEFLSRYARNPQPHLTILIFTTKQECFRELSKALPSALSLSLFGEWPADRQKRIIRLLLQRAERVGISCSQSLASLFLRALASTSLPDILSEFDKLLCSVGKKTSLDHSDIKELVVKKEKASLWKFRDSLLKRDPVEGHQQLHFLLEDGEDPLGIITFLRTQCLYGLRSIEEGSKENKHRMFVLYGKERLHQALNSLFYAETLIKNNVQDPIVAVETLVIRMVNL

SEQ ID NO: 402 - protein, 182 aa, Chlamydia pneumoniae
  SITE 1...182: Xaa=unknown or other
VITCLIRGIKMIGAQKKQSGKKTASRAVRKPAKKVAAKRTVKKATVRKTAVKKPAVRKTAAKKTVAKKTTAKRTVRKTVAKKPAVKKVAAKRVVKKTVAKKTTAKRAVRKTVAKKPVARKTTVAKGSPKKAAACALACHXNHKHTSSCKRVCSSTATRKHGSKSRVRTAXGWRHQLIKMMSR

SEQ ID NO: 403 - protein, 197 aa, Chlamydia pneumoniae
  SITE 1...197: Xaa=unknown or other
RQPXAVRTRLLEPCFLVAVEEQTRLQLDVCLWFXWHAKAQAAAFLGEPLATVVFLATGFLATVLRTALLAVVFFATVFFTTRLAATFLTAGFLATVLRTVLLAVVFFATVFLAAVLRTAGFFTAVLRTVAFLTVRLAATFLAGFRTALEAVFLPLCFFCAPIIFIPLIRQVITYLIYRQGRLKTLIKKMTFILKKLK

SEQ ID NO: 404 - protein, 192 aa, Chlamydia pneumoniae
MSRGSFLLTENAIDGASYKMGDVYVGMSGLSVEICSTDAEGRLILADAITYALKYCKPTRIIDFATLTGAMVVSLGEEVAGFFSNNDVLAEDLLEASAETSEPLWRLPLVKKYDKTLHSDIADMKNLGSNRAGAITAALFLQRFLEESSVAWAHLDIAGTAYHEKEEDRYPKYASGFGVRSILYYLENSLSK

SEQ ID NO: 405 - protein, 325 aa, Chlamydia pneumoniae
  SITE 1...325: Xaa=unknown or other
VVLFHAQASGRNRVKADAIVLPFWHFKDAKNAASFEAEFEPSYLPALENFQGKTGEIELLYSSPKAKEKRIVLLGLGKNEELTSDVVFQTYATLTRVLRKAKCSTVNIILPTISELRLSAEEFLVGLSSGILSLNYDYPRYNKVDRNLETPLSKVTVIGIVPKMADAIFRKEAAIFEGVYLTRDLVNRNADEITPKKLAEVALNLGKEFPSIDTKVLGKDAIAKEKMGLLLAVSKGSCVDPHFIVVRYQGRPKSKDHTVLIGKGVTFDSGGLDLKPGKSMLTMKEDMAGGATVLGILSALAXLELPINVTGIIPAYRECYRWRLL

SEQ ID NO: 406 - protein, 105 aa, Chlamydia pneumoniae
DASLLEERLRSHCCWRYLCRELHEQRWFHRNSSLVISVDSLKFSPFGRNEGSRSPSLEDNHQQVGYESVSVGFEGEALDAEAIKDKDMYAGYGQEQQYVCEDVPF

SEQ ID NO: 407 - protein, 89 aa, Chlamydia pneumoniae
MMFGHFAGYLGADPEERMTSKGKRVITLRLGVKTRVGMKDETVWCKCNIWHNRYDKMLPYLKKGSGVIVAGDISVESYMSKDGFTAILL

SEQ ID NO: 408 - protein, 179 aa, Chlamydia pneumoniae
LETTTIYYKEIPSCPRQNAEENLKNFAKELKLPDVAFDQNNTCILFVDGEFSLHLTYEEHSDRLYVYAPLLDGLPDNTQRKLALYEKLLEGSMLGGQMAGGGVGVATKEQLILMHCVLDMKYAETNLLKAFAQLFIETVVKWRTVCADICAGREPSVDTMPQMPQGGGGMQPPPTGIRA

SEQ ID NO: 409 - protein, 666 aa, Chlamydia pneumoniae
STMEKVSSYPSVPLPLGASKISPNRYRFALYASQATEVILALTDENSEVIEVPLYPDTHRTGAIWHIEIEGISDQSSYAFRVHGPKKHGMQYSFKEYLADPYAKNIHSPQSFGSRKKQGDYAFCYLKEEPFPWDGDQPLHLPKEEMIIYEMHVRSFTQSSSSRVHAPGTFLGIIEKIDHLHKLGINAVELLPIFEFDETAHPFRNSKFPYLCNYWGYAPLNFFSPCRRYAYASDPCAPSREFKTLVKTLHQEGIEVILDVVFNHTGLQGTTCSLPWIDTPSYYILDAQGHFTNYSGCGNTLNTNRAPTTQWILDILRYWVEEMHVDGFRFDLASVFSRGPSGSPLQFAPVLEAISFDPLLASTKIIAEPWDAGGLYQVGYFPTLSPRWSEWNGPYRDNVKAFLNGDQNLIGTFASRISGSQDIYPHGSPTNSINYVSCHDGFTLCDTVTYNHKHNEANGEDNRDGTDANYSYNFGTEGKTEDPGILEVRERQLRNFFLTLMVSQGIPMIQSGDEYAHTAEGNNNRWALDSNANYFLWDQLTAKPTLMHFLCDLIAFRKKYKTLFNRGFLSNKEISWVDAMGNPMTWRPGNFLAFKIKSPKAHVYVAFHVGAQDQLATLPKASSNFLPYQIVAESQQGFVPQNVATPTVSLQPHTTLIAISHAKEVT

SEQ ID NO: 410 - protein, 312 aa, Chlamydia pneumoniae
TVFNFKRFYQKDSQRQNGNTTCLRPFKKTCKELIEFRRRTVKLLKNVLLGLFFSMSISGFSEVKVSDTFVKQDTVVEPKIRVLLSNESTTALIEAKGPYRIYGDNVLLDTAIQGQRCVVHALYEGIRWGEFYPGLQCLKIEPVDDTASLFFNGIQYQGSLYVHRKDNHCIMVSNEVTIEDYLKSVLSIKYLEELDKEALSACIILERTALYEKLLARNPQNFWHVKAEEEGYAGFGVTKQFYGVEEAIDWTARLVVDSPQGLIIDAQGLLQSNVDRLAIEGFNARQILEKFYKDVDFVVIESWNEELDGEIR

SEQ ID NO: 411 - protein, 337 aa, Chlamydia pneumoniae
MTHQVAVLHQDKKFDVSLRPKGLEEFYGQHHLKERLDLFLCAALQRGEVPGHCLFFGPPGLGKTSLAHIVAYTVGKGLVLASGPQLIKPSDLLGLLTSLQEGDVFFIDEIHRMGKVAEEYLYSAMEDFKVDITIDSGPGARSVRVDLAPFTLVGATTRSGMLSEPLRTRFAFSARLSYYSDQDLKEILVRSSHLLGIEADSSALLEIAKRSRGTPRLANHLLRWVRDFAQIREGNCINGDVAEKALAMLLIDDWGLNEIDIKLLTTIIDYYQGGPVGIKTLSVAVGEDIKTLEDVYEPFLILKGFIKKTPRGRMVTQLAYDHLKRHAKNLLSLGEGQ

SEQ ID NO: 412 - protein, 190 aa, Chlamydia pneumoniae
MSIKEDKWIREMALNADMIHPFVNGQVNVNEETGEKLISYGLSSYGYDLRLSREFKVFTNVYNSVVDPKCFTEDIFISITDDVCIVPPNSFALARSVEYFRIPRNVLTMCIGKSTYARCGIIVNVTPFEPEWEGHVTIEISNTTPLPAKIYANEGIAQVLFFESSTTCEVSYADRKGKYQKQQGITVPCV

SEQ ID NO: 413 - protein, 165 aa, Chlamydia pneumoniae
KFLTLRHCQRKFTLMKGLPRSYSLSLVRPARFLMQTEKESIKSNKASPYLVSKVSVRKKNWGFRLLEEVMIKSWWVIFSILIGGFVYDRAIQELRTEELRLQSKVSSLCQDILSAQEKQRQLQLHLQHWQDSAAIEAALIQRLGLIPKGYKKLCVSPKQQSENKD

SEQ ID NO: 414 - protein, 414 aa, Chlamydia pneumoniae
KETMIPTMLMFFIICFTLCSGFISLSQIALFSLPTSLISHYKRSKSKKQQRVATLLLHPHHLLITLIFCDIGLNIAIQNCFAILFGDAASWWFTVGLPLAITLILGEILPKAVALPFNTQIASSVAPLILCVTKIFKPLLHWGIVGINYVVQWILSKQQIDIIQPQELKEVLQSCKDFGVVNQEESRLLYGYLSLSDCSVKERMQPRQDILFYDIQTPLENLYLLFSKQHCSRVPICNDNLQNLLGICTARSLLLHDKPLQSSDDLLPLLKKPYYMPETISAKMALCQMAAEDETLGMIIDEYGSIEGLITQEDLFEIVAGEIVDQRDNKILYTTSGADVIIASGTLELREFSEIFDINLPTNNNIATIGGWLIEQIGTIPTTGMKLSWNNLLFQVLDAAPNRIRRVYIRKLYD

SEQ ID NO: 415 - protein, 404 aa, Chlamydia pneumoniae
MTNSALFWIGVNIICIVLQGFYSMMEMACVSFNRVRLQYYLTKDHKKARYINFLIRRPYRLFGTVMLGVNIALQVGSESSRNCYRALGITPDYAPFTQIFIVVIFAELLPLTISRKIPEKLALWGAPILYYSHYIFYPLIQLIGSLTEGLYYLLNIRKEKLNSTLSRDEFQKALETHHEEQDFNTIATNIFSLSATCADQVCQPLEQVTMLPSSANVKDFCRTIKNTDINFIPVYHKARKNVIGIAHPKDFVNKALDEPLINNLHSPWFITAKSKLIRILKEFRDNRSSVAVVLNASGEPIGILSLNAIFKILFNTTNIAHLKPKTISVIERTFPGNSRIKDLQKELDIQFPQYPVETLAQLVLQLLDSPAEVGTSVIINNLLLEVKEMSLSGIKTVSIKNLLS

SEQ ID NO: 416 - protein, 373 aa, Chlamydia pneumoniae
YSMIYLDNNAMTPPERGLLEFLQKTFLIEGTYANPSSVHQLGKKSRQLVLEASHWMQKVLSFQGRVLYTSGATESLNLAIASLPKDSHVITSGSEHPAILEPLKHSSLSVSYLNPEEGRCVLTIEQIERAVTPKTSAIILGWVNSETGAKADIAAIAHFAQERQLQFIVDATANVGKERIVLPSGVTMAAFSGHKFHALSGIGALLVSPGVKLHPQLWGGGQQGGLRAGTENLWGIASLLYIFKYLDLHQERISQEILTHRNGFEKAIKARIPDVHIHCADQPRANNVSAIAFPPLEGEVLQIALDIEGVACGYGSACSSGATAPFKSLVSMGVDEELTLATLRFSFSHLLLQEDVERAVGIIEKVVERLKNS

SEQ ID NO: 417 - protein, 248 aa, Chlamydia pneumoniae
EHFVDFDYFGLSDIGRVRARNEDFWQVNLMSQVVAIADGVGGRLGGDIASQEAVTSLMELIDEQQSKLMGYEDDQYKETLKKILLEVNGVVYEHGQMEEHLQGMGTTLSFIQFRKDRAWLFHVGDSRIYRIREGELRRLTEDHSLENQLKNRYGLPKQSDKVYSYRHILTNVLGSRPYVMPDIRNLPCEKEDLYCLCSDGLTNMVPDIDIRDILNQPATLEERGNALISLANTRGGDDNATVVLVRIQ

SEQ ID NO: 418 - protein, 255 aa, Chlamydia pneumoniae
YKLMRVLNGKSLNCESIDLKSKNFPRARIFCKISNLRTVTMRKMLVLLASLGLLSPTLSSCTHLGSSGSYHPKLYTSGSKTKGVIAMLPVFHRPGKSLEPLPWNLQGEFTEEISKRFYASEKVFLIKHNASPQTVSQFYAPIANRLPETIIEQFLPAEFIVATELLEQKTGKEAGVDSVTASVRVRVFDIRHHKIALIYQEIIECSQPLTTLVNDYHRYGWNSKHFDSTPMGLMHSRLFREVVARVEGYVCANYS

SEQ ID NO: 419 - protein, 231 aa, Chlamydia pneumoniae
  SITE 1...231: Xaa=unknown or other
GNVQVYSSLVPWRRCSSFQKLLYLASTLWENTFKXRQVLFGGALLVFSSLVALSVSSQTAELLSTMTGISLAFAFLFYLXFLPKDITRAILFSGERXVKTSWRALGSAIRMWIIIIPVTQLIGIMMSKFITLVLPTQEIHTQEVTQEVQNSLPITGHYISMILNLGVLTPFGEEVFFRGILQTFLKNKMTRIAAVLCSSIIFSFIHIEHSLGSWVFCPRALCFSLICRVSI

SEQ ID NO: 420 - protein, 130 aa, Chlamydia pneumoniae
MRDHAFSKLIGTVRAMVVEGRCPWSLQQSLVSMVEHILGECQEFHEAVLQGKTVQEVGSEAGDVLTLVLILCFLLEREGVLASEDVANEAMEKLRRRAPYIFAEDYKPVSIEEADRLWELAKHREKNEST

SEQ ID NO: 421 - protein, 375 aa, Chlamydia pneumoniae
NFKRFCMTKIAFSEKAKNFPVEALKKWFEKNKRSLPWRDNPTPYSVWVSEVMLQQTRAEVVIDYFNQWMERFPTIESLAAAKEEDVIKLWEGLGYYSRARHLLEGARMVMEEFHGKIPDDAISLAQIRGVGPYTVHAILAFAFKRRAAAVDGNVLRVLSRIFLIETSIDLESTRTWVSRIAQALLPHKSPEVIAEALIELGACICKKVPQCHRCPVRQACGAWRENKQFVLPVRHARKKVIFLHRLVAIVLYDGSLVVEKRRPKEMMAGLYEFPYIEVEPEEGLQDIEGFTKKMELSLESPLEFLGNLKEQRHAFTNHKVHLCPIIFKATSLPQFGELHLLSDIDHLAFSSGHKKIKDALLIYLGDVRSRESIGV

SEQ ID NO: 422 - protein, 234 aa, Chlamydia pneumoniae
NFMQLSNDKRAALQYFMENFSWLATQVSRLSSFLRSQLPNHSKQEILASIRQHRCRVNGFIERFESYKVQPGDRVSLSLIPSTKQQPSILWEDDYSIIYEKPPHLTTEQMAHMTRFFTVHRLDKGTSGCLLMGKSKQAATELMKLFKQRKIHKQYIAFVFGHPKKKFGTVKSYTAPVYRRCGAVIFGAAGPSQGEPIKSAYKWDCWVILLSEMSTTDLKNSLPRSSALSSMLTP

SEQ ID NO: 423 - protein, 364 aa, Chlamydia pneumoniae
ELEALEQKYGKAVLLIALSELGIDTMSLLSGHRLEGFPPIAEVMAACDRCSMDFCEILKSQSMDLWADAASCVDGLLQDPFWSTAIASGIAKSSLQETEFECESKVMVLSSWGEQGAQVCSPFNLERICMSFPSLKVFSLKKNGCENMGIQLSASCMNLLMSIFFVATNGGSTPIWITKENLMALVALVLSHYQCYFVPATGDPQRGNILGNPEVNAILARGMGMRVDLERKRGGESSSSRYLELAARCFENSLTKTSLLSDANNVQERDKCLLQMSTSLMHTAGLNLQRPPVPTPSGVTAHPQPQPDPVVTSQPSLLGARERSPVSSRGRFPVVLPLSVISPRSHPGRVERRDLEDEEEEVMF

SEQ ID NO: 424 - protein, 283 aa, Chlamydia pneumoniae
NIQTSHSRVLLKKFSKEFTIRTYRSLGFTDYLGGCLTNPLGKFPSPQNPQVVTIAPSSTTPQAVSSAVQGFLQTGGAASSTATTTTASGASALGLSPDQVQALLTNLLNVGQPSVGQPSTSAGTSGASSSSASMQQQLLQLILDKTTGSGGSSVSSEQLQQLLSLVSQMTTSQGGSGGTQAGQAASVLLNLLSATGSAAANPLGTAASLAQIIYAAVTSPGAKKTSEFCYNYCGETCQGNCGCPTCGCPDGQCGCGGFGRFFCGVWKNCCGIGEGSQEPAIPL

SEQ ID NO: 425 - protein, 302 aa, Chlamydia pneumoniae
GGFMLKIDLTGKVAFVAGIGDDQGYGWGIAKLLAEAGATIIVGTWVPIYKIFSQSWELGKFNESRKLSNGTLLEIAKIYPMDASFDSPEDVPEDIAENKRYKGITGFTISEVAEQVKKDFGHIDILVHSLANSPEISKSLLETSRKGYLAALSASSYSFVSLLSHFGSIMNRGGSTISLTYLASMRAVPGYGGGMSSAKAALESDTKTLAWEAGRRWGIRVNTISAGPLASRAGKAIGFIERMVDYYQEWAPIPEAMNAEQVGAVAAFLASPLASAITGETLYVDHGANVMGIGPEMFPKDS

SEQ ID NO: 426 - protein, 300 aa, Chlamydia pneumoniae
NYGDAMEKLLVTDIDGTITHQSHHLDKKVYERLYALHQAGWKLFFLTGRYYKYAARLFSDFDAPYLLGCQNGASVWSSTSSNLLYSKSLPSDLLCILQDCMEGATALFSVESGAPYGDHYYRFSPTPIAQDLHEYVDPRYFPNAKEREILFETRSLKDDYAFPSFAAAKVFGLRDEVIRIQKELERQEALTSVATMTLMRWPFDFRYAILFLTDKSVSKGKALDRVVNILYDGKKPFVMASGDDANDLDLIERGDFKIVMSSAPEEMHVHADFLAPPADKNGILSAWEAGVRYYDDLMSL

SEQ ID NO: 427 - protein, 164 aa, Chlamydia pneumoniae
SRVLHMFFNLFSLVFKLSDELALAETIQEPISVHEMFPGSMKLEMFKMLGSLILLLTIFGFGVWAFKKFVRSRSHGFGGSSQIKILERRSLTPKTSIYLIRVVNKTLVIAETPEKITLLTEFPPDTDINHLLQENNKQSSSSATSDFLSKAIQKIQKKQQTNQD

SEQ ID NO: 428 - protein, 161 aa, Chlamydia pneumoniae
MTTWTLNQNNLTKFLKSSDEEPFLERESGLTYINIQANGNELPLFFVIRSEGEILQLICYLPYQLHESHKASTARLLHLLNRDIDIPGFGMDEEQGLIFYRLVLPCLNGEIHDTLLRIYIDTIKLVCDSFSHAIGLISSGNMNLDELRRQALQEQQEKRNE

SEQ ID NO: 429 - protein, 249 aa, Chlamydia pneumoniae
DVRLFKSNKKNVMSSQTMDVLIFYDTETTGTQIERDRIIEIAAYNSVTDESFLTYVNPEIPIPDEASKIHGITTDAVLSAPKFPEAYEGFRKFCGEDSILVAHNNDGFDFPLLGKECRRHSLEPLTNRTIDSLKWAQKYRPDLPKHNLQYLRQVYGFAENQAHRALDDVVILHKVFTSLIGDLPPQQVLDLLQQSYHPKVFKMPFGKYKGQPLVDIPKSYFEWLENQGALDKPENKDIKAAIALLHQPT

SEQ ID NO: 430 - protein, 259 aa, Chlamydia pneumoniae
MILTAAFSPCPNDIFLFRSFLKDPQFRPLLNQVTIADIETLNTLALQRRLSLMKMSAALFPLVSDYYNLMDVGNTLGYNSGPIVLSLDPECSLDTLATPGEMTTAHALCKLYYPKAKLIPMPYDKILSAILQGKVDGGALIHEERFSYDLQLTLRADFGELWRRKTIFPLPLGCLAIAKYVPMATVDALTAALRKSLICSLKDPITAGAKAVEYSKNKNVTVIHRFIGTYINKETFQLSKTGKKALHMLWKANECCQYT

SEQ ID NO: 431 - protein, 168 aa, Chlamydia pneumoniae
EPISTKKPFNYLKLGKKLYICSGRPMNAVNTPKKILCIVADYREISPLIEQLDFTQINEHLYSYRCTDYHLDLYIVHVWGSTAVLNALQSYCQAYTDYDLWINPGFVGACSPEIPLGQCYTIEKIANLTTDTPPVLSEDPPYIFDALPDSLPKSSLVTSPVLYHYGFQ

SEQ ID NO: 432 - protein, 659 aa, Chlamydia pneumoniae
  SITE 1...659: Xaa=unknown or other
MKLLLKAVLRHKNHLVILGCSLLAILGLTFSSQMEIFSLGMIAKTGPDAFLLFGRKESGKLVKVSELSQKDILENWQAISKDSETLTVSDATTYIAEHGKSTASLTSKLSKFVRNYIDVSRFRGLAIFLICVAIFKAVTLFFQRFLGQVVAIRVSRDLRQDYFKALQQLPMTFFHDHDIGNLSNRVMTDSASIALAVNSLMINYIQAPITFILTLGVCLSISWKFSILICVAFPIFILPIVVIARKIKNLAKRIQKSQDSFSSVLYDFLAGVMTVKVFRTEKFAFTKYCEHNNKISALEEKSAAYGLLPRPLLHTIASLFFAFVVVIGIYKFAIPPEELIVFCGLLYLIYDPIKKFGDEXTSIMRGCAAAERFYEVLNHPDLHSQKEREIEFLGLSNTITFENVSFGYQEDKHILKNLSFTLHKGEALGIVGPTGSGKTTLVKLLPRLYEVSQGKILIDSLPITEYNKGSLRNHIACVLQNPFLFYDTVWNNLTCGKDMEEEAVLEALKRAYADEFILKLPKGVHSVLEESGKNLSGGQQQRLAIARALLKNASILILDEATSALDAISENYIKNIIGELKGQCTQIIIAHKLTTLEHVDRVLYIENGQKIAEGTKEELLQTCPEFLKMWELSGTKEYNRVFVPDHKLVANPTDMAITT

SEQ ID NO: 433 - protein, 344 aa, Chlamydia pneumoniae
LCLRIVCIKMILFIRGEHILMELLPHEKQVVEYEKAIAEFKEKNKKNSLLSSSEIQKLEKRLDKLKEKIYSDLTPWERVQICRHPSRPRTVNYIEGMCEEFVELCGDRTFRDDPAVVGGFVKIQGQRFVLIGQEKGCDTASRLHRNFGMLCPEGFRKALRLGKLAEKFGLPVVFLVDTPGAYPGLTAEERGQGWAIAKNLFELSRLATPVIIVVIGEGCSGGALGMAVGDSVAMLEHSYYSVISPEGCASILWKDPKKNSEAASMLKMHGENLKQFGIIDTVIKEPIGGAHHDPALVYSNVREFIIQEWLRLKDLAIEELLEKRYEKFRSIGLYETTSESGPEA

SEQ ID NO: 434 - protein, 434 aa, Chlamydia pneumoniae
  SITE 1...434: Xaa=unknown or other
SQTGFLPGLTLIFVIIIVWCNAFLIKLCVIMGLQSRLQHCIEVSQNSNFDSQVKQFIYACQDKTLRQSVLKIFRYHPLLKIHDIARAVYLLMALEEGEDLGLSFLNVQQYPSGAVELFSCGGFPWKGLPYPAEHAEFGLLLLQIAEFYEESQAYVSKMSHFQQALFDHQGSVFPSLWSQENSRLLKEKTTLSQSFLFQLGMQIHPEYSLEDPALGFWMQRTRSSSAFVAASGCQSSLGAYSSGDVGVIAYGPCSGDISDCYYFGCCGIAKEFVCQXSHQTTEISFLTSTGKPHPRNTGFSYLRDSYVHLPIRCKITISDKQYRVHAALAEATSAMTFSIFCKGKNCQVVDGPRLRSCSLDSYKGPGNDIMILGENDAINIVSASPYMEIFALQGKEKFWNADFLINIPYKEEGVMLIFEKKVTSEKGRFFTKMN

SEQ ID NO: 435 - protein, 85 aa, Chlamydia pneumoniae
RRMPDSLHKTLRSVTGVGQIPHVLQDKVILSKEIPHKKTVLQHLKGTAVHLKSLSLNPRLLLRPSKDRRPEQYHEFLVKDGSGKS

SEQ ID NO: 436 - protein, 105 aa, Chlamydia pneumoniae
EALSNMATMTKKKLISTISQDHKIHPNHVRTVIQNFLDKMTDALVKGDRLEFRDFGVLQVVERKPKVGRNPRNAAVPIHIPARRAVKFTPGKRMKRLIETPNKHS

SEQ ID NO: 437 - protein, 264 aa, Chlamydia pneumoniae
MKLTKYLNTKQLRSMISRLFVRYSLPMSKQLSFFALCVLGSHPIFAQTPNPPQRVRRSEVIFIDPGHGGKDQGTASKELHYEEKSLTLSLALTVQSYLKRMGYKPQLTRSSDVYVDLGKRVALSNRGQGDVFISIHCNHSSNAAAFGTEVYFYNGKVGSPTRNRMSEVLGKNILAAMEKNGILKSRGLKTANFVVIRDTSMPAVLVETGFLSNSRERAALQDARYRMHVAKGIAEGVHNFLSGPSFQKPKQNIAKIRKPQIQAN

SEQ ID NO: 438 - protein, 483 aa, Chlamydia pneumoniae
MDLKELLHGVQAKIYGKVRPLEVRNLTRDSRCVSVGDIFIAHKGQRYDGNDFAVDALANGAIAIASSLYNPFLSVVQIITPNLEELEAELSAKYYEYPSSKLHTIGVTGTNGKTTVTCLIKALLDSYQKPSGLLGTIEHILGEGVIKDGFTTPTPALLQKYLATMVRQNRDAVVMEVSSIGLASGRVAYTNFDTAVLTNITLDHLDFHGTFETYVAAKAKLFSLVPPSGMVVINTDSPYASQCIESAKAPVITYGIESAADYRATDIQLSSSGTKYTLVYGDQKIACSSSFIGKYNVYNLLAAISTVHASLRCDLEDLLEKIGLCQPPPGRLDPVLMGPCPVYIDYAHTPDALDNVLTGLHELLPEGGRLIVVFGCGGDRDRSKRKLMAQVVERYGFAVVTSDNPRSEPPEDIVNEICDGFYSKNYFIEIDRKQAITYALSIASDRDIVLIAGKGHEAYQIFKHQTVAFDDKQTVCEVLASYV

SEQ ID NO: 439 - protein, 653 aa, Chlamydia pneumoniae
  SITE 1...653: Xaa=unknown or other
MSYRKRSTLIVLGVFALYALLVLRYYKXQICEGDHWAAEALGQHEFCVRDPFRRGTFFANTTVRKGDKDLQQPFAVDITKFHLCADPLAIPECHRDEIIQGILQFIEGQTYDDLSLKLDKKSRYCKLYPLLDVSVHDRLSLWWKGYATKHRLPTNALFFITDYQRSYPFGKLLGQVLHTLREIKDEKTGKAFPTGGMEAYFNHILEGDVGERKLLRSPLNRLDTNRVIKLPKDGSDIYLTINPVIQTIAEEELERGVLEAKAQGGRLILMNSQTGEILALAQYPFFDPTNYKEYFNNKERIEHTKVSFVSDVFEPGSIMKPLTVAIALQANEEASLKSQKKIFDPEEPIDVTRTLFPGRKGSPLKDISRNSQLNMYMAIQKSSNVYVAQLADRIIQSLGVAWYQQKLLALGFGRKTGIELPSEASGLVPSPHRFHINGSLEWSLSTPYSLAMGYNILATGIQMVQAYAILANGGYAVRPTLVKKIVSASGEEYHLPTKEKTRLFSEEITREVVRAMRFTTLPGGSGFRASPKHHSSAGKTGTTEKMIHGKYDKRRHIASFIGFTPVESSEGNFPPLVMLVSIDDPEYGLRADGTKNYMGGRCAAPIFSRVADRTLLYLGILPDKKLRNCDEEAAALKRLYEEWNRSPKQGGTR

SEQ ID NO: 440 - protein, 300 aa, Chlamydia pneumoniae
EILMSERAHIPVLVEECLALFAQRPPQTFRDVTLGAGGHAYAFLEAYPSLTCYDGSDRDLQALAIAEKRLETFQDRVSFSHASFEDLANQPTPRLYDGVLADLGVSSMQLDTLSRGFSFQGEKEELDMRMDQTQELSASDVLNSLKEEELGRIFREYGEEPQWKSAAKAVVHFRKHKKILSIQDVKEALLGVFPHYRFHRKIHPLTLIFQALRVYVNGEDRQLKSLLTSAISWLAPQGRLVIISFCSSEDRPVKWFFKEAEASGLGKVITKKVIQPTYQEVRRNPRSRSAKLRCFEKASQ

SEQ ID NO: 441 - protein, 184 aa, Chlamydia pneumoniae
GLAMVEIFNYSTSIYEQHASNNRIVSDFRKEIQMEGISIRDVAKHAQILDMNPKPSALTSLLQTNQKSHWACFSPPNNFYKQRFSTPYLAPSLGSPDQQDEDIEKISSFLKVLTRGKFSYRSQITPFLSYKDKEEEEDEDPEEDDDDPRVQQGKVLLKALDLGVKSTNVMIDYVISRIFQFVQG

SEQ ID NO: 442 - protein, 143 aa, Chlamydia pneumoniae
CMLDNEWKAILGWGDDELEELRISGYSFLRQGHYSKAILFFEALVILDPLSIYDHQTLGGLYLQIGENSQALAVLDQALRMQGDHLPTLLNKTKALFCLGRIEEATAIATYLSSCPIPAIANDAEALLMSYSKATKKNAALVR

SEQ ID NO: 443 - protein, 467 aa, Chlamydia pneumoniae
MGWVDCIWESFINKESGMLTCNECTTWEQFLNYVKTRCSKTAFENWISPIQVLEETQEKIRLEVPNIFVQNYLLDNYKRDLCSFVPLDVHGEPALEFVVAEHKKPSAPVASQKESNEGISEVFEETKDFELKLNLSYRFDNFIEGPSNQFVKSAAVGIAGKPGRSYNPLFIHGGVGLGKTHLLHAVGHYVREHHKNLRIHCITTEAFINDLVYHLKSKSVDKMKNFYRSLDLLLVDDIQFLQNRQNFEEEFCNTFETLINLSKQIVITSDKPPSQLKLSERIIARMEWGLVAHVGIPDLETRVAILQHKAEQKGLLIPNEMAFYIADHIYGNVRQLEGAINKLTAYCRLFGKSLTETTVRETLKELFRSPTKQKISVETILKSVATVFQVKLNDLKGNSRSKDLVLARQIAMYLAKTLITDSLVAIGAAFGKTHSTVLYACKTIEHKLQNDETLKRQVNLCKNHIVG

SEQ ID NO: 444 - protein, 195 aa, Chlamydia pneumoniae
MFRRTGKGPFEDVQTLYEEETSSPSSYSPYSRSERPETPPSLFDNPKASEARPLNHNLTEESSLPQWSSTPRTESLLPLEEPETTLGEGVTFKGELAFERLLRIDGTFEGILVSKGKIIIGPKGVVKADIQLQEAIIEGVVEGNITVSGKVELRGGAIIKGDIQANTLCVDEGVRILGYLAIAGITDHSERERDL

SEQ ID NO: 445 - protein, 192 aa, Chlamydia pneumoniae
MVLFSLLFPKLCYGCQAPGAYFCSNCLEKLLVEDREGRCLHCFRYLGSSETRLCSQCSPSSQLQAFSLYLPSQTALSVYARACEGKRPALQFFSKSIAFELASLDETPSCIAYITSTISRKIVVEVAKLEKLLRIPLWPWLPKKRQIEKLPKGEGICFLSAYPLSQKWMQTIVGGSASPLVSISLFLSQNDQ

SEQ ID NO: 446 - protein, 517 aa, Chlamydia pneumoniae
VFERVEASTFLSITMLKKFINSLWKLCQQDKYQRFTPIVDAIDTFCYEPIETPSKPPFIRDSVDVKRWMMLVVIALFPATFVAIWNSGLQSIVYSSGNPVLMEQFLHISGFGSYLSFVYKEIHIVPILWEGLKIFIPLLTISYVVGGTCEVLFAVVRGHKIAEGLLVTGILYPLTLPPTIPYWMAALGIAFGIVVSKELFGGTGMNILNPALSGRAFLFFTFPAKMSGDVWVGSNPGVIKDSLMKMNSSTGKVLIDGFSQSTCLQTLNSTPPSVKRLHVDAIAANMLHIPHVPTQDVIHSQFSLWTETHPGWVLDNLTLTQLQTFVTAPVAEGGLGLLPTQFDSAYAITDVIYGIGKFSAGNLFWGNIIGSLGETSTFACLLGAIFLIVTGIASWRTMAAFGIGAFLTGWLFKFISVLIVGQNGAWAPARFFIPAYRQLFLGGLAFGLVFMATDPVSSPTMKLGKWIYGFFIGFMTIVIRLINPAYPEGVMLAILLGNVFAPLIDYFAVRKYRKRGV

SEQ ID NO: 447 - protein, 320 aa, Chlamydia pneumoniae
MSKGSSKHTVRINQTWYIVSFILGLSLFAGVLLSTIYYVLSPIQEQAATFDRNKQMLLAAHILDFKGRFQIQEKKEWVPATFDKKTQLLEVATKKVSEVSYPELELYAERFVRPLLTDAQGKVFSFEEKNLNPIEFFEKYQESPPCQQSPLPFYVILENTSRTENMSGADVAKDLSTVQALIFPISGFGLWGPIHGYLGVKNDGDTVLGTAWYQQGETPGLGANITNPEWQEQFYGKKIFLQDSSGTTNFATTDLGLEVVKGSVRTTLGDSPKALSAIDGISGATLTCNGVTEAYVQSLACYRQLLINFSNLTHEKKTGE

SEQ ID NO: 448 - protein, 223 aa, Chlamydia pneumoniae
  SITE 1...223: Xaa=unknown or other
MTSKKSYKSYFFDPLWSNNQILIAILGICSALAVTTTVQTAITMGIAVSIVTGCSSFFVSLLRKFTPDSVRMITQLIIISLFVIVIDQFLKAFFFDISKTLSVFVGLIITNCXXMGRSESLARHVTPIPAFLDGFASGLGYGWVLLVIGVIRELFGFGTPYGVSHHPSICYASETHPDGYQNLSLMVLAPSAFFLLGIMIWLVNIRDSKEKXVVYVVRCVYLA

SEQ ID NO: 449 - protein, 256 aa, Chlamydia pneumoniae
MWLGAYTWLNVFGILLQAAFIQNILLANFLGMCSYLACSTRVSTANGLGMSVALVLTVTGSINWFVHAFITGPKALTWISPSLASVNLGFLELIIFIVVIAAFTQILELLLEKVSRNLYLSLGIFLPLIAVNCAILGGVLFGITRSYPFIPMMIFSLGAGCGWWLAIVILATIKEKLAYSDIPKNLQGMGISFITTGLIAMAFMSLTGIDISKPSAKIQRAPLETEVVENTTNPLKESSSKHQPSISKARTQRRSL

SEQ ID NO: 450 - protein, 113 aa, Chlamydia pneumoniae
KIMTTLPKYVPRSRQNPDTLTFLKRYSSVLLHSENSLSYRIFAKVLAILLTSLAVAFAVTLFSCEGSQLRLCALYIGIALAICVLLTIVVYCIASKIATACKKPPSISRIEIV

SEQ ID NO: 451 - protein, 436 aa, Chlamydia pneumoniae
  SITE 1...436: Xaa=unknown or other
GEXAYTKISKNKEFSLGFEEFVNSYFQFLEISESEFFNMYRDILLCKRALLLLQGGVSFDFQPLTTFFVQGKDSIQVEFFRLPKEYSFKTKQELKAFEVYLKLVSLPKSDSLDVPNEILPIATIKAKEPRLVGRRFSIDYKRVALQDLAATVPMVEVLHWQQNSEHFQEILQQFPDVETCQSYKDFQHLKPALRDKISLFTRKEILRARPERILQSLQQVPKQSQEVLLSAGKNSALPGISDGQQLAKVLLENEVLDLYSQDAETYYTIIVNSSFEKEEVLPYREVLKRDLASQLLTSHGHLVDMERLESALRTRYPGEEGASLWQRRLWKVVENHRLGRHLEGSFSWSLDRSLKTFSRGDKELPQEFDRIFSMKVGDYSSVFMSPNEGPCYYQCLSHLLYDRPASVDKLFLAKSQLDEELLGSYMERFIEQGVVR

SEQ ID NO: 452 - protein, 84 aa, Chlamydia pneumoniae
SQALFRREKVPSLCASTNVGVPQQMFALPPDEALSRGKDLRLFGYQTIQDWFGDAYLSAAVELLIRFIDEQKKVLPRPSKQESS

SEQ ID NO: 453 - protein, 269 aa, Chlamydia pneumoniae
RPWVRIYQQDLFCRLCRDPAWFFSLLSFTLRFYCLGRGWTLLSFFYKHQKKFIGIVIAVVCVSGIGVGWGRFSRKGSAESTSRRTVFTTASGKRYVEKDFMAMKKFFAHEAYPFTGNPRAWNFINEGLLTDYFLTTRVGEKLFLKVYHPGEKIFSKEKAYQPYRRFDAPFISSEEVWKSSAPQLLEILKVFQQIENPISKEGFLARAKLFLEERRFPHYVLRQMLEYRSKCLLFPQMKPYLAGKTCGYLATRRFKTGLGMPTFLLLLSS

SEQ ID NO: 454 - protein, 196 aa, Chlamydia pneumoniae
ATQSWTQEYLKLIQGARSSVKLAHMYFIPKDELLNALVDVSHNHGVHLSLITNGCHELSPAITGPYAWGNRINYFALLYGKRYPLWKKWFCEKLKPYERVSIYEFAIWETQLHKKCMIIDDEIFVIGSYNFGKKSDAFDYESIVVIESPEVAAKANKVFNKDIGLSIPVSHGDIFSWYFHSVHHTLGHLQLTYMPA

SEQ ID NO: 455 - protein, 214 aa, Chlamydia pneumoniae
RDGKITSRLVWIWFQSSVANIIIQPTFTDAEDQKLLKALKERHPNRFFYVFTGCPPSTSILAPNVIEMHIKLSIIDGKYCILGGTNFEEFMCTPGDEVPEKVDNPRLFVSGVRRPLAFRDQDIMLRSTAFGLQLREEYHKQFAMWDYYAHHMWFIDNPEQFAGACPPLTLEQAEETVFPGFDKHEDLVLVDSSKIRIVLGGPHDKQPNPGLKNI

SEQ ID NO: 456 - protein, 95 aa, Chlamydia pneumoniae
GVMMSRLRFRLAALGIFFILLVPNSVSAKTIVASDKEKVGVLVYDNSVEAFQQILDCIDHANFYVELCPCMTGGRTLKEMVRSPRGSYGSGSRAL

SEQ ID NO: 457 - protein, 244 aa, Chlamydia pneumoniae
  SITE 1...244: Xaa=unknown or other
FYVCYMKVRIVDSGKSSAASHMAKDRDLLESLQDGELILHLYEWENPCSLTYGHFMRPEKFLLSNYADLGLDAAVRPTGGGFVFHKGDYAFSVLMSATHPSYSSSVLENYHTVNSFVAKVLEKVFRIQGMLAPEDENSSSRDSGNFCMAKTSKYDVLXWGQEDRGAAQRKVQQGFLHQGSLFLSGSSSEFYQRFLKPEVLEEIIEQIQIHAFFPLGLEAADEVLQEARQQVKEAFIKLFCGEGL

SEQ ID NO: 458 - protein, 845 aa, Chlamydia pneumoniae
MFEKFTNRAKQVIKLAKKEAQRLNHNYLGTEHILLGLLKLGQGVAVNVLRNLGIDFDTARQEVERLIGYGPEIQVYGDAALTGRVKKSFESANEEASLLEHNYVGTEHLLLGILHQSDSVALQVLENLHIDPREVRKEILKELETFNLQLPPSSSSSSSSSRSNPSSSKSPLGQSLGSDKNEKLSALKAYGYDLTEMVRESKLDPVIGRSSEVERLILILCRRRKNNPVLIGEAGVGKTAIVEGLAQKIILNEVPDALRKKRLITLDLALMIAGTKYRGQFEERIKAVMDEVRKHGNILLFIDELHTIVGAGAAEGAIDASNILKPALARGEIQCIGATTIDEYRKHIEKDAALERRFQKIVVHPPSVDETIEILRGLKKKYEEHHNVFITEEALKAAATLSDQYVHGRFLPDKAIDLLDEAGARVRVNTMGQPTDLMKLEAEIENTKLAKEQAIGTQEYEKAAGLRDEEKKLRERLQSMKQEWENHKEEHQVPVDEEAVAQVVSLQTGIPSARLTEAESEKLLKLEDTLRRKVIGQNDAVTSICRAIRRSRTGIKDPNRPTGSFLFLGPTGVGKSLLAQQIAIEMFGGEDALIQVDMSEYMEKFAATKMMGSPPGYVGHEEGGHLTEQVRRRPYCVVLFDEIEKAHPDIMDLMLQILEQGRLTDSFGRKVDFRHAIIIMTSNLGADLIRKSGEIGFGLKSHMDYKVIQEKIEHAMKKHLKPEFINRLDESVIFRPLEKESLSEIIHLEINKLDSRLKNYQMALNIPDSVISFLVTKGHSPEMGARPLRRVIEQYLEDPLAELLLKESCRQEARKLRATLVENRVAFEREEEEQEAALPSPHLES

SEQ ID NO: 459 - protein, 374 aa, Chlamydia pneumoniae
  SITE 1...374: Xaa=unknown or other
NLTLPMRRQVREIMQQTVIVAMSGGVDSSVVAYLFKKFTNYKVIGLFMKNWEEDSEGGLCSSTKDYEDVERVCLQLDIPYYTVSFAKEYRERVFARFLKEYSLGYTPNPDILCNREIKFDLLQKKVQELGGDYLATGHYCRLNTELQETQLLRGCDPQKDQSYFLSGTPKSALHNVLFPLGEMNKTEVRAIAAQAALPTAEKKDSTGICFIGKRPFKEFLEKFLPNKTGNVIDWDTKEIVGQHQGSHYYTIGQRRGLDLGGSEKPXYVVGKNIEENSIYIVRGEDHPQLYLRELTARELNWFTPPKSGCHCSAKVRYRSPDEACTIDYSSGDEVKVRFSQPVKAVTPGQTIAFYQGDTCLGSGVIDVPMIPSEG

SEQ ID NO: 460 - protein, 185 aa, Chlamydia pneumoniae
IISSNNRVLFVSSTLNGVFPSSLPEESADLFITNKEIVALGEKGNVFLTHSIPMHIAAITILVIVALAGIAIICLGCYSQSILLIAVGIVLTILTLLCLQALVGFIKFIRQLPQQLHTTVQFIREKIRPESSLQLVTNAQRKTTQDTLKLYEELCDLSQKEFKLQSTLYQKRFELSHKNEKTNQN

SEQ ID NO: 461 - protein, 220 aa, Chlamydia pneumoniae
LATIRGNNMATSVAPSPVPESSPLSHATEVLNLPNAYITQPHPIPAAPWETFRSKLSTKHTLCFALTLLLTLGGTISAGYAGYTGNWIICGIGLGIIVLTLILALLLAIPLKNKQTGTKLIDEISQDISSIGSGFVQRYGLMFSTIKSVHLPELTTQNQEKTRILNEIEAKKESIQNLELKITECQNKLAQKQPKRKSSQKSFMRSIKHLSKNPVILFDC

SEQ ID NO: 462 - protein, 159 aa, Chlamydia pneumoniae
  SITE 1...159: Xaa=unknown or other
RWRILQNMFKLLFHIAAFAGHVLSTPIFIVQDACGIDEEACKNPPPRPFSAQVQYLKVNDAKFKKLPHQTIGYRQYDGTFLCTLPITEHSGLLFSTGYIGADIQWKSSLPISETDPNGLGWATFQDTSFYNYVLLSLGAYTLSXKKLAVVYHSFWACGS

SEQ ID NO: 463 - protein, 186 aa, Chlamydia pneumoniae
ELIHSPLKNWQWSIILSGLVDPKNIEMGYGLYQGVLSGKYQATEKLSAIFGVINETGLHQEKAWPLVGVSYKATDQLTLNCIYPVNFSIDYRSTSVCNLGLAYRLTRFRKKLYKNHLISSRGIFEYQGREIEANVKLTPWPGSFIKGFYGWSIGNDISIADDHNNNKTSHTFKTSAFFGGSAVMNF

SEQ ID NO: 464 - protein, 127 aa, Chlamydia pneumoniae
VDSMSQPPINPLGQPQVPAAASPSGQPSVVKRLKTSSTGLFKRFITVPDKYPKMRYVYDTGIIALAAIAILSILLTASGNSLMLYALAPALALGALGVTLLISDILDSPKPRKSVRQSLLSSFLSLY

SEQ ID NO: 465 - protein, 91 aa, Chlamydia pneumoniae
YSGQSEAKKIGEAITAIVVPIIVLAIAAGLIAGAFVASSGTMLVFANPMFVMGLITVGLYFMSLNKLTLDYFRREHLLRMEKKTQETADLF

SEQ ID NO: 466 - protein, 1132 aa, Chlamydia pneumoniae
MKYSLPWLLTSSALVFSLHPLMAANTDLSSSDNYENGSSGSAAFTAKETSDASGTTYTLTSDVSITNVSAITPADKSCFTNTGGALSFVGADHSLVLQTIALTHDGAAINNTNTALSFSGFSSLLIDSAPATGTSGGKGAICVTNTEGGTATFTDNASVTLQKNTSEKDGAAVSAYSIDLAKTTTAALLDQNTSTKNGGALCSTANTTVQGNSGTVTFSSNTATDKGGGIYSKEKDSTLDANTGVVTFKSNTAKTGGAWSSDDNLALTGNTQVLFQENKTTGSAAQANNPEGCGGAICCYLATATDKTGLAISQNQEMSFTSNTTTANGGAIYATKCTLDGNTTLTFDQNTATAGCGGAIYTETEDFSLKGSTGTVTFSTNTAKTGGALYSKENSSLTGNTNLLFSGNKATGPSNSSANQEGCGGAILSFLESASVSTKKGLWIEDNENVSLSGNTATVSGGAIYATKCALHGNTTLTFDGNTAETAGGAIYTETEDFTLTGSTGTVTFSTNTAKTAGALHTKGNTSFTKNKALVFSGNSATATATTTTDQEGCGGAILCNISESDIATKSLTLTENESLSFINNTAKRSGGGIYAPKCVISGSESINFDGNTAETSGGAIYSKNLSITANGPVSFTNNSGGKGGAIYIADSGELSLEAIDGDITFSGNRATEGTSTPNSIHLGAGAKITKLAAAPGHTIYFYDPITMEAPASGGTIEELVINPVVKAIVPPPQPKNGPIASVPVVPVAPANPNTGTIVFSSGKLPSQDASIPANTTTILNQKINLAGGNVVLKEGATLQVYSFTQQPDSTVFMDAGTTLETTTTNNTDGSIDLKNLSVNLDALDGKRMITIAVNSTSGGLKISGDLKFHNNEGSFYDNPGLKANLNLPFLDLSSTSGTVNLDDFNPIPSSMAAPDYGYQGSWTLVPKVGAGGKVTLVAEWQALGYTPKPELRATLVPNSLWNAYVNIHSIQQEIATAMSDAPSHPGIWIGGIGNAFHQDKQKENAGFRLISRGYIVGGSMTTPQEYTFAVAFSQLFGKSKDYVVSDIKSQVYAGSLCAQSSYVIPLHSSLRRHVLSKVLPELPGETPLVLHGQVSYGRNHHNMTTKLANNTQGKSDWDSHSSLLKSVVLFL

SEQ ID NO: 467 - protein, 154 aa, Chlamydia pneumoniae
FAVEVGGSLPVDLNYRYLTSYSPYVKLQVVSVNQKGFQEVAADPRIFDASHLVNVSIPMGLTFKHESAKPPSALLLTLGYAVDAYRDHPHCLTSLTNGTSWSTFATNLSRQAFFAEASGHLKLLHGLDCFASGSCELRSSSRSYNANCGTRYSF

SEQ ID NO: 468 - protein, 671 aa, Chlamydia pneumoniae
MKSSVSWLFFSSIPLFSSLSIVAAEVTLDSSNNSYDGSNGTTFTVFSTTDAAAGTTYSLLSDVSFQNAGALGIPLASGCFLEAGGDLTFQGNQHALKFAFINAGSSAGTVASTSAADKNLLFNDFSRLSIISCPSLLLSPTGQCALKSVGNLSLTGNSQIIFTQNFSSDNGGVINTKNFLLSGTSQFASFSRNQAFTGKQGGVVYATGTITIENSPGIVSFSQNLAKGSGGALYSTDNCSITDNFQVIFDGNSAWEAAQAQGGAICCTTTDKTVTLTGNKNLSFTNNTALTYGGAISGLKVSISAGGPTLFQSNISGSSAGQGGGGAINIASAGELALSATSGDITFNNNQVTNGSTSTRNAINIIDTAKVTSIRAATGQSIYFYDPITNPGTAASTDTLNLNLADANSEIEYGGAIVFSGEKLSPTEKAIAANVTSTIRQPAVLARGDLVLRDGVTVTFKDLTQSPGSRILMDGGTTLSAKEANLSLNGLAVNLSSLDGTNKAALKTEAADKNISLSGTIALIDTEGSFYENHNLKSASTYPLLELTTAGANGTITLGALSTLTLQEPETHYGYQGNWQLSWANATSSKIGSINWTRTGYIPSPERKSNLPLNSLWGNFIDIRSINQLIETKSSGEPFEREYGFQELRISSIEILCPPAMVSAISAGVMH

SEQ ID NO: 469 - protein, 294 aa, Chlamydia pneumoniae
VWLSGIANFFYRDSMPTRHGFRHISGGYALGITATTPAEDQLTFAFCQLFARDRNHITGKNHGDTYGASLYFHHTEGLFDIANFLWGKATRAPWVLSEISQIIPLSFDAKFSYLHTDNHMKTYYTDNSIIKGSWRNDAFCADLGASLPFVISVPYLLKEVEPFVKVQYIYAHQQDFYERYAEGRAFNKSELINVEIPIGVTFERDSKSEKGTYDLTLMYILDAYRRNPKCQTSLIASDANWMAYGTNLARQGFSVRAANHFQVNPHMEIFGQFAFEVRSSSRNYNTNLGSKFCF

SEQ ID NO: 470 - protein, 930 aa, Chlamydia pneumoniae
MKIPLHKLLISSTLVTPILLSIATYGADASLSPTDSFDGAGGSTFTPKSTADANGTNYVLSGNVYINDAGKGTALTGCCFTETTGDLTFTGKGYSFSFNTVDAGSNAGAAASTTADKALTFTGFSNLSFIAAPGTTVASGKSTLSSAGALNLTDNGTILFSQNVSNEANNNGGAITAKTLSISGNTSSITFTSNSAKKLGGAIYSSAAASISGNTGQLVFMNNKGETGGGALGFEASSSITQNSSLFFSGNTATDAAGKGGAIYCEKTGETPTLTISGNKSLTFAENSSVTQGGAICAHGLDLSAAGPTLFSNNRCGNTAAGKGGAIAIADSGSLSLSANQGDITFLGNTLTSTSAPTSTRNAIYLGSSAKITNLRAAQGQSIYFYDPIASNTTGASDVLTINQPDSNSPLDYSGTIVFSGEKLSADEAKAADNFTSILKQPLALASGTLALKGNVELDVNGFTQTEGSTLLMQPGTKLKADTEAISLTKLVVDLSALEGNKSVSIETAGANKTITLTSPLVFQDSSGNFYESHTINQAFTQPLVVFTAATAASDIYIDALLTSPVQTPEPHYGYQGHWEATWADTSTAKSGTMTWVTTGYNPNPERRASVVPDSLWASFTDIRTLQQIMTSQANSIYQQRGLWASGTANFFHKDKSGTNQAFRHKSYGYIVGGSAEDFSENIFSVAFCQLFGKDKDLFIVENTSHNYLASLYLQHRAFLGGLPMPSFGSITDMLKDIPLILNAQLSYSYTKNDMDTRYTSYPEAQGSWTNNSGALELGGSLALYLPKEAPFFQGYFPFLKFQAVYSRQQNFKESGAEARAFDDGDLVNCSIPVGIRLEKISEDEKNNFEISLAYIGDVYRKNPRSRTSLMVSGASWTSLCKNLARQAFLASAGSHLTLSPHVELSGEAAYELRGSAHIYNVDCGLRYSF

SEQ ID NO: 471 - protein, 138 aa, Chlamydia pneumoniae
IAPPNFFALLLVKVIEEVFPEIERVFAVIAPPLLLASLETFWLKRIVPLSVRFKAPAELKVLFPEATVVPGAAMKERLENPVNVRALSAVVLAAAPAFEPASTVLNENEYPFPVNVRSPVVSVKQQPVNAVPFPASFI

SEQ ID NO: 472 - protein, 927 aa, Chlamydia pneumoniae
  SITE 1...927: Xaa=unknown or other
MKSSLHWFLISSSLALPLSLNFSAFAAVVEINLGPTNSFSGPGTYTPPAQTTNADGTIYNLTGDVSITNAGSPTALTASCFKETTGNLSFQGHGYQFLLQNIDAGANCTFTNTAANKLLSFSGFSYLSLIQTTNATTGTGAIKSTGACSIQSNYSCYFGQNFSNDNGGALQGSSISLSLNPNLTFAKNKATQKGGALYSTGGITINNTLNSASFSENTAANNGGAIYTEASSFISSNKAISFINNSVTATSATGGAIYCSSTSAPKPVLTLSDNGELNFIGNTAITSGGAIYTDNLVLSSGGPTLFKNNSAIDTAAPLGGAIAIADSGSLSLSALGGDITFEGNTVVKGASSSQTTTRNSINIGNTNAKIVQLRASQGNTIYFYDPITTSITAALSDALNLNGPDLAGNPAYQGTIVFSGEKLSEAEAAEADNLKSTIQQPLTLAGGQLSLKSGVTLVAKSFSQSPGSTLLMDAGTTLETADGSLSIICSQCRFLKRDQEXTLKATQASQTVTLSGSLSLVDPSGNVYEDVSWNNPQVFSCLTLTADDPANIHITDLAADPLEKNPIHWGYQGNWALSWQEDTATKSKAATLTWTKTGYNPNPERRGTLVANTLWGSFVDVRSIQQLVATKVRQSQETRGIWCEGISNFFHKDSTKINKGFRHISAGYVVGATTTLASDNLITAAFCQLFGKDRDHFINKNRASAYAASLHLQHLATLSSPSLLRYLPGSESEQPVLFDAQISYIYSKNTMKTYYTQAPKGESSWYNDGCALELASSLPHTALSHEGLFHAYFPFIKVEASYIHQDSFKERNTTLVRSFDSGDLINVSVPIGITFERFSRNERASYEATVIYVADVYRKNPDCTTALLINNTSWKTTGTNLSRQAGIGRAGIFYAFSPNLEVTSNLSMEIRGSSRSYNADLGGKFQF

SEQ ID NO: 473 - protein, 393 aa, Chlamydia pneumoniae
FIQPSRREIHEWKCILLGSSLRMEMMSPFQQPEQCHFDVVGSFLRPESLTRARSDFEEGRIVYEQMRVVEDAAIRNLIKKQTEAGLIFFTDGEFRRYSWDFDFMWGFHGVDRRRDSNDPEIGVYLKDKISVSKHPFIEHFEFVKTFEKGNAKAKQTIPSPSQFFHEMIFAPNLKNTRKFYPTNQELIDDIVFYYRQVIQDLYAAGCRNLQLDDCAWCRLLDIRAPSWYGVDSHDRLQEILEQFLWIHNLVMKDRPEDLFVSLHVCRGDYQAEFFSRRAYDSIEEPLFAKTDVDSYHYYWALDDKYSGGAEPLAYVSGEKHVCLGLISSNHSCIEDRDAVVSRIYEAASYIPLERLSLSPQCGFASCEGDHRMTEEEQWKKIAFVKEIAKEIWG

SEQ ID NO: 474 - protein, 643 aa, Chlamydia pneumoniae
LMAEPFMLRSLHWLPGGGGGISFSNNIVQGTTAGNGGAISILAAGECSLSAEAGDITFNGNAIVATTPQTTKRNSIDIGSTAKITNLRAISGHSIFFYDPITANTAADSTDTLNLNKADAGNSTDYSGSIVFSGEKLSEDEAKVADNLTSTLKQPVTLTAGNLVLKRGVTLDTKGFTQTAGSSVIMDAGTTLKASTEEVTLTGLSIPVDSLGEGKKVVIAASAASKNVALSGPILLLDNQGNAYENHDLGKTQDFSFVQLSALGTATTTDVPAVPTVATPTHYGYQGTWGMTWVDDTASTPKTKTATLAWTNTGYLPNPERQGPLVPNSLWGSFSDIQAIQGVIERSALTLCSDRGFWAAGVANFLDKDKKGEKRKYRHKSGGYAIGGAAQTCSENLISFAFCQLFGSDKDFLVAKNHTDTYAGAFYIQHITECSGFIGCLLDKLPGSWSHKPLVLEGQLAYSHVSNDLKTKYTAYPEVKGSWGNNAFNMMLGASSHSYPEYLHCFDTYAPYIKLNLTYIRQDSFSEKGTEGRSFDDSNLFNLSLPIGVKFEKFSDCNDFSYDLTLSYVPDLIRNDPKCTTALVISGASWETYANNLARQALQVRAGSHYAFSPMFEVLGQFVFEVRGSSRIYNVDLGGKFQF

SEQ ID NO: 475 - protein, 102 aa, Chlamydia pneumoniae
KKMLCPDIARKFVIFAVDPMSIEFLFVVCGVVATMAFPLKVMSPASAERLHSPAASIEMAPPLPAVVPWTILLEKEIPPPPPGSQCKLLSINGSAISYSLVS

SEQ ID NO: 476 - protein, 174 aa, Chlamydia pneumoniae
SQPPQEKVQLNVEGILHLITMELFYLNKITVRKMADISTKNLSLKNSTGSISFEGNKSSATGKKGGAICATGTVDITNNTAPTLFSNNIAEAAGGAINSTGNCTITGNTSLVFSENSVTATAGNGGALSGDADVTISGNQSVTFSGNQAVANGGAIYAKKLTLASGGGGGYLLF

SEQ ID NO: 477 - protein, 118 aa, Chlamydia pneumoniae
  SITE 1...118: Xaa=unknown or other
MKSQFSWLVLSSTLACFTSCSTVFAATAENIGPSDSFDGSTNTGTYTPKNTTTGIDYTLTGDITLQNLGDSAALTKGCFSDTTESLSFAGKGYSLSFLNXKSSAEGAXFLLQLIKICR

SEQ ID NO: 478 - protein, 949 aa, Chlamydia pneumoniae
  SITE 1...949: Xaa=unknown or other
LIYLFCFYIDANSSLKNKSITMKTSIPWVLVSSVLAFSCHLQSLANEELLSPDDSFNGNIDSGTFTPKTSATTYSLTGDVFFYEPGKGTPLSDSCFKQTTDNLTFLGNGHSLTFGFIDAGTHAGAAASTTANKNLTFSGFSLLSFDSSPSTTVTTGQGTLSSAGGVNLENIRKLVVAGNFSTADGGAIKGASFLLTGTSGDALFSNNSSSTKGGAIATTAGARIANNTGXVRFLSNIASTSGGAIDDEGTSILSNNKFLYFEGNAAKTTGGAICNTKASGSPELIISNNKTLIFASNVAETSGGAIHAKKLALSSGGFTEFLRNNVSSATPKGGAISIDASGELSLSAETGNITFVRNTLTTTGSTDTPKRNAINIGSNGKFTELRAAKNHTIFFYDPITSEGTSSDVLKINNGSAGALNPYQGTILFSGETLTADELKVADNLKSSFTQPVSLSGGKLLLQKGVTLESTSFSQEAGSLLGMDSGTTLSTTAGSITITNLGINVDSLGLKQPVSLTAKGASNKVIVSGKLNLIDIEGNIYESHMFSHDQLFSLLKITVDADVDTNVDISSLIPVPAEDPNSEYGFQGQWNVNWTTDTATNTKEATATWTKTGFVPSPERKSALVCNTLWGVFTDIRSLQQLVEIGATGMEHKQGFWVSSMTNFLHKTGDENRKGFRHTSGGYVIGGSAHTPKDDLFTFAFCHLFARDKDCFIAHNNSRTYGGTLFFKHSHTLQPQNYLRLGRAKFSESAIEKFPREIPLALDVQVSFSHSDNRMETHYTSLPESEGSWSNECIAGGIGLDLPFVLSNPHPLFKTFIPQMKVEMVYVSQNSFFESSSDGRGFSIGRLLNLSIPVGAKFVQGDIGDSYTYDLSGFFVSDVYRNNPQSTATLVMSPDSWKIRGGNLSRQAFLLRGSNNYVYNSNCELFGHYAMELRGSSRNYNVDVGTKLRF

SEQ ID NO: 479 - protein, 519 aa, Chlamydia pneumoniae
FNEETMTILRNFLTCSALFLALPAAAQVVYLHESDGYNGAINNKSLEPKITCYPEGTSYIFLDDVRISNVKHDQEDAGVFINRSGNLFFMGNRCNFTFHNLMTEGFGAAISNRVGDTTLTLSNFSYLAFTSAPLLPQGQGAIYSLGSVMIENSEEVTFCGNYSSWSGAAIYTPYLLGSKASRPSVNLSGNRYLVFRDNVSQGYGGAISTHNLTLTTRGPSCFENNHAYHDVNSNGGAIAIAPGGSISISVKSGDLIFKGNTASQDGNTIHNSIHLQSGAQFKNLRAVSESGVYFYDPISHSESHKITDLVINAPEGKETYEGTISFSGLCLDDHEVCAENLTSTILQDVTLAGGTLSLSDGVTLQLHSFKQEASSTLTMSPGTTLLCSGDARVQNLHILIEDTDNFVPVRIRAEDKDALVSLEKLKVAFEAYWSVYDFPQFKEAFTIPLLELLGPSFDSLLLGETTLERTQVTTENDAVRGFWSLSWEEYPPSLDKDRRITPTKKTVFLTWNPEITSTP

SEQ ID NO: 480 - protein, 522 aa, Chlamydia pneumoniae
NCVLLYLFFYSLSLICRIIWFHLYVQMKTSIRKFLISTTLAPCFASTAFTVEVIMPSENFDGSSGKIFPYTTLSDPRGTLCIFSGDLYIANLDNAISRTSSSCFSNRAGALQILGKGGVFSFLNIRSSADGAAISSVITQNPELCPLSFSGFSQMIFDNCESLTSDTSASNVIPHASAIYATTPMLFTNNDSILFQYNRSAGFGAAIRGTSITIENTKKSLLFNGNGSISNGGALTGSAAINLINNSAPVIFSTNATGIYGGAIYLTGGSMLTSGNLSGVLFVNNSSRSGGAIYANGNVTFSNNSDLTFQNNTASPQNSLPAPTPPPTPPAVTPLLGYGGAIFCTPPATPPPTGVSLTISGENSVTFLENIASEQGGALYGKKISIDSNKSTIFLGNTAGKGGAIAIPESGELSLSANQGDILFNKNLSITSGTPTRNSIHFGKDAKFATLGLRKAIPYTSMIRLHLMIYLCIRSRYCGRQSQSQCRWCVFRDYCLFRRNPHCYRSSNPCKCYIYIKPKART

SEQ ID NO: 481 - protein, 85 aa, Chlamydia pneumoniae
RAPPCSEAMFSRNVTLFSPDIVRLTPVGGGVAGGVQKMAPPYPNKGVTAGGVGGGVGAGKEFCGDAVLFWKVRSLLLENVTFPLA

SEQ ID NO: 482 - protein, 530 aa, Chlamydia pneumoniae
FISASAAATVVVNPKASADGAYSGTIVFSGETLTATEAATPANATSTLNQKLELEGGTLALRNGATLNVHNFTQDEKSVVIMDAGTTLATTNGANNTDGAITLNKLVINLDSLDGTKAAVVNVQSTNGALTISGTLGLVKNSQDCCDNHGMFNKDLQQVPILELKATSNTVTTTDFSLGTNGYQQSPYGYQGTWEFTIDTTTHTVTGNWKKTGYLPHPERLAPLIPNSLWANVIDLRAVSQASAADGEDVPGKQLSITGITNFFHANHTGDARSYRHMGGGYLINTYTRITPDAALSLGFGQLFTKSKDYLVGHGHSNVYFATVYSNITKSLFGSSRFFSGGTSRVTYSRSNEKVKTSYTKLPKGRCSWSNNCWLGELEGNLPITLSSRILNLKQIIPFVKAEVAYATHGGIQENTPEGRIFGHGHLLNVAVPVGVRFGKNSHNRPDFYTIIVAYAPDVYRHNPDCDTTLPINGATWTSIGNNLTRSTLLVQASSHTSVNDVLEIFGHCGCDIRRTSRQYTLDIGSKLRF

SEQ ID NO: 483 - protein, 280 aa, Chlamydia pneumoniae
GMPLSFKSSSFCLLACLCSASCAFAETRLGGNFVPPITNQGEEILLTSDFVCSNFLGASFSSSFINSSSNLSLLGKGLSLTFTSCQAPTNSNYALLSAAETLTFKNFSSINFTGNQSTGLGGLIYGKDIVFQSIKDLIFTTNRVAYSPASVTTSATPAITTVTTGASALQPTDSLTVENISQSIKFFGNLANFGSAISSSPTAVVKFINNTATMSFSHNFTSSGGGVIYGGSSLLFENNSGCIIFTANSCVNSLKGVTPSSGTYALGSGGASASLRELSN

SEQ ID NO: 484 - protein, 82 aa, Chlamydia pneumoniae
ITPPPDEVKLWEKLMVAVLLMNLTTAVGELLIAEPKLARFPKNLIDWDMFSTVSESVGWRAEAPVVTVVIAGVADVVTDAGE

SEQ ID NO: 485 - protein, 492 aa, Chlamydia pneumoniae
KQFWMHHLHRQLLCEQLKRRHPFIRNLCFRKWRSICIPTGTFELKNNQGKCTFSYNGTPNDAGAIYAETCNIVGNQGALLLDSNTAARNGGAICAKVLNIQGRGPIEFSRNRAEKGGAIFIGPSVGDPAKQTSTLTILASEGNIAFQGNMLNTKPGIRNAITVEAGGEIVSLSAQGGSRLVFYDPITHSLPTTSPSNKDITINANGASGSVVFTSKGLSSTELLLPANTTTILLGTVKIASGELKITDNAVVNVLGFATQGSGQLTLGSGGTLGLATPTGAPAAVDFTIGKLAFDPFSFLKRDFVSASVNAGTKNVTLTGALVLDEHDVTDLYDMVSLQSPVAIPIAVFKGATVTKTGFPDGEIATPSHYGYQGKWSYTWSRPLLIPAPDGGFPGGPSPSANTLYAVWNSDTLVRSTYILDPERYGEIVSNSLWISFLGNQAFSDILQDVLLIDHPGLSITAKALGAYVEHTPRQGHEGFSGRYGGYQVRYL

SEQ ID NO: 486 - protein, 264 aa, Chlamydia pneumoniae
GLFRSLWRLPSALSMNYTDHTTLGLSFGQLYGKTNANPYDSRCSEQMYLLSFFGQFPIVTQKSEALISWKAAYGYSKNHLNTTYLRPDKAPKSQGQWHNNSYYVLISAEHPFLNWCLLTRPLAQAWDLSGFISAEFLGGWQSKFTETGDLQRSFSRGKGYNVSLPIGCSSQWFTPFKKAPSTLTIKLAYKPDIYRVNPHNIVTVVSNQESTSISGANLRRHGLFVQIHDVVDLTEDTQAFLNYTFDGKNGFTNHRVSTGLKSTF

SEQ ID NO: 487 - protein, 357 aa, Chlamydia pneumoniae
NRQRLHAPLSQGSHCHSYLADLTHEELKILLFSAFVDAKNISKKELREVSLNFANDTSVESWLRFLLLVSYDEKEKDVVVVCNHSEPNILGLPPEAVSQLIEELSDEGYSYLNVVRCDLSGETTVQQRLLLNADEGRSMTVVISELPEGHPDIRNLQLASERIFVSREKEAADAYASGCKVVAFDDEHLPWVSSHIAYAEEIREKQEQTMQGSLTEEQLGALLCNTVSTEKNLAFALDAVIKQSVWRFRNPDLFAYEREALEASVTDALVSYVSNLDMIPYTSSQGIVIEDSSIVRTSQEHTLIVNCAAFDKLASQIEFLCPSDVLPISGKDPLISDDEDEELNPKVSSAADSKDKT

SEQ ID NO: 488 - protein, 347 aa, Chlamydia pneumoniae
  SITE 1...347: Xaa=unknown or other
IPCTFESKRKFLMTHCLHGWFSVVRHHFVQAFNFSRPLYSRITHFALGVIKAIPIVGHLVMGVDWLISHCFERGVSHPGFPSDIAPILKVEKIAGRDHISRIENQLKSLRKTIEVEDLDKVHGQYQENPYADMASSEVLKLDKGVHVSELGKAFSRVRNRITRSYSYAPTPQLDSIAIVGIDLVSPEEQENLVRLANEVIQLYPKSKTTLYLLIDFNXEWVGDISSDKEKQLRSLGLHSEVQCLSVLEPQGAEGEDTKHFDLMVGCYGKDSYLREGKILQQALGTSLGTVPWVNVMHTLPSRYRSRLSLPINTEKDKTELYKEISRTHHQLHTLGMGLGAQDFRDCS

SEQ ID NO: 489 - protein, 636 aa, Chlamydia pneumoniae
VFLPSRVMASCLSAWFSIVREHFYRAFDFSLPFCARITEFVLGVIKGIPVVGHIIVGIEWLVSRYLESFVTKPTFVSDVVSLLKTEKVAGRDHIARVVETLKRQRVAVAPEDEDKVHGKIPVHPFGGIQPVEVLTLYPEVQDATLGLAFSKIRNRVRQAYLQAPRPKLQKIYIIGNDMNPFEVDDFLHLARLCNETQRLYPDATISLYLTASGGRNAMDKKNRKLLSDCELNPKIACLDFNQGDVVKQATCDCWMVYHGENDQGTLNQIQEELEKSGEETPWIHVGQKPLSQSLWDFSPFSSLEMKGDKEKALEYSELEKEQLYSRLVYVGERSSVLSLGFGDSRSGILMDPKRVHAPLSEGHYCHSYLADLENPGLQKTILAAFLNPKELSSTILQPISLNLILNSKTYLRQHFGFFERMSRSDRNVVVVVCDSWWGTDWKEEPSFQHFIMELECRGYSHFNIFAFRSNSMCVEERRILNESSQEKAFTMIFCEDSVSQGDIRCLHLASEGMLCGKECYAVDVYTSGCANFMMEEVLTLERESNLWNRKHGLWKREVRKQKQEAALDQDESEIYVCNQLTAQQNFACSLDAAIRQSIWRSRMPELLSIERRALGEQLFTTVHHYLTTQKKILRGI

SEQ ID NO: 490 - protein, 703 aa, Chlamydia pneumoniae
  SITE 1...703: Xaa=unknown or other
YFLCCYLKLFVSNFIFFVXMPIPYISSWISTVRQHFVKAFDFSRPFCSRVTNFALGVIKAIPIVGHIVMGMEWLVSSCVAGIITRSSFTSDVVQIVKTEKALGRDHISRVAEILQRERGTITPENQDKVHGKFPVCPFGRLKSEETLKLKPGERGGTLDTVFSPIRTRVTRAYLQAPRPEIRTISIVGSKLKTPQDFSQFVSLANETQRLHPEALVCLYLTGLNRESQMCDTTTAEKKQYLHNSGLDSRIQCKDSKEDDAGSPENPELWIGYYSREQQHNIDGQYIQQCLGKSADPIPWIHVTEDTKDFYYPPNFTSYSHTRQSTDPTSPPRLPESEGDKDSLYGQLSRSYHHEYMLGLGLKPEDAGLLMDPDRIYAPLSQGHYCHSYLADIENEDLRTLVLSPFLDPGNLSSEDLRPVAFNIARLPLELDSLFFRLVAGQQEGRNIVTLAHGTPRPEDLDPDSMNILTRRLQMSGYSYLNIFSYKSRKMIVKERQFFGDRSEGKSFTLILFEDPISAADFRCLQLAAEGMVAKDLPSVADICASGCSCIQFSEMQSPQAIEYRQWEARVEDEAGEEAREPVIYSQDQLSSMLTTQQNFVFSLDAVVKQAIWRFRSKGLLTMERKALGEEFLTAIFSYLGSQERNENMGKRTTEEHEVVISFEELDRMVQVLPAEVPADSGNDPTHPVPNPDSNPDSSQNEGS

SEQ ID NO: 491 - protein, 148 aa, Chlamydia pneumoniae
STKIQMHPGLRNWRTSTNKLREEGSVSFREYFRAYMCDKIVAQKNFLFTLDAVIKQAGWRSQEKLNLFYVESQALGREIKVSLEEYIQSMVGILGSQRTKKSFKFSVDFTPLEQALQERCSSDDDEDATAASTATGATASPTDMHEDE

SEQ ID NO: 492 - protein, 283 aa, Chlamydia pneumoniae
VIQHLLNFALEETPSISVQYQEQEKLSPCDHSPEIGKKKRWNKLESFSTYCSLFMSVKDHYKLNLGIQNSLSGWLLDPYRVCAPLSSPYSCPSYLLDLQNKELRRSLLSTFLDPKNLTSETFRSVSINFGNSSFGQRWSEFLSRVLHDEKEKHVAVVCNDAKLLEEGLSPEALSLLEEDLRESGYSYLNILSVSPEGVSKVQERQILRRDLQGRSFTVMITDLPLGSEDIRSLQLASDRILVSSSLDAADACASGCKVLVYENPNASWAQELENFYKQVERRR

SEQ ID NO: 493 - protein, 169 aa, Chlamydia pneumoniae
LESPHFPRRSRQSTRENPRRSLRRYHTHRNCPTFSLIEELSTVDEALQGVRSRLTYAYRSVEKPMIQDLALVGFGLRDSADLINFVRLANGVQNHYPHTKVKLYLAKNLADVWDCEISEEEKGQLRALGLDPKIESISLTSAGLPSVPEVATVDFMITCYGKDQEVQDP

SEQ ID NO: 494 - protein, 135 aa, Chlamydia pneumoniae
ISTVACPSISSWFTVVRQHFVNAFDFTHPVCSRITNFALGIIKAIPVLGHIVMGIEWLISWIPRHTVRHGMFTSDVSSAIKVEQTRGHNCLAPLEAYLSSLRVPISQEDLGKVHGRTPEDPFVDITPTEIVQPSP

SEQ ID NO: 495 - protein, 156 aa, Chlamydia pneumoniae
FLSALDAADACASECKILEYEDPEQEWAQQYASFYRNIDRAGDLQRQGIPGEPLGVSASTRVVLEKDIVFNLNAVIQQAMWKFKKRDLFAVESQALGDDMRRALEGYIGSSLLVEGTIQPQVACNVNVSFATLDEAVCAACDSAQDAPSEENNTDD

SEQ ID NO: 496 - protein, 542 aa, Chlamydia pneumoniae
LIFYLFLNLYIACVRFHFQCWFDPMACYISIWISTVKQHFIRAFDFTRPLGSRITNFALGVIKAIPILGCVVIGVSWLVSTCSARRFGKPAFTSDVASIVKIEKTRGYNPLAWVEQYLRQLRVRLPEGDLGKIHGKVSRDYVCDRTPQENLNMVPHQYLGELGRAFYGIRNRVTKAYQRVTPLEVPCLTLVGFDILDPEDQVNFVRLANGIQTQYPQTQIKLYLISIQKIWNQCDGTISQEKEQQLRSLGLDAKIKCVSAPALLLQKYLQSENLPSCDLLINYYGKQQSVRDVDSIKSLLNLSSEHIPAISVTYRPDDPFYSYYFFPGSQGGTAPDQRIPWSEQEHLQTYTTLSNPRCDRYAVHLGMEDFASGVFLDPLRVSAPLSGEYSCPSYLLDLKSEELRCFLLSAFIDPNNSGQGNPRPMSINFGNSPLGQRWSEFLSRVLHDETEKHVAVVCNNPQLIKKSFPSHSLSLLENELEESGYSYLNIVSVSQERTCVKERRILSSDPSGRSFTVILTDLPEGSSDIRNLQLASDRILVS

SEQ ID NO: 497 - protein, 430 aa, Chlamydia pneumoniae
LSSPYEKTEQLLGTPNCRTPRVNISTVGIPIDETSNAFVDSMMKQGVGQDAKELYTFLSRGNEHYQPCLWFSLEEELGFLFDEKMLCAPLSEDHYCHSYLVDLVDQHLKDLILSMFLDPQNISAGELLKVSINVGDSFSPLQQKDFLSMVLRDETGKNVVVVFKGVLSLPATQVCKLVEELNSKDYSYLNIFSCHGDSSPQLLFRKELEGTSGRYFTVICALYLGDTDMRSLQLASERIMVSREFDLVDAYAARCKLLKIDHTNWRPGTFSRHADFADAVDVSAGFNSREFKLITQANQGILESGELPLPSKTFWEGFLAFCDRVTVTRHFIPMLDAAIKQAVWTHKHPSLIDKECEALDLKTQCLPSIVSYLEYVTNSHEKTSKGPFIQKEIIADCSPLKEALFPGSDEDVPSTSEDPSDDHPSDLEDS

SEQ ID NO: 498 - protein, 186 aa, Chlamydia pneumoniae
SLETRGRFAEICLQLLFFDIQSLKFLQLFSEGTALNLFRIFAPLRNRVTTEYSRARQPDLHRIAIVYIGVLDSESSKILERLISYMSCIYSESQMYLRFFMGKNVNQSAVLSKLHVENLHIRCGFFSEDAVPESEPFDLSIYVHTDRSCPLPTKKRSSSWELQTVELPESIYPQSEFLLMRPRMLS

SEQ ID NO: 499 - protein, 136 aa, Chlamydia pneumoniae
LLENNRFFLFFKVKYFLKDSFLMSYYFSLWYLKVQQHFQAAFDFTRSLCSRISNFALGVIALLPIIGQLYVGLDWLLSRIKKPEFPSDVDQIVRVEHVVGHDHRSRVEDILKRQRLSLEPRDEGKVRGDLPSAPFF

SEQ ID NO: 500 - protein, 940 aa, Chlamydia pneumoniae
TSMRFFCFGMLLPFTFVLANEGLQLPLETYITLSPEYQAAPQVGFTHNQNQDLAIVGNHNDFILDYKYYRSNGGALTCKNLLISENIGNVFFEKNVCPNSGGAIYAAQNCTISKNQNYAFTTNLVSDNPTATAGSLLGGALFAINCSITNNLGQGTFVDNLALNKGGALYTETNLSIKDNKGPIIIKQNRALNSDSLGGGIYSGNSLNIEGNSGAIQITSNSSGSGGGIFSTQTLTISSNKKLIEISENSAFANNYGSNFNPGGGGLTTTFCTILNNREGVLFNNNQSQSNGGAIHAKSIIIKENGPVYFLNNTATRGGALLNLSAGSGNGSFILSADNGDIIFNNNTASKHALNPPYRNAIHSTPNMNLQIGARPGYRVLFYDPIEHELPSSFPILFNFETGHTGTVLFSGEHVHQNFTDEMNFFSYLRNTSELRQGVLAVEDGAGLACYKFFQRGGTLLLGQGAVITTAGTIPTPSSTPTTVGSTITLNHIAIDLPSILSFQAQAPKIWIYPTKTGSTYTEDSNPTITISGTLTLRNSNNEDPYDSLDLSHSLEKVPLLYIVDVAAQKINSSQLDLSTLNSGEHYGYQGIWSTYWVETTTITNPTSLLGANTKHKLLYANWSPLGYRPHPERRGEFITNALWQSAYTALAGLHSLSSWDEEKGHAASLQGIGLLVHQKDKNGFKGFRSHMTGYSATTEATSSQSPNFSLGFAQFFSKAKEHESQNSTSSHHYFSGMCIENTLFKEWIRLSVSLAYMFTSEHTHTMYQGLLEGNSQGSFHNHTLAGALSCVFLPQPHGESLQIYPFITALAIRGNLAAFQESGDHAREFSLHRPLTDVSLPVGIRASWKNHHRVPLVWLTEISYRSTLYRQDPELHSKLLISQGTWTTQATPVTYNALGIKVKNTMQVFPKVTLSLDYSADISSSTLSHYLNVASRMRF

SEQ ID NO: 501 - protein, 969 aa, Chlamydia pneumoniae
NEILTISDQNRKIKEPLVSKTPPKFLFYLGNFTACMFGMTPAVYSLQTDSLEKFALERDEEFRTSFPLLDSLSTLTGFSPITTFVGNRHNSSQDIVLSNYKSIDNILLLWTSAGGAVSCNNFLLSNVEDHAFFSKNLAIGTGGAIACQGACTITKNRGPLIFFSNRGLNNASTGGETRGGAIACNGDFTISQNQGTFYFVNNSVNNWGGALSTNGHCRIQSNRAPLLFFNNTAPSGGGALRSENTTISDNTRPIYFKNNCGNNGGAIQTSVTVAIKNNSGSVIFNNNTALSGSINSGNGSGGAIYTTNLSIDDNPGTILFNNNYCIRDGGAICTQFLTIKNSGHVYFTNNQGNWGGALMLLQDSTCLLFAEQGNIAFQNNEVFLTTFGRYNAIHCTPNSNLQLGANKGYTTAFFDPIEHQHPTTNPLIFNPNANHQGTILFSSAYIPEASDYENNFISSSKNTSELRNGVLSIEDRAGWQFYKFTQKGGILKLGHAASIATTANSETPSTSVGSQVIINNLAINLPSILAKGKAPTLWIRPLQSSAPFTEDNNPTITLSGPLTLLNEENRDPYDSIDLSEPLQNIHLLSLSDVTARHINTDNFHPESLNATEHYGYQGIWSPYWVETITTTNNASIETANTLYRALYANWTPLGYKVNPEYQGDLATTPLWQSFHTMFSLLRSYNRTGDSDIERPFLEIQGIADGLFVHQNSIPGAPGFRIQSTGYSLQASSETSLHQKISLGFAQFFTRTKEIGSSNNVSAHNTVSSLYVELPWFQEAFATSTVLAYGYGDHHLHSLHPSHQEQAEGTCYSHTLAAAIGCSFPWQQKSYLHLSPFVQAIAIRSHQTAFEEIGDNPRKFVSQKPFYNLTLPLGIQGKWQSKFHVPTEWTLELSYEPVLYQQNPQIGVTLLASGGSWDILGHNYVRNALGYKVHNQTALFRSLDLFLDYQGSVSSSTSTHHLQAGSTLKF

SEQ ID NO: 502 - protein, 100 aa, Chlamydia pneumoniae
RCPVALDAAVSIGGEGSSPVVDGIVDKVESPLILRNREVSITGNRTPTSFSSCTRIVKTSIAEKNKGSSILRDCAGSLASNRASSPNREIFTEEGMVFNI

SEQ ID NO: 503 - protein, 275 aa, Chlamydia pneumoniae
IYKLLDNKLMIFYDKLYFHIKVWMFMRPICLSILSTALCCSLSGNEVPNLASCQMSRKDISAFHTSPSFRLNVTPEPLVSSFRPSNLLNGFGHDITQDITITGNSINSVIDYNYHYEDGGILACKNLFISENKGNLSFERNSSHSSGGALYSVRECWISKNQNYSFISNAASLATTTTSGFGGAIHALDSYITNNLGEGQFLDNVSKNRGGAIYVGVSLSITDNLGPIVIKKNQTLEDSSFGGGIFCRAVNIERNYQNIQINDNASGQGVVYFLP

SEQ ID NO: 504 - protein, 354 aa, Chlamydia pneumoniae
CFRTRGGIFSALGVIISSNKEIIEISNHSASSINTASGKLYPGGGGIMCTSLVIENNPKGLIFNNKTAALSGGAIHTRSFIFQNNGPTAFINNSATSGGALINLSGIGSTPQNFFLSADYGDILFNNNTITSSSPQPGYRNALYAAPGINLKLGARQGYKILFYDPIDHDQTTTDPIVFNYEPHHLGTVLFSGINVDSNATNPLNFLSKFSNSSRLERGVLAIEDRAAISCKTLSQTGGILRLGNAALIRTKGPGSSINFNAIAINLPSILQSEASAPKFWIYPTLTGSTYSEDTSSTITLSGPLTFLNDENENPYDSLDLSEPRKDIPPPLPPRCDCKKNRYFESHCRSHELR

SEQ ID NO: 505 - protein, 392 aa, Chlamydia pneumoniae
ISLNLERISPLLYLLDVTAKKIDTSNLIVEAMNLDEHYGYQGIWSPYWMETTTTTSSTVPEQTNTNHRQLYVDWTPVGYRPNPERHGEFIANTLWQSAYNALLGIRILPPQNLKEHDLEASLQGLGLLINQHNREGRKGFRNHTTGYAATTSAKTAARHSFSLGFAQMFSKTRERQSPSTTSSHNYFAGLRFDSLLFRDFISTGLSLGYSYGDHHMLCHYTEILKGSSKAFFNNHTLVASLDCTFLPARITRTLELQPFISAIALRCSQASFQETGDHIRKFHPKHPLTDLSSPIGFRSEWKTSHHIPMLWTTEISYVPTLYRKNPEMFTTLLISNGTWTTQATPVSYNSVAAKIKNTSQLFSRVTLSLDYSAQVSSSTVGQYLKAESHCTF

SEQ ID NO: 506 - protein, 822 aa, Chlamydia pneumoniae
  SITE 1...822: Xaa=unknown or other
TVQNNRSLSKSSFFVGALILGKTTILLNATPLSDYFDNQANQLTTLFPLIDTLTNMTPYSHRATLFGVRDDTNQDIVLDHQNSIESWFENFSQDGGALSCKSLAITNTKNQILFLNSFAIKRAGAMYVNGNFDLSENHGSIIFSGNLSFPNASNFADTCTGGAVLCSKNVTISKNQRTAYFINNKAKSSGGAIQAAIINIKDNTGPCLFFNNAAGXTAGGALFANACRIENNSQPIYFLNNQSGLGGAIRVHQECILTKNTGSVIFNNNFAMEADISANHSSGGAIYCISCSIKDNPGIAAFDNNTAARDGGAICTQSLTIQDSGPVYFTNNQGTWGGAIMLRQDGACTLFADQGDIIFYNNRHFKDTFSNHVSVNCTRNVSLTVGASQGHSATFYDPILQRYTIQNSIQKFNPNPEHLGTILFSSAYIPDTSTSRDDFISHFRNHIGLYNGTLALEDRAEWKVYKFDQFGGTLRLGSRAVFSTTDEEQSSSSVGSVININNLAINLPSILGNRVAPKLWIRPTGSSAPYSEDNNPIINLSGPLSLLDDENLDPYDTADLAQPIAEVPLLYLLDVTAKHINTDNFYPEGLNTTQHYGYQGVWSPYWIETITTSDTSSEDTVNTLHRQLYGDWTPTGYKVNPENKGDIALSAFWQSFHNLFATLRYQTQQGQIAPTASGEATRLFVHQNSNNDAKGFHMEATGYSLGTTSNTASNHSFGVNFSQLFSNLYESHSDNSVASHTTTVALQINNPWLQERFSTSASLAYSYSNHHIKASGYSGKIQTEGKCYSTTLRGGSLLLSISTMAITTSPLHSFYPSNCRSF

SEQ ID NO: 507 - protein, 155 aa, Chlamydia pneumoniae
GAALSCSLSLQWRSRPLHFTPFIQAIAVRSNQTAFQESGDKARKFSVHKPLYNLTVPLGIQSAWESKFRLPTYWNIELAYQPVLYQQNPEVNVSLESSGSSWLLSGTTLARNAIAFKGRNQIFIFPKLSVFLDYQGSVSSSTTTHYLHAGTTFKF

SEQ ID NO: 508 - protein, 778 aa, Chlamydia pneumoniae
EVFMASGIGGSSGLGKIPPKDNGDRSRSPSPKGELGSHEISLPPQEHGEEGASGSSHIHSSSSFLPEDQESQSSSSAASSPGFFSRVRSGVDRALKSFGNFFSAESTSQARETRQAFVRLSKTITADERRDVDSSSAAATEARVAEDASVSGENPSQGVPETSSGPEPQRLFSLPSVKKQSGLGRLVQTVRDRIVLPSGAPPTDSEPLSLYELNLRLSSLRQELSDIQSNDQLTPEEKAEATVTIQQLIQITEFQCGYMEATQSSVSLAEARFKGVETSDEINSLCSELTDPELQELMSDGDSLQNLLDETADDLEAALSHARLSFSLDDNPTPIDNNPTLISQEEPIYEEIGGAADPQRTRENWSTRLWNQIREALVSLLGMILSILGSILHRLRIARHAAAEAVGRCCTCRGEECTSSEEDSMSVGSPSEIDETERTGSPHDVPRRNGSPREDSPLMNALVGWAHKHGAKTKESSESSTPEISISAPIVRGWSQDSSVSFIVMEDDHIFYDVPRRKDGIYDVPSSPRWSPARELEEDVFGDYEVPITSAEPSKDKNIYMTPRLATPAIYDLPSRPGSSGSSRSPSSDRVRSSSPNRRGVPLPPVPSPAMSEEGSIYEDMSGASGAGESDYEDMSRSPSPRGDLDEPIYANTPEDNPFTQRNIDRILQERSGGASASPVEPIYDEIPWIHGRPPATLPRPENTLTNVSLRVSPGFGPEVRAALLSESVSAVMVEAESIVPPTEPGDGESEYLEPLGGLVATTKILLQKGWPRGESNA

SEQ ID NO: 509 - protein, 511 aa, Chlamydia pneumoniae
GSIMAVGGVGGSRSPSPIPPNRRNSEDGKVSPKDNLGEHTVSSSDSSLASQGPTIEERKAQLGGTDKIPLPSVKEPGDSPTSGRSGVLQRIWKGVKGVFKKTPQARPEVSSPRLPSHVQHGQRLPGLEGFRDRIQKRSENPEADLGKMKRSYSDGDLDRVGHDSNEDSTEDSRSEGGEPSSKSSSFLSGVRGAVSKVHGALGDIKGKFQRSASEDDLTTQGEDSAGDTVKERRSEEAEASSKSSSFLSGVRGATSTVQGALGDAKEKVSAFGEQAAGAIRSAPGNIRTRFQRSSSEGDLSNVNKAAKHLRKALENLEKVAPEQVSPEVASRVQSLLARMEQLTHQEPPTVEDLITFVESNVGSDSVEYASIVPQDGSQAPAETAEAPETGGVEGSAAQGAWKALRDFVVSIFQAVASFFRAIASRLSSARRESAVDDLASESNTQWFVEQEGVSNPSAAPSLSFAEEIARRAAEMSNRNAQSLEKLESGNVTDPVIQQGLGLARSFAPEGQ

SEQ ID NO: 510 - protein, 122 aa, Chlamydia pneumoniae
MTGSVTLPDSNFSRLWAFLLLISAALRAISSAKDKLGAADGFETPSCSTNHCVLLSDARSSTADSRRAELNLEAIALKKLATAWNMLTTKSRNAFHAPCAADPSTPPVSGASAVSAGACDPS

SEQ ID NO: 511 - protein, 598 aa, Chlamydia pneumoniae
LKIIISISFMSTSPISNDPRYLSLSNATEKTSLLANSRSLSPVPNSLVPSNPEDTGLRKSIFTHSVTLFAGLVVLLVAVSVVVVALTVLAPGVPQAILLGIAISGVGIGGFSIMKSLVYMVRDYMSPRMQESSRIKSALAVGTGFTVMGLVMKVGANFVPGGYGGLVGSLGSSAYSRGSQTTLASFSHYIYTKFFRSEKVAKGEKLTEAETIKEAKKLHYITLSIATIGVGLAVLGILLAIAGTVLLGGAPATIAIILAPPLISIGLTTVLQTILHSSIGKWRAFLLTQEKKDLFVDTSLKDIRLEKLPPSEVEESETSQSVIEVPDSEGIAETRISAEEIDTRLSLTTRQKVIFALATLLLLASIAAFIVTGFGGLTVMQVLLVASVGSAVASVTLPMVSSGFSYVAYQLKARLNISKLRWKEAKNKKRVRQFLIESGVIASDREFNQMWKTVYKKQIQKTDAAIREEVRNFEKGGEVNSALVGGILLGVGTGIMLLALVPAFAPIVPGILALGGSTLGIAGSILMRKFVNWLYDELVKLYERRRNRRELLYGPESKMRSIATDLVVEALAASHDHLFDLDGPVDFIDVDVDIDGAA

SEQ ID NO: 512 - protein, 99 aa, Chlamydia pneumoniae
GTPGAKTVKATTTTETATSKTTRPANKVTEWVKILFRNPVSSGLLGTREFGTGERLRLFARREVFSVALDKDKYRGSLLIGDVDIKEILIIIFNYKINY

SEQ ID NO: 513 - protein, 722 aa, Chlamydia pneumoniae
PSMVDKLIHPWDLDLLVSGRQKDPHKLLGILASEDSSDHIVIFRPGAHTVAIELLGELHHAVAYRSGLFFLSVPKGIGHGDYRVYHQNGLLAHDPYAFPPLWGEIDSFLFHRGTHYRIYERMGAIPMEVQGISGVLFVLWAPHAQRVSVVGDFNFWHGLVNPLRKISDQGIWELFVPGLGEGIRYKWEIVTQSGNVIVKTDPYGKSFDPPPQGTARVADSESYSWSDHRWMERRSKQSEGPVTIYEVHLGSWQWQEGRPLSYSEMAHRLASYCKEMHYTHVELLPITEHPLNESWGYQVTGYYAPTSRYGTLQEFQYFVDYLHKENIGIILDWVPGHFPVDAFALASFDGEPLYEYTGHSQALHPHWNTFTFDYSRHEVTNFLLGSALFWLDKMHIDGLRVDAVASMLYRDYGREDGEWTPNIYGGKENLESIEFLKHLNSVIHKEFSGVLTFAEESTAFPGVTKDVDQGGLGFDYKWNLGWMHDTFHYFMKDPMYRKYHQKDLTFSLWYAFQESFILPLSHDEVVHGKGSLVNKLPGDTWTRFAQMRVLLSYQICLPGKKLLFMGGEFGQYGEWSPDRPLDWELLNHHYHKTLRNCVSALNALYIHQPYLWMQESSQECFHWVDFHDIENNVIAYYRFAGSNRSSALLCVHHFSASTFPSYVLRCEGVKHCELLLNTDDESFGGSGKGNRAPVVCQDQGVAWGLDIELPPLATVIYLVTFF

SEQ ID NO: 514 - protein, 340 aa, Chlamydia pneumoniae
GRGRRADWGDCMIDIMQHFKPYTMVPGQKLPIPGSLLYAQVFPTLWRLFSSKHEILNEQTLQVQGPLKRFAVFQDLHRGGLAVTSERYKYYLLPSGECTQSIKGKLPSAAQAGPLLSLGVHKHADWQKVRCRRDLKEILPLWFRFAAMAPKGSYRDLETTAIGSLVKTAHQRVLHRETTEIAPALLSIALAGFSECFLPRSYDEEFQGILPQDGDPEGGVPFELLSYSFGMIQDIFLRHQGQLVEILPALPPEFPCGRLIHVALPNLGTLSIVWTKKTIRQVELHAEYSGEVFLKFCSSLCSARLREWSERRLSGSKRLSLGETLEIKAGTTYLWDCFHK

SEQ ID NO: 515 - protein, 423 aa, Chlamydia pneumoniae
RYMTVAEVKGTFKLVCLGCRVNQYEVQAYRDQLTILGYQEVLDSEIPADLCIINTCAVTASAESSGRHAVRQLCRQNPTAHIVVTGCLGESDKEFFASLDRQCTLVSNKEKSRLIEKIFSYDTTFPEFKIHSFEGKSRAFIKVQDGCNSFCSYCIIPYLRGRSVSRPAEKILAEIAGVVDQGYREVVIAGINVGDYCDGERSLASLIEQVDQIPGIERIRISSIDPDDITEDLHRAITSSRHTCPSSHLVLQSGSNSILKRMNRKYSRGDFLDCVEKFRASDPRYAFTTDVIVGFPGESDQDFEDTLRIIEDVGFIKVHSFPFSARRRTKAYTFDNQIPNQVIYERKKYLAEVAKRVGQKEMMKRLGETTEVLVEKVTGQVATGHSPYFEKVSFPVVGTVAINTLVSVRLDRVEEEGLIGEIV

SEQ ID NO: 516 - protein, 472 aa, Chlamydia pneumoniae
LDTIDTPGEQGSQSFGNSLGARFDLPRKEQDPSQALAVASYQNKTDSQVVEEHLDELISLADSCGISVLETRSWILKTPSASTYINVGKLEEIEEILKEFPSIGTLIIDEEITPSQQRNLEKRLGLVVLDRTELILEIFSSRALTAEANIQVQLAQARYLLPRLKRLWGHLSRQKSGGGSGGFVKGEGEKQIELDRRMVRERIHKLSAQLKAVIKQRAERRKVKSRRGIPTFALIGYTNSGKSTLLNLLTAADTYVEDKLFATLDPKTRKCVLPGGRHVLLTDTVGFIRKLPHTLVAAFKSTLEAAFHEDVLLHVVDASHPLALEHVQTTYDLFQELKIEKPRIITVLNKVDRLPQGSIPMKLRLLSPLPVLISAKTGEGIQNLLSLMTEIIQEKSLHVTLNFPYTEYGKFTELCDAGVVASSRYQEDFLVVEAYLPKELQKKFRPFISYVFPEDCGDDEGRGPVLESSFGD

SEQ ID NO: 517 - protein, 273 aa, Chlamydia pneumoniae
AIGMVRDIQSESIGKLVFLGTGNPEGIPVPFCSCRVCQNTGIHRLRSSVLIQYQNKTLVIDAGPDFRTQMLVAGVSELDGVFLTHPHYDHIGGIDDLRAWYIVTQRSLPLVLSASTYRFLNKAKEYLFATPNVESSLPAVLEFTILNEDCGQEEFQGIPYTYVSYYQKSCHVTGFRFGNLAYLTDLCSYDAKIFSYLDNVETLILSAGPSETPIPFQGHKSSHLTVEEAKAFANHAGIKNLIITHISHCLEAERDQHPEVTFAYDGMEVLWTL

SEQ ID NO: 518 - protein, 242 aa, Chlamydia pneumoniae
  SITE 1...242: Xaa=unknown or other
SDXXISWGISGRLGEFVSKKEQDCMLGSLPCYPGAGNIEEYKNRYFYCQLCAEVVSPYVVPVIVVDVQGAPPTGILQVLRCKQHKFQGLPVHGPITSLWALEPVGKGAPQLESAMYELCSQVRNFDICSIVSWVFGGLCIFAGLIVGVMVEAPLIAGLSAWVIPCIIGGVGAILCLFAILMAYLGRGRVREWLNLSHEYITQCHCRQIQAHSQNYSVITEYPATCALSQPITKLPNGSRRDN

SEQ ID NO: 519 - protein, 545 aa, Chlamydia pneumoniae
  SITE 1...545: Xaa=unknown or other
SCLRIEGILMATSVPVTSSTSVGEANSSNERFTERTSRMYYAALVLGALSCLIFIAMIVIFPQVGLWAVVLGFALGCLLLSLAIVFAVSGLVLGKTLEPSREATPPEIVAQKEWTTQQDVLGNEYWRSELISLFLRGDLHESLIVDSKDRSLDIDQSLQNILKLEPLSTTLSLLKKDCVHINIILHLVRQWNLLGVDLSPEVTAHAEELLLFLIEEQYYSPDILKLIRYGDALQATSPLMDWADSGSFSVDADGVFSCRREECSPEDALAQFDLLLALENPDRRFLKDSFLTYIWSSSFFEKFLHRHLESLQRKLPETAIDVARYEAQIQTFLSRYFQKLDLINAMSLDWGYNCAEGEKCYESANQRLDNLFIAFSSSVPAMKRLFDKYGSVVRVDRRQIREQILSNTEILENESGFLCSLYEYPLSYLIDWAVLLDCVRGTEISLEDQADYTVCLQGLDSMLSQFASRLQSGQKVLNPRDVLSEQAAVMLVHGLAAQGVSFQGLKALMYLTAVPQRMWLGALPLFESFPVFNRMXEFLGESLGD

SEQ ID NO: 520 - protein, 237 aa, Chlamydia pneumoniae
MIKQIGRFFRAFIFIMPLSLTSCESKIDRNRIWIVGTNATYPPFEYVDAQGEVVGFDIDLAKAISEKLGKQLEVREFAFDALILNLKKHRIDAILAGMSITPSRQKEIALLPYYGDEVQELMVVSKRSLETPVLPLTQHSSVAVQTGTFQEHYLLSQPGICVRSFDSTLEVIMEVRYGKSPVAVLEPSVGRVVLKDFPNLVATRLELPPECWVLGCGLGVLKIVLKKYKRFNKRLQI

SEQ ID NO: 521 - protein, 369 aa, Chlamydia pneumoniae
KLPNNRLRMVKTKNPMFPSRARRPQRTHPRLPPKLLHQRAQKSLKQPADKKPTPPPEAPPPPVRVATPMPLRPSSQGYWQCLNRMVSMVLRRAPLPLPAMQVDPILGDFNPHFVASYPNRINNEPMYFQIKQFKKIAQNPDLPQQHRRLAQLSLEQALYLNDNYYLVNVPGDGNCFYRAYAVGWLSALYEESSRNDIVFEQEATRLLDLPFASSSPANANLCAEMAELLQLCSTYCSFIDLYDGVILSQKHTATLIAFLRKLSAYAIRQQIAASSNEETARALFISDMQDDLLPSVLEFLAANRPYSELFQNLIDHSAHPTCNLETNSFFSWNICPLSFLLMQSFKRCLQKINNFESNMKEKYERLLLS

SEQ ID NO: 522 - protein, 637 aa, Chlamydia pneumoniae
  SITE 1...637: Xaa=unknown or other
SFRTPYMQSRDKLFLLLEHLPALFLTDAELQKMSPEDQQLRKQYEREIREAFAKLSRRIADSGWDTERFNAIVKDHLPEAIRCQYSRFLATIENRRSGDLPWSPALSFFAFLCTCPSVRFHKLCATFYKSLEDIIIASAPPQRSIQEILXISNASLSYLNEDLDSSWQREVISSNIMTILTTHESLTLESSMPQLETLHKRIANLLKNVISTSFETPPLSNQPDLLSNLVNKLLVAIHSKLELKEHFNTVCSARSLRLTRDEGSGLSQEQDLLYTQAVQLLFFILQHPQVNNRPETKDAVKELKMLLLPFLQYAFKKVENEKKLQKLLRSILGSLVLKPPARYPSTPSNKDKETFCKFWSRHPEVMVLDPILEKNCMQFLRATFPNYQLETEAILLEKEIESTFRNGWNVFLTRLNLFGSKLGSPSSPTALSDQFSKSFLIFCFLNNYPKLLQKKTPLAARLDAFQREASHRFTQVKDKLLLSLKYGFPLATATINQYSRARDQLICNLLKNTVTASDGFCRSGFRQSLIGYLHSLSSNELGDILDDVKEQAEANDVAAMTTVPLQPFAVCLIMSDRDTVSEENIENFVAMHGFLNTISPERDARIFLIRFPNHYGCLLPRNPRTEDQNSKPDSSNP

SEQ ID NO: 523 - protein, 298 aa, Chlamydia pneumoniae
RSELKTGQLKSLVLHEVLILTFTYPLPRTLKQHPDEVHTVPISPNLSFGEGSPILIAGPCTLESYEHTVSSALTVKEAGAQVFRGSIRKPRTSPFSFQGWEKECVLWHKEAQSIHGLPTETEVLDVRDVEITAEHVDILRIGAKNMHNTPLLQEVSKSHRPIILKRSPAATLEEWLCAAEYILASSPSCPGVILCERGIRTFEHSTRYTLDLNTVALLKEISSLPVIVDPSHAAGKRSLVLPLASAGLSVGADGLMIEVHAHPEKALCDAKQQITPEELHLFAKKHFCPSESRAHAIS

SEQ ID NO: 524 - protein, 465 aa, Chlamydia pneumoniae
  SITE 1...465: Xaa=unknown or other
AQHRSLLKGNIXHLGCGVLYFMNFSLFLFFLIAIQGICLYVGRRGSKKVEDRESYFLAGRSLKIFPLMMTFIATQIGGGVLLGAAEEAFCYGYGGILYPLGVALGLIFLGMGPGKRLAEGSLTTVVSIFEVFYGSKKLRKIAFLLSAGSLFFILVAQVIALDRLFSSFPFGKYVTVAFWIVLASYTSTGGFRGVVRTDVIQAGFLLIAVLVCGVSVWLSVPKSLSVLDPFQSLPCAKFSNWIFMPMLFMLVEQDMVQRCVAASSPKRLQWAAVGAGLVLLLFNFIPLFLGSLGAKAGLKAGCPLIDTIAYFCNPSLAAVMAAAIGVAILSTADSLMNAVSQLIAEEYPTLKAPYYRYLVLGLAVAAPLVAIGFTNIVDVLILSYSLSVCCLSVPVGFYLLAPKGRRVSGAAAWAGVLVGALGYGWVQIVSLGMFGELLAWVGSLVAFSFVGFIEITWKNKVKTQT

SEQ ID NO: 525 - protein, 237 aa, Chlamydia pneumoniae
GLRSPQPLVCEAASAALCSLGIHGVPLAKEHLESLSSRKAAANLSILLLVSREDIERAGDVIARYLSNPEMCWAIEYFLWDAQWNLRGDTFPLYSDMIKREIGRKLIRLLAVARYSQAKAVTATFLSGQQAQGWSFFSGMFWEEGDVKTSEDLVTDACFAAKLEGALASLCQKKDQASLQRVSQLYNDSRWQDKLAILESVAFSENLDAVPFLLDCCHHEAPSLRSAAAGALFSIFK

SEQ ID NO: 526 - protein, 356 aa, Chlamydia pneumoniae
RRTGGISLTYSSFRWASFRCYSLIFFCFCGSLFGSESLRYQLLIQDFAKVSEEGIGLLESKEYSLLQAKLVLRALAQNSSFDDWFRSFKKCQISYPELAHDRDVLEEFGIQVLREGIENPSVTVRAVSVLAIGLARDFRLVPLLLQSCNDDSAIVRSLALQVAVNYGSESLKKAIVELARNDDSIHVRITAYQVVALLQIEELLPFLRERAENKLVDSVERREAWKACLELSSQFLETGVAKDDIDQALFTCEVLRNGMLPETTEIFTELLSVEHPEVQESLLLSALAWSHQLQNHKEFLSKVRHVMCTSPFAKVRFQAAALLHLHGDPLGRDSLVEGCALLNLLCVRQLRRLSAL

SEQ ID NO: 527 - protein, 110 aa, Chlamydia pneumoniae
MTVFKQIIDGLIDCEKVFENENFIAIKDRFPQAPVHLLIIPKKPIPRFQDIPGDEMILMAEAGKIVQELAAEFGIADGYRVVINNGAEGGQAVFHLHIHLLGGRPLGAIA

SEQ ID NO: 528 - protein, 130 aa, Chlamydia pneumoniae
NHLIPWDILKSWYRFFRNDKKMNRSLRKTIFYSYEIFVFKYLFTIYQSIDNLFEYCHMIPRSCNVNRKARWQLSLFVHTERKRPLWQNTAPGIPDTLDNSLPNKPAQFSGKGTRTSIRRSKFGGIPRKIH

SEQ ID NO: 529 - protein, 300 aa, Chlamydia pneumoniae
MEDWLRRIVGMQIPRSIGTHDGSFHADEVTACALLIIFDLVDENKIIRSRDPVVLSKCEYVCDVGGVYSIENKRFDHHQVSYDGSWSSAGMILHYLKEFGYMDCEEYHFLNNTLVHGVDEQDNGRFFSKEGFCSFSDIIKIYNPREEEETNSDADFSCALHFTIDFLCRLRKKFQYDRVCRGIVREAMETEDMCLYFDRPLAWQENFFFLGGEKHPAAFVCFPSCDQWILRGIPPNLDRRMEVRVPFPENWAGLLGKELSKVSGIPGAVFCHKGLFLSVWTNRESCQRALRLTLQDRGII

SEQ ID NO: 530 - protein, 154 aa, Chlamydia pneumoniae
  SITE 1...154: Xaa=unknown or other
IMYNLLHAHHDAASPDGRLVSHLKKLSPHIYEGEVLIENIPAYFLGFHLPQQCIQVNLKSSLAQLGVEAVLNHLELNKARKEARLHVLFMSQDPIATANVGAPRSLXVLSASSLLLMIADSYVRLVISTGCLRTQTVQDLRSYALGKNLSTSSL

SEQ ID NO: 531 - protein, 230 aa, Chlamydia pneumoniae
  SITE 1...230: Xaa=unknown or other
EPGSFVCKLFAADDRRLVRSPCYLNRMFTHTDRTGSPLLRFGKKLEHFITLEIINDRLVVFLPILPGTICYEETIYGFLPLMSKSLTRPHLKIRKFLPLYQMVTDRPPVPEDHKILLIKTEPLHIRTVFARVVQDLLPQGLRHTAADILEPTTQESGDIYEFYGSTSEPIERIPLEFFTLEPYKEHSFFFYRDMLQETLXSPQEVFRVFESIPEGENQAAMFISKGSELA

SEQ ID NO: 532 - protein, 356 aa, Chlamydia pneumoniae
ACLSSPKTLGSSNLESPHQMKDMLGKFKSTLKTQPCFPFLKAMETDHITSQGVLFSRYFPSASLKGMFLSNYSRYYLQHIYFQIPSPTSGEFFSNRDRSFLLDLYFAGISVFWADLESKRLLQYIKRRNKDVGMFVPKHQAEQFAQSYFIGIHGSCLIAGDYDEFLRELLTGMHTLSQQFTIPEFPPQTPLAILTGGGSGAMELANRVATELSILSCGNLISLDTTNAYVEAKMSYAIPDLLERQADFHVDLAVFVIGGMGTDFELLLELISLKTGKKALVPVFLIGPVDYWKSKITALYNSNHAVGTIRGSEWVHNCLFCLSSAKAGIAIFRRYLNHTLPIGPEHPVPEDGFVIV

SEQ ID NO: 533 - protein, 420 aa, Chlamydia pneumoniae
ILSSLYTVFTMKTAFHSCYSWFCWLFSFLVLFVGGIAGGEPLCPDCKYETKSVLRSDQLPDHLWNYENDCYLTGYVQSLLDMHFLDSRTQVVIEKNRAYLFSLPVDSSLSEAITNFVRDLPFICAVEICERPYGECITRSSAERPLLPKEKTLGMPIFCGKEGVWLPQNTILFSPLIADPRQVTNSAGIRFNEKVVGNRVGATIFGGDFILLRLFDVSRFHVDCDFGIQGGVFSVFDLDHPESCMVNSDFFVAGLWSGAIDKWSFRFRLWHLSSHLGDEFILTHPNFPRFNLSDEGVDLFISFRYTPQIRLYGGCGYIVSRDLTFPERPFYCEWGAELRPFGLREGNLHAQPIFAMHFRCWEEQKFGLDQSYILGMEWAKFQEIGRKIRAVLEYHQGFSKEGQFIREPCNYYGFRLTYGF

SEQ ID NO: 534 - protein, 96 aa, Chlamydia pneumoniae
SKTEGSHSKTSKGFVGRFVQWIRTFTGRGSKKRSPSSFSPTHPYIRLRTYTRSPKQSGVERKQEDAETSFIETPKGILKKPGNKDPKGKHVHWKDS

SEQ ID NO: 535 - protein, 421 aa, Chlamydia pneumoniae
MAIQKAGAFLRCLPSESRPYLEHAMRRNPHFSLLKPQYLFSEISKKLAQFRKENPEISVIDLSIGDTTQPLCRSITQAIKEFCVSQEKQETYRGYGPETGLEKLRTKIASEVYENRISPEEIFISDGAKPDIFRLFSFFGSEKTLGLQDPVYPAYRDIAHITGIRDIIPLACRKETGFIPELPNQQSLDILCLCYPNNPTGTVLTFQQLQALVNYANQHGTVLIFDAAYSAFVSDPSLPKSIFEIPEAKYCAIEINSFSKSLGFTGMRLAWNVIPKELTYDNNEPMINDWKRLFATTFNGASLLMQEAGYYGLDLFPTPPAISLYLTNAQKLKKSLETAGFSVHGGDHAPYLWVELPEGISDEEAFDFFLHQYHIAVTPGHGFGSCGQGFVRFSALTQPQNIALACDRLCTASLKETMVLA

SEQ ID NO: 536 - protein, 354 aa, Chlamydia pneumoniae
PPLYRFTKRNDGSCMTILRKLSQYLFFFSLFCSFIYVATCGSQPDSVSSPKIAIFLSFPHPLLEDCSKSCIETLKDFENLPEIVVLNAEDSIVKARKIARSLHTDKNVVAIVTLGTIATKVMSHIETQKPVIYAAVPDRESLTPPKNTMNIYGVNDTLDINQYCFAIQAVATNAQSIVYLKPSEPFPSDLQKEIVKKLHASGIEVIEISITSSTFKTRIRQAIDKRPSAIFIPLSPLSHKEGTAFLQEILKEKIPIITDDTSLISEEPALPVAWITKNQENKSQKIVHHLLYNNHDVDSLRKIIAQRLSPTTTFNEDIIKYLGIKLHKTERNQFLSFKSKKLEKSEKGKNVAVS

SEQ ID NO: 537 - protein, 290 aa, Chlamydia pneumoniae
QAKSRCSIDKYIPVVNRLLEVCGLPEAENVEDLIESSSAWVLTPEERFSGELVSICQVKDEHAFYNDLSLLHMTQAVPSYSATYDCAVVFGGPLPALRQRLDFLVREWQRGVRFKKIVFLCGERGRYQSIEEQEHFFDSRYNPFPTEENWESGNRVTPSSEEEVAKFVWMQMLLPRAWRDSTSGVRVTFLLAKPEENRVVANRKDTLLLFRSYQEAFPGRVLFVSSQPFIGLDACRVGQFFKGESYDLAGPGFAQGVLKYHWAPRICLHTLAEWLKETNGCLNISEGCFG

SEQ ID NO: 538 - protein, 400 aa, Chlamydia pneumoniae
LSVYLLIFYFCNCSTMSSVNQSSGTPNPEEVTSPESTEENKNVVSSDEAQATHAVALPIVTQLSLPEGVGTSSEETASNPKVDEIVAEVSSSRAVADQISSLVERVGELLDDLKGAQSLFTSFQSELKNCLPAWKSSTRRLETRGAGDNADIARLELFRSDYEAVLGHANQFHGKAHLILSKLTDVHHKLQGLSREDLSLAFDNNDRVLEHLGSLGLDVDAEGNWSLSCERGIPRLVLTADSMLVQIKKVNLPTVEELRTLQGTTESSSDPRVEESLSCCERLLNELRRLWANFVGFISSCYDNIVFVLMWIVRRINLLPGLGCLPFHNPDASQEDQRSSSGERSTRRERLSRRSDLSEEEMIVRAEGESIHPESPHGDGRNQPSRGDKQDSDSEEETEL

SEQ ID NO: 539 - protein, 568 aa, Chlamydia pneumoniae
  SITE 1...568: Xaa=unknown or other
MKTSQLFYKTSKNANKSAAVLSNELLEKAGYLFKVSKGVYTYTPLLWRVVSKMMNIIREELNAIGGQELLLPLLHNAELWQHTGRWEAFTSEGLLYTLKDREGKSHCLAPTHEEVICSFVAQWLSSKRQLPLHLYQIATKFRDEIRPRFGLIRSRELLMEDSYTFSDSPEQMNEQYEKLRSAYSKIFDRLGLAYVIVTADGGKIGKGKSEEFQVLCSLGEDTICVSGSYGANIEAAVSIPPQHAYDREFLPVEEVATPGITTIEALANFFSIPLHKILKTLVVKLSYSNEEKFIAIGMRGDRQVNLVKVASKLNADDIALASDEEIERVLGTEKGFIGPLNCPIDFXADETTSPMTNFVCAGNAKDKHYVNVNWDRDLLPPQYGDFLLAEEGDTCPENPGHPYRIYQGIEVAHIFNLGTRYTDSFEVNFQDEHGQTQQCWMGTYGIGVGRTLAACVEQLADDRGIVWPKALAPFSITIAFNGGDTVSQELAETIYHELQSQGYEPLLDDRDERLGFKLKDSDLIGIPYKLILGKSYQSSGIFEIESRSGEKYTVSPEAFPTWCQNHLA

SEQ ID NO: 540 - protein, 126 aa, Chlamydia pneumoniae
  SITE 1...126: Xaa=unknown or other
LTFSGSFPIMLSVTIVLVGLEMARSKVSKRDSKILDILFATTELYLKTGQPVGSKTLKESFCSDLSTATIRNYFAELEAEGFLKXNHTSGGRIPTDLALRHYVDHQEECPEAEISAPIFDKXSXLP

SEQ ID NO: 541 - protein, 304 aa, Chlamydia pneumoniae
  SITE 1...304: Xaa=unknown or other
ITKKNAQKLRFLPPFLIXSVXFPSESRNIIKDLQKATELLGEILDLPTFFSSPRFENDSVTNIQITQVDKQRAVTILSTEFGQIFTDTLWLPEACDTLSIKRIEKFLQNYIRKLPTNEELSKKEEHLSMSLYNEVVVRYLTRYCNFSEEDLYQTGMSKLLKYEAFKDPEVLALGLSLFENRRQMCELLNIGMHKGRATAFIGKELSDILGTSNPGCSVITIPYYMNRSPLGALGILGPINLPYKEALPLLKLFANKINETLTQSFYKFKLSFRRPLTSNCKLSNEPILRTEYSSIKLLPSKETL

SEQ ID NO: 542 - protein, 184 aa, Chlamydia pneumoniae
MTDTPPENEEQHESNVQNENEVEHLQQEIVTLKTELKEKNDKYLMALAESENSRKRLQKERQELMQYALENTLIDFLNPIESMEKALGFATQMSDDVKNWALGFNMILNQFKQIFEEKGIIEYSSIGQKFNPFLHEAVQTEETSEVPEGTILEEFAKGYKIGERPIRVAKVKVAKAPTPKENKE

SEQ ID NO: 543 - protein, 539 aa, Chlamydia pneumoniae
MSEHKKSSKIIGIDLGTTNSCVSVMEGGQAKVITSSEGTRTTPSIVAFKGNEKLVGIPAKRQAVTNPEKTLGSTKRFIGRKYSEVASEIQTVPYTVTSGSKGDAVFEVDGKQYTPEEIGAQILMKMKETAEAYLGETVTEAVITVPAYFNDSQRASTKDAGRIAGLDVKRIIPEPTAAALAYGIDKVGDKKIAVFDLGGGTFDISILEIGDGVFEVLSTNGDTLLGGDDFDEVIIKWMIEEFKKQEGIDLSKDNMALQRLKDAAEKAKIELSGVSSTEINQPFITMDAQGPKHLALTLTRAQFEKLAASLIERTKSPCIKALSDAKLSAKDIDDVLLVGGMSRMPAVQETVKELFGKEPNKGVNPDEVVAIGAAIQGGVLGGEVKDVLLLDVIPLSLGIETLGGVMTTLVERNTTIPTQKKQIFSTAADNQPAVTIVVLQGERPMAKDNKEIGRFDLTDIPPAPRGHPQIEVSFDIDANGIFHVSAKDVASGKEQKIRIEASSGLQEDEIQRMVRDAEINKEEDKNVVKLQMLKMKPIA

SEQ ID NO: 544 - protein, 135 aa, Chlamydia pneumoniae
KRREASDAKNEADSMIFRAEKAIKDYKEQIPETLVKEIEERIENVRNALKDDAPIEKIKEVTEDLSKHMQKIGESMQSQSASAAASSAANAKGGPNINTEDLKKHSFSTKPPSNNGSSEDHIEEADVEIIDNDDK

SEQ ID NO: 545 - protein, 234 aa, Chlamydia pneumoniae
  SITE 1...234: Xaa=unknown or other
ATQFTSETTGFLVQCPKLTGGAQLLKKPKRKPGRRTYGKSLKIFIPGTLFVHARKGFGFVSPDNPEEYPFDIFVPARDLRGALDGDHVIVSVLPYPRDGQKLKGTISEVLARGKTTLVGTITSLVSPTSALAYTSMSGSQSLIPVELLPGRTYKIGDRILLSTPPWVDKPQEGASPALQMLEFIGHITNAKADFQAIQAEYNLAEEFPPEVIEEASLFSQXXLTQVLQLSQRSP

SEQ ID NO: 546 - protein, 258 aa, Chlamydia pneumoniae
  SITE 1...258: Xaa=unknown or other
PKFSNSRKDLRDLLCFTIDSSTARDFDDAISLTYDHNNNYILGVHIADVSHYVTPHSHLDKEAAKRCNSTYFPGKVIPMLPSALSDNLCSLKPNVDRLAVSVFMTFTKSGHLSDYQIFRSVIRSKYRMTYDEVDNIIEKKHSHPLSKILNEMATLSKKFSDIREERGCIRFVLPSVTMSLDNLQEPVALIENHQTFSHKLIEEFMLKANEVVAYHISHQGVSLPFRSHEPPNDENLLAFQEXAKNMGFDITFTPTQRT

SEQ ID NO: 547 - protein, 286 aa, Chlamydia pneumoniae
  SITE 1...286: Xaa=unknown or other
KTTRPSPINSSKSLCLKQTKWSPIISPIKAFLYLFVVTNLPMMKTYSPSKXXQKTWALISRSLPHKEPDYQYLLQTTSAGHPLEQVLHSQFVRSMKTASYSTENKGHYGLKLDYYTHFTSPIRRYIDLIVHRLLFNPLSIDQTHLEIIVRACSTKERVSAKAENSFENLKKTRFINKFLQEQPKTTYHAYIITANHEGLSFVVTEFCHEGFIAAAELPKEYSLKKNALPESIPDKMKPGASRKVTIDSVNLLTQKIVWSIATTTEDKPKKIKKTPSKKKGTKKRAS

SEQ ID NO: 548 - protein, 201 aa, Chlamydia pneumoniae
KEPRNVLQEHFFLSEDVITLAQQLLGHKLITTHEGLITSGYIVETEAYRGPDDKACHAYNYRKTQRNRAMYLKRGSAYLYRCYGMHHLLNVVTGPEDIPHAVLIRAILPDQGKELMIQRRQWRDKPPHLLTNGPGKVCQALGISLENNRQRLNTPALYISKEKISGTLTATARIGIDYAQEYRDVPWRFLLSPEDSGKVLS

SEQ ID NO: 549 - protein, 189 aa, Chlamydia pneumoniae
AWLRNSLTKFSFYTKHRALLKFVLQIILLFGLFFATVLLGFLTRIMIFKSLLSIYDKILHRIPIIKTVYKAAQQVMTTIFGSKSGSFKQVVMVPFPNANVQCIGLVAGDAPTVCCTGEKEDDPLVTVFIPTTPNPTSGFLTLFRKSDIVFLDMKIEDAFKYIISCGVLSTPMACPSSPLPDELHQDQGS

SEQ ID NO: 550 - protein, 390 aa, Chlamydia pneumoniae
QLNMLHILLAIFCILLFLAFGLTQPSCHGSSKFLKTLNQRFFTDKGREYPPFPSAPTILATLLCILYGALGTKLYTLLPPKTAHKDLLFWPLYSLSALIAYGFLPPWISTKVPKETTAHLRFLASVFQLGLFPLQLLFYRRRPNQQVRSSTSFQSQLSEALSAFDNLIVREVMIPKVDIFALPEETTLQEALVLVSEEGYSRVPVYKKNLDNITGILLVKDLLLLYTSSHDLSQPISSVAKPPFYAPEIKKASSLLQEFRQKHRHLAIIVNEYGFTEGIATMEDIIEEIIGEIADEHDVQENTPYKKIGSSWIVDGRMNISDAEEYFNLKIDHENSYDTLGGHVFHKVGAVPQKGMRIHHENFDIEIITCTERNVGKLKITPRKRKFNIS

SEQ ID NO: 551 - protein, 116 aa, Chlamydia pneumoniae
MSDIQKEEHGSTTIFHLHGKLDGISSPEVQENIYQSLAAGSKNIILDCAHLDYMSSAGIRVLLQSYHQVGQHSGKIVLTTVPKTIEQTLYVTGFLSYFKIFNTVDEAIQTLNKDGD

SEQ ID NO: 552 - protein, 212 aa, Chlamydia pneumoniae
SLPLTMRRSVCYVNPSIARAGQISTWKFLYSLATPLPAGTKCKFDLAGSGKPTDWEAPATDLSQTRNVIYAEMPEGEIIEATAIPVKDNPVPQFEFTLPYELQVGETLTIVMGASPNHPQVDDAGNGAQLFAQRRKPFYLYIDPTGEGNYDEPDVFSMDIRGNVLKKIEIFTPSYVVKNKRFDITVRFEDEFGNLTNFSPEEDPNRAFLRAS

SEQ ID NO: 553 - protein, 457 aa, Chlamydia pneumoniae
  SITE 1...457: Xaa=unknown or other
RSLLPPMSLKTNASISPCDLKTNSGTSPTSLLKKTRIELSYEHLRENLNWQLFIPETGFVILPNLYFNEPGIYRIQLKNLSTQXIFISAPIKCFADSAPNLMWGLLHGESERVDSEENIETCMRYFRDDRALNFYASSSFENQENLSPDIWKLINQTVSDFNEEDRFITLSGFQYSGEPHLEGVRHILHTKETKSHSKHKEYKHIPLAKLYKSTVNHDMISIPSFTASKEHGFDFENFYPEFERVVEIYNAWGSSETTAALNNPFPIQGKDSEDPRGTVIEGLKKNLRFGFVAGGLDDRGIYKDYFDSPQVQYSPGLTAIICNKYTRESLVEALFARHCYATTGPRIVLSFNITSAPMGSELSTGSKPGLNVNRHISGHVAGTALLKTVEIIRNGEVLHTFFPDSNNLDYEYDDMVPLSSVTLKDPNGKAPFVFYYLRVTQADNAMAWSSPIWVDLN

SEQ ID NO: 554 - protein, 409 aa, Chlamydia pneumoniae
LAGPSLKGVKNQIAAKKKHVTKQSTVLQNLERIVHQSVHQMTTCLPQPPKTSPPYSIFEKLDAQERLSSEDALHLLLLTNKEDQRTLWNFADQVRKQRVGDTVYYSSTLYLYPTNFCDFSCKFCSFYAKPGDPKGWLYSPDDLLQQIQNIKTPITEVHIVGGCFPSCNLQYYSDLFTKIKEYDPQIHIKALTAIEYAYLSDLDNLSIRDVLLTLKDAGLDSIPGGGAEILVDKIRNFLAPKRLSSSDFLNIHKMAHQLGIHSNITMLCYHKEGPEDLVTHMVKVRDLQDETQGFKNFILLKFAQENNVLGKRLRKSGQGHAIPLKSLMAVARIFLDNFSNMKALWNYLGIEAALDLLSCGANDLSSTHMGEKVFQMASSKEPIKMDAEGMAALITQQGRTPCLTNSSHV

SEQ ID NO: 555 - protein, 277 aa, Chlamydia pneumoniae
GNGGPHHTTRENAMSNQLQPCISLGCVSYINSFPLSLQLIKRNDIRCVLAPPADLLNLLIEGKLDVALTSSLGAISHNLGYVPGFGIAANQRILSANLYAAPTFFNSPQPRIAATLESRSSIGLLKVLCRHLWRIPTPHILRFITTKVLRQTPENYDGLLLIGDAALQHPVLPGFVTYDLASGWYDLTKLPFVFALLLHSTSWKEHPLPNLAMEEALQQFESSPEEVLKEAHQHTGLPPSLLQEYYALCQYRLGEEHYESFEKFREYYGTLYQQARL

SEQ ID NO: 556 - protein, 237 aa, Chlamydia pneumoniae
LKNSGNIMEPSTNKPDCKKIFDSIASKYDRTNTILSLGMHHFWNRSLIQILGSGYSLLDLCAGTGKVAKRYIAAHPQASVTLVDFSSAMLDIAKQHLPQGSCSFIHSDINQLPLENHSYPLAAMAYGLRNLSDPHKALQEISRVLMPSGKLGILELTPPKKTHPTYSAHKLYLRAVVPWIGKSVSKDPDAYSYLSKSIQQLPKDHDLEDLFSKSGFYIAKKKKLFLGAATIWLLEKQ

SEQ ID NO: 557 - protein, 550 aa, Chlamydia pneumoniae
RISISFRVSWFVKIILAVLGRAIAKAYYVCMVARGLCDFPTLVPNERLPIGPFFVPQHTSGAKGKEFAKRNFSIISGLDDILKLCILQRRPFALQWDNLSVKSDYEEAGPAIGIRSLEPQVSQISPAHGRLCSTLVQWAPILGSEERLVWLEETMKRLKFPKSLGSKDAVIVDSEMVPVNANPTQEIPAASETVESSPVAPGNTTDTMPAASGTTDTTSGVSEAAAAEATVDSTPGTEEEPSFSLRYALVVQNVPYPEPPKEPEVMFTDEEKSLILEATRARRMELDLYNGYLADYELSKDEIQKHVPDLPENWRTNWRWSERLYKFFFKTKKEGLEEIFLNKELGNMILARGLAATQSQARIKVFNSLVAWLLQSFNVGRSCTAKPLPTSKLDLFKSEFESKPKNNILTEFLVASDEEILFKGLRVLEPGIEGWYDHPDQAGEIRSVLEGLVQAGRISGYWENQPFGRFVLRGVGERRTELVELLESLVASGEIMQFFESSDEEGAFIIDNEPSKTAMLKQRFKSCVRTKLVGSFADESLPRGRFTILV

SEQ ID NO: 558 - protein, 325 aa, Chlamydia pneumoniae
FMMTYPVPQNPLLLRILRLMDAFSKSDDERDFYLDRVEGFILYIDLDKDQEDLNKIYQELEENAERYCLIPKLTFYEVKKIMETFINEKIYDIDTKEKFLEILQSKNAREQFLEFIYDHEAELEKWQQFYVERSRIRIIEWLRNNKFHFVFEEDLDFTKNVLEQLKIHLFDAKVGKEITQARQLLSNKAKIYYSNEALNPRPKRGRPPKQSAKVETETTISSDIYTKVPQAARRFLFLPEITSPSSITFSEKFDTEEEFLANLRGSTRVEDQLNLTNLSERFASLKELSAKLGYDSLSTGDFFGDDDEKVVTKTKGSKRGRKKSS

SEQ ID NO: 559 - protein, 261 aa, Chlamydia pneumoniae
LVYWMAFYSPSTISKYFIYSGAGNRFLLGETLPEVEDVRFLCQETRVDGFLYLKPSSCADAQLIIFNSDGSRPTMCGNGLRCAIAHLASQKGKSDISVSTDSGLYSGYFYSWDRVLVDMTLADWRASVHRLESRPDPLPKEIVCIHTGVPHAVVILPEISTLDLSILGPFLRYHQTFSPDGVNVNFVQILGHCQLRVRTYERGVEGETAACGTGALASALVVSNSYGWKESIQIHTWGGELMTVSQNRGRVYLQGSVTRDL

SEQ ID NO: 560 - protein, 196 aa, Chlamydia pneumoniae
ERHYFMADGEVHKLRDIIEKELLEARRVFFSEPVTEKSASDAIKKLWYLELKDPGKPIVFVINSPGGSVDAGFAVWDQIKMLTSPVTTVVTGLAASMGSVLSLCAAPGRRFATPHSRIMIHQPSIGGPITGQATDLDIHAREILKTKARIIDVYVEATNQPRDIIEKAIDRDMWMTANEAKDFGLLDGILFSFNDL

SEQ ID NO: 561 - protein, 519 aa, Chlamydia pneumoniae
LLKVFEKFKKFAIVEIFTKVVAVVSLLHKFLENASGKKGQSLASTAYLAALDHLLNAFPSIGERIIDELKSQRSHLKMIASENYSSLSVQLAMGNLLTDKYCEGSPFKRFYSCCENVDAIEWECVETAKELFAADCACVQPHSGADANLLAVMAILTHKVQGPAVSKLGYKTVNELTEEEYTLLKAEMSSCVCLGPSLNSGGHLTHGNVRLNVMSKLMRCFPYDVNPDTECFDYAEISRLAKEYKPKVLIAGYSSYSRRLNFAVLKQIAEDCGSVLWVDMAHFAGLVAGGVFVDEENPIPYADIVTTTTHKTLRGPRGGLVLATREYESTLNKACPLMMGGPLPHVIAAKTVALKEALSVDFKKYAHQVVNNARRLAERFLSHGLRLLTGGTDNHMMVIDLGSLGISGKIAEDILSSVGIAVNRNSLPSDAIGKWDTSGIRLGTPALTTLGMGIDEMEEVADIIVKVLRNIRLSCHVEGSSKKNKGELPEAIAQEARDRVRNLLLRFPLYPEIDLEALV

SEQ ID NO: 562 - protein, 367 aa, Chlamydia pneumoniae
  SITE 1...367: Xaa=unknown or other
KVFYKKNVMSGPSRTESSQVSVLSYVPRDKEIAPKKQFTIAKISTLAILASLALGALVAGISLTIVLGNPVFLALLITTALFSVVTFLVYHQMTSKVSSNWQKVLEQNFKPLGKAWQEKNVDCXSNEMQFYNNHLNPKFKVAIQTDAXQPFQPTFLTGLRVIEKNQSTGIIFNPVGPTNLIDNTATNLSTILYSTLKDKSVWDTCKQREGGPAKGEDPFSPTEVRVVKLPNEALDQTFNLNLSSAEKKSILPTFLGHVCGPKSEELPNQQEYYRQALLAYENCLKAAIESHAAIVALPLFTSVYEVPPEEILPKEGTFYWDNQTQAFCKRALLDAIQNTALRYPQRSLLVILQDPFNTIESQSRSEE

SEQ ID NO: 563 - protein, 258 aa, Chlamydia pneumoniae
  SITE 1...258: Xaa=unknown or other
GIIFMHDALLSILAIQELDIKMIRLMRVKKEHQKELAKVQSLKSDIRRKVQEKELEMENLKTQIRDGENRIQEISEQINKLENQQAAVKKMDEFNALTQEMTTANKERRSLEHQLSDLMDKQAGGEDLIVSLKESLASTENSSSVIEKEIFESIKKINEEGKALLEQRTELKHATNPELLSIYERLLNNKKDRVVVPIENRVCSGCHIVLTPQHENLVRXKDRLIFCEHCSRILYWQESQVNAQENSTAKRRRRRAAV

SEQ ID NO: 564 - protein, 329 aa, Chlamydia pneumoniae
MPSPMISTDVCQDILGKQKEAVDFFFQAFQPKEAMQLAEKILGHSGWVFFSGVGKSGCVARKLVATLQSLSERALFFSPVDLLHGDLGLVSPGDIVCLFSKSGETQELLDTVPHLKSRRAILVAITSMPYSNLAALSDLVVILPSVAELDPFNLIPTNSTTCQMIFGDFLAMLLFHSRGVSLSTYGKNHPSGQVGMKANGKVKDFMFPKTEVPFCHLGDKVSFSLEVFSAYGCGCVCIVDPQFRLMGIFTDGDLRRSLASYGGEVLSLSLEKVMTANPRCITEDSDIAIALQLMESSSPVAVLPVLDNEENRHVTGLLHMHTLAKAGLL

SEQ ID NO: 565 - protein, 393 aa, Chlamydia pneumoniae
MIFEFRFPKIGETSSGGSIVRWLKNLGDHVARDEPLIEVSTDKIATELPSPKAGRLVRFCVNEGDEVASGDVLGLIELEEISEADDESTSCPLTSCETKSEAGSSSSSVWFSPAVLSLAQREGIGLDNLQKIAGTGKGGRVTRQDLEAYISESQQVSIPEIFQGEVNRIPMSPLRRAIASSLSKSSDEVPHASLVVDVDVTDLMNLISGERQRFLDTHGVKLTITSFIVQCLAQTLRQFPLLNGSLDGTTIVMKKSVNVGVAVNLNKEGVVVPVIHNCQDRGLVSIAKALADLSSRARLNKLDPSEVQDGSVTVTNFGMTGALIGMPIIRYPEVAILGIGTIQKRVVVRDDDSLAIRKMVYVTLTFDHRVLDGIYGSEFLTSLKNRLESVTMG

SEQ ID NO: 566 - protein, 90 aa, Chlamydia pneumoniae
AKLSTAGENHTEELLEPASDFVSQEVRGHEVLSSSASEISSSSINPKTSPEATSSPSLTQKRTSRPALGEGNSVAILSVDTSIRGSSLAT

SEQ ID NO: 567 - protein, 415 aa, Chlamydia pneumoniae
LMKLWMKIFIGLFVGVTLGLVLEDKAIFFKPIGDIFLNLLSMVVYPLVFCSMVLGIASISDMKKLGRIGIKSVGLYLGTTALAIVIGLCFAWIFSPGNGCDFAQAQSMDSAVTVIDSNKTAAYFLSIIAQVFPSNPVRSFAEGNILQIIIFAIFLGIALRLSGERGRPVERFIDGFSEIMLRMVNMIMSFAPYGVGASMAWISGNHGLGVLWQLGKFIIAYYLACLFHATLVFGGLVRFGCKMSFSKFLSSMMDAISCAVSTASSSATLPVTMRCVSKNLGVSAEVSGFVLPLGATVNMNGTAIFQGMAAVFIAQAYNCPLSLSSLLLLVVTATFSAVGSAGVPGGGMITLGSVLASVGLPIQGIAILAGIDRLRDIVGTPMNILGDAVVATYVASGEGELSPYESIKQESVETT

SEQ ID NO: 568 - protein, 365 aa, Chlamydia pneumoniae
MKKRFPSTLFLFYRRVTIAISLEGILGWGWLGSLLSKVFAFLVACWNRFSWSTPYRARSTVISVGNIVVGGAGKTPTVLWLAEALRLRGYSCGVLSRGYKSQSSRQKKLTVVDSKVHSASYVGDEPLLMAEKLPEGSVWVHKDRRISAARAAEKFGILLLDDGLQYRKLHKDVEIAVVNGQDPLGGRAFFPKGRLRDFPLRLKTVDAIIVNGGGKEAGTVVKRVSNAPQIFVKPTIASVVWTHNGERIPKEALRELRVGVFCGLGFPQGFLNMLREEGIHILGKYLLPDHAAITKKELNYFCQQMAMRQGQGLLCTEKDSVKLPRLSGEVSLLPIAKVEMRLSVNQDDTLSLLNMIEQIHKNRGN

SEQ ID NO: 569 - protein, 287 aa, Chlamydia pneumoniae
VVLWGKFLWRRCGSLAFWEFCSMDCIGKHNPLVKEALALKRSRCRKSSWFLVEGAREIQKALRTGYLCQHVFCSTHLSEKEKEFLYELKRNSTKILYCLDSTLAQLSFKEHHDSFVAVIQKRVWNKEDFLIQRKNAQPFYLIIEQVEKPGNVGAILRIADGAGVDGVILCNPIVDLYNPNVVRSSLGAVFSLPILSISREEGKELFKQEGWTVFVTSPRAETMYFSKNYLGPTALVFGSEKDGLTEDWFSEDFSEIALPMLGESDSLNLATSVAAVAYEVVRQRWVN

SEQ ID NO: 570 - protein, 321 aa, Chlamydia pneumoniae
DSSKDDFRKEKGRRKSQYRDRYVNKDTGRHSKTYFSLIRERLVMDYKLLDSGDGNKLECFGPVTLIRPSSIAVWPKSRPELWSQAQLQYVREGERGAWKNFKRLPEEWEVAFSDVRCLLKRTPFGHLGVFPEHMGFWPALKQAIEKHKERQVLNLFAYTGAGSIFAAKCGARVTHVDASQAAVRWAQRNVEKNAFPERRIFWVIEDVISFLKKEIRRNKKYQVILLDPPSYGRGPDGEVFKIDKDLFPLLSLCSKLLADDASYFLLTSHTPGHTPEFLRAIARRRCQPLFLKRGLVGKVFVEKVWEPCLLGVLFNGLHRET

SEQ ID NO: 571 - protein, 200 aa, Chlamydia pneumoniae
MFSGIIQELGEVCFFEAQGNGLSLGIKSTPLFVTPLVTGDSVAVDGVCLTLTSCNESKIFFDVIPETLACTTLGEKRCSDQVNLEAALKMGDSIGGHLLSGHVFGTAEIFLIKENRYYFRGSKELSQYLFEKGFIAIDGVSLTLVSVDSDTFSVGLIPETLQRTTLGKKREGERVNIEIDMSTKIQVDTVKRILASSGKD

SEQ ID NO: 572 - protein, 152 aa, Chlamydia pneumoniae
MQCPFCNHGELKVIDSRNAPEANAIKRRRECLKCSQRFTTFETVELTLQVLKRDGRYENFQESKLIHGLNAASSHTRIGQDQVHAIASNVKSELLGKQNREISTKEIGELVMKYLKKADMIAYIRFACVYRRFKDVGELMEVLLSATPDMEK

SEQ ID NO: 573 - protein, 132 aa, Chlamydia pneumoniae
LNFIRSKVVPLSDDEIEQFKKRLLEMKAKLSHTLEGNAQEVKKPNEATGYSQHQADQGTDTFDRTISLEVTTKEYELLRQINRALEKINESSYGICDVSGEEIPLARLIAIPYATMTVKAQEQFEKGLLSGN

SEQ ID NO: 574 - protein, 168 aa, Chlamydia pneumoniae
MATRFRSTLLVITLFVLIDWVTKLVVLLQYKDLQILTHPTLYTHSWGRFSFSIAPVFNEGAAFGLFSNYKYFLFLLRIFVILGLLAYLFFKKKSIQSTTQTALVLLCAGAIGNVGDIIFYGHIVDFISFNYKQWAFPTFNVADVLISLGTLLLVYKFYFPTKQTEKKR

SEQ ID NO: 575 - protein, 449 aa, Chlamydia pneumoniae
MNRLLSLLSVFDDFFWSYVAFILIIVLGVSFSWKSRFFQFTKFSQFCKLFRYYSQNPQERETKQGVHPLKVFFASAGGNIGIGNVVGIVTAACIGGPGALFWVWIAGIFGSIVKYSEVYLGIKFRKLDRDGVYQGGPMYFLIKAFKTPVVSVIVAILLCIYGVEIYQFSVITDSLAHCWNLPKVYPMLGLLFLVFYAIRGGLQRIGKICSIVLPFFMLLYCALSLYILVKEFHTLPHLLSTVFSSAFKGQSALGGFAGCTVATTIHQGISRAAYSGDIGIGFDSIIQSESSAKDPSTQAQLSIVGIAIDNLICTLSLLMVLASGSWSLGLENASQVVEHTLASYFPMVKFFLPTFFFVTGYTTIISYFLVGKKCAKFLYGNTGAKIYTLYGLLILPLFCFLSQNTALLIMSVSGALLLCFNLLGVFILRKEVIFPARAASLTETSLSTE

SEQ ID NO: 576 - protein, 232 aa, Chlamydia pneumoniae
LIFLLFMDNYLLGSLIFCCVLLSIGMCTIFVMTICFLRQLNKILKNIHRVTTILNFEAKILAPLMLGKKLLCGWLKKRKNRGSLSEDIDELLDEKKQRSWKKNLDQGIKWCAHWSSFGKCFVIKIKTLRDIVMFRNNHKPKKTKCKRFRWLRGVLFGGFIATLLTCLFTPKSGVQLRKKILKVKNSGAKKSRVFFKNSKQHTKSFVKQAKLLAKNISHELQDFKKGILDDKD

SEQ ID NO: 577 - protein, 308 aa, Chlamydia pneumoniae
GYNLLGLRHMKQMRLWGFLFLSSFCQVSYLRANDVLLPLSGIHSGEDLELFTLRSSSPTKTTYSLRKDFIVCDFAGNSIHKPGAAFLNLKGDLFFINSTPLAALTFKNIHLGARGAGLFSESNVTFKGLHSLVLENNESWGGVLTTSGDLSFINNTSVLCQNNISYGPGGALLLQGRKSKALFFRDNRGTILFLKNKAVNQDESHPGYGGAVSSISPGSPITFADNQEILFQENEGELGGAIYNDQGAITFENNFQTTSFFSNKASFGGAVYSRYCNLYSQWGDTLFTKNAAAKVGGHPCGLCSYKRL

SEQ ID NO: 578 - protein, 660 aa, Chlamydia pneumoniae
ADIHADYVHIRDCKGSIVFEENSATAGGAIAVNAVCDINAQGPVRFINNSALGLNGGAIYMQATGSILRLHANQGDIEFCGNKVRSQFHSHINSTSNFTNNAITIQGAPREFSLSANEGHRICFYDPIISATENYNSLYINHQRLLEAGGAVIFSGARLSPEHKKENKNKTSIINQPVRLCSGVLSIEGGAILAVRSFYQEGGLLALGPGSKLTTQGKNSEKDKIVITNLGFNLENLDSSDPAEIRATEKASIEISGVPRVYGHTESFYENHEYASKPYTTSIILSAKKLVTAPSRPEKDIQNLIIAESEYMGYGYQGSWEFSWSPNDTKEKKTIIASWTPTGEFSLDPKRRGSFIPTTLWSTFSGLNIASNIVNNNYLNNSEVIPLQHLCVFGGPVYQIMEQNPKQSSNNLLVQHAGHNVGARIPFSFNTILSAALTQLFSSSSQQNVADKSHAQILIGTVSLNKSWQALSLRSSFSYTEDSQVMKHVFPYKGTSRGSWRNYGWSGSVGMSYAYPKGIRYLKMTPFVDLQYTKLVQNPFVETGYDPRYFSSSEMTNLSLPIGIALEMRFIGSRSSLFLQVSTSYIKDLRRVNPQSSASLVLNHYTWDIQGVPLGKEALNITLNSTIKYKIVTAYMGISSTQREGSNLSANAHAGLSLSF

SEQ ID NO: 579 - protein, 609 aa, Chlamydia pneumoniae
  SITE 1...609: Xaa=unknown or other
FIHLIYLSLIEFVNISDRFSSMKWLPATAVFAAVLPALTAFGDPASVEISTSHTGSGDPTSDAALTGFTQSSTETDGTTYTIVGDITFSTFTNIPVPVVTPDANDSSSNSSKGGSSSSGATSLIRSSNLHSDFDFTKDSVLDLYHLFFPSASNTLNPALLSSSSSGGSSSSSSSSSSGSASAVVAADPKGGAAFYSNEANGTLTFTTDSGNPGSLTLQNLKMTGDGAAIYSKGPLVFTGLKNLTFTGNESQKSGGAAYTEGALTTQAIVEAVTFTGNTSAGQGGAIYVKEATLFNALDSLKFEKNTSGQAGGGIYTESTLTISNITKSIEFISNKASVPAPAPEPTSPAPSSLINSTTIDTSTLQTRAASATPAVAPVAAVTPTPISTQETAGNGGAIYAKQGISISTFKDLTFKSNSASVDATLTVDSSTIGESGGAIFAADSIQIQQCTGTTLFSGNTANKSGGGIYAVGQVTLEDIANLKMTNNTCKGEGGAIYTKKALTINNGAILTTFSGNTSTDNGGAIFAVGGITLSDLVEVRFSKNKTGNYSAPITKAASNTAPVVSSSTTAASPAVPAAAAAPVTNAAKGGALYSTEGLTVSGITSXIVV

SEQ ID NO: 580 - protein, 1146 aa, Chlamydia pneumoniae
  SITE 1...1146: Xaa=unknown or other
LYLESHRXLSFENNECQNQGGGAYVTKTFQCSDSHRLQFTSNKAADEGGGLYCGDDVTLTNLTGKTLFQENSSEKHGGGLSLASGKSLTMTSLESFCLNANTAKENGGGANVPENIVLTFTYTPTPNEPAPVQQPVYGEALVTGNTATKSGGGIYTKNAAFSNLSSVTFDQNTSSENGGALLTQKAADKTDCSFTYITNVNITNNTATGNGGGIAGGKAHFDRIDNLTVQSNQAKKGGGVYLEDALILEKVITGSVSQNTATESGGGIYAKDIQLQALPGSFTITDNKVETSLTTSTNLYGGGIYSSGAVTLTNISGTFGITGNSVINTATSQDADIQGGGIYATTSLSINQCNTPILFSNNSAATKKTSTTKQIAGGAIFSAAVTIENNSQPIIFLNNSAKSEATTAATAGNKDSCGGAIAANSVTLTNNPEITFKGNYAETGGAIGCIDLTNGSPPRKVSIADNGSVLFQDNSALNRGGAIYGETIDISRTGATFIGNSSKHDGSAICCSTALTLAPNSQLIFENNKVTETTATTKASINNLGAAIYGNNETSDVTISLSAENGSIFFKNNLCTATNKYCSIAGNVKFTAIEASAGKAISFYDAVNVSTKXTNAQELKLNEKATSTGTILFSGELHENKSYIPQKVTFAHGNLILGKNAELSVVSFTQSPGTTITMGPGSVLSNHSKEAGGIAINNVIIDFSEIVPTKDNATVAPPTLKLVSRTNADSKDKIDITGTVTLLDPNGNLYQNSYLGEDRDITLFNIDNSASGAVTATNVTLQGNLGAKKGYLGTWNLDPNSSGSKIILKWTFDKYLRWPYIPRDNHFYINSIWGAQNSLVTVKQGILGNMLNNARFEDPAFNNFWASAIGSFLRKEVSRNSDSFTYHGRGYTAAVDAKPRQEFILGAAFSQVFGHAESEYHLDNYKHKGSGHSTQASLYAGNIFYFPAIRSRPILFQGVATYGYMQHDTTTYYPSIEEKNMANWDSIAWLFDLRFSVDLKEPQPHSTARLTFYTEAEYTRIRQEKFTELDYDPRSFSACSYGNLAIPTGFSVDGALAWREIILYNKVSAAYLPVILRNNPKATYEVLSTKEKGNVVNVLPTRNAARAEVSSQIYLGSYWTLYGTYTIDASMNTLVQMANGGIRFVF

SEQ ID NO: 581 - protein, 289 aa, Chlamydia pneumoniae
  SITE 1...289: Xaa=unknown or other
NNRSSYQTAFVMHKVIVXIFLTLYSLKSYGNDVIDKPHVLVSIAPYKFLVEQIAEETCFVYAIVTNHYDPHTYELPPQQIKELRQGDLWFRIGEAFEKTCERNLTCQQVDLSQNVSLIQGKPCCNQHTTNYDTHTWLSPKNLKVQVETIVTTLSKKYPQHATLYQSNGEKLLLALDQLNEEILTITSKAKQRHILVSHGAFGYFCRDYNFSQHTIEKSSHVEPSPKDVARVFRDIEQYKISSVILLEYSGRRSSAMLADRFHMHTVNLDPYAENILVNLKTIATTFSSL

SEQ ID NO: 582 - protein, 352 aa, Chlamydia pneumoniae
  SITE 1...352: Xaa=unknown or other
LKKDKNVIMFVDQITLELRAGKGGNGVVAWRKEKYLPKGGPYGGNGGNGGSVIIEATTSVYSFEAYRNIRFLKAPDGQSGATNNRTGRSGKDLIVSVPTGTLLRDAETGEILHDFTVDGERLLVSQGGKGGKGNTFFKTSVNRAPTKATPGKPGEIRQVELELKLIADIGLVGFPNAGKSTLFNTLAHTEVKVGAYPFTTLAPSLGLVLCKDRLYQKPWIIADIPGIIEGAHQNKGLGLDFLRHIERTLLLLFVIDVSKRERNSPEEDLETLIHELHSHQPDFEKKDMLVALNKIDDLLPDEQEECLQSFQKRFPSYTFVLISGLTGEGVDGLYRFFTQDSLYNXTPSAMIS

SEQ ID NO: 583 - protein, 84 aa, Chlamydia pneumoniae
MAHKKGQGASRNGRDSKSKRLGVKVGAGQKVSTGSILVRQRGTRWNPAQNVGRGRDDTLFALVDGIVVMKKTNRTYISVVPEQL

SEQ ID NO: 584 - protein, 107 aa, Chlamydia pneumoniae
LMEPYAVIQTGSKQYQVRSGDVIDVELLGEVASDKEVIFQDVLFVFDGTKASLGSPTIANAQVKAEYLSHVKGEKVVAYKYKKRKNYHRKHGHRQKYLRVKIREILI

SEQ ID NO: 585 - protein, 199 aa, Chlamydia pneumoniae
VNFRNFVVSSVKEILKKNIYQVVMDRDNEVPLPKPKWIYRTGIGQDSHRFLPESSTKPCILGGIIFDHCPGFQANSDGDIIFHAICNAISSVTNKIILGKVADELLQTRGITDSGIYLEEALKSLKPNQKISHVAITIEGSRPKFLCKLSALRQNIAQVMNLTPTDIGITATSGEGLSDFGCGDGVQCFCVLTVMEYCD

SEQ ID NO: 586 - protein, 246 aa, Chlamydia pneumoniae
IPAKLNSFFPDKDPKITLYDAIQEYRPQIPIELFAESVFPLLPRFYSIASSPDLHPKSIELLVKHVSYPGKYQKRFGVCSSFLCSELQVNDSAYIFVQPTKHFTLSTQTEGKPLVMIGAGTGIAPYKAFLEERLFNKDPGNNLLFFGERKEKVNFYYREFWNHAEEEGKLKLFLAFSRERDQKVYVQDLLRIQKDEVRKAYEEGGFFFVCGRKVLGIEVKHALEEILGKDTLASLRKEHRYVVDVY

SEQ ID NO: 587 - protein, 85 aa, Chlamydia pneumoniae
KMYLQEKFKAQQVPLVLRELLSCSDSINDSDPIYRMVFDSNDTTISYKVGDALGVLPENSKEVSEHVLQLLRLFPNDPCQRKKNF

SEQ ID NO: 588 - protein, 118 aa, Chlamydia pneumoniae
KKFKKRLLRSKGCMKQQKQKIRIRLKGFDQGQLDRSTADIVETAKRTGARVVGPIPLPTKREVYTVLRSPHVDKKSREQFEIRTHKRLVDILDPTGKTIDALKMLALPAGVDIKIKAA

SEQ ID NO: 589 - protein, 651 aa, Chlamydia pneumoniae
SHEGGATMDWMAQEQERGITITSAATTVFWLGAKINIIDTPGHVDFTIEVERSLRVLDGAVAVFDAVSGVEPQSETVWRQADKYGVPRIAFVNKMDRMGADYFAAVESMKEKLGANAFPVHCPIGSESQFVGMVDLISQKALYFLDDTLGAKWEEKEISEDLKERCAELRANLLEELATIDESNEAFMMKVLEDPDSITEDEIHQVMRKGVIENKINPVLCGTAFKNKGVQQLLNVIVKWLPSPLDRGNIRGINLKTDQEISLEPRRDGPLAALAFKIMTDPYVGRITFIRIYSGTLKKGSAILNSTKDKKERISRLLEMHANERTDRDEFTVGDIGACVGLKFSVTGDTLCDDNQEIVLERIEFPDPVIDMAIEPKSKGDREKLAQALSSLSEEDPTFRVSTNEETGQTIISGMGELHLDILRDRMIREFKVEANVGKPQVSYKETITVSGNSETKYVKQSGGRGQYAHVCLEIEPNEPGKGNEVVSKIVGGVIPKEYIPAVIKGIEEGLNTGVLAGYGLVDVKVSIVFGSYHEVDSSEMAFKICGSMAVKDACRKAKPVILEPIMKVAVITPEDHLGDVIGDLNRRRGKILGQESSRGMAQVNAEVPLSEMFGYTTSLRSLTSGRATSTMEPAFFAKVPQKIQEEIVKK

SEQ ID NO: 590 - protein, 82 aa, Chlamydia pneumoniae
LNYGENNKFMSNQEFDLSAIRNIGIMAHIDAGKTTTTERILFYAGRTHKIGEVMKAELPWTGWPRSKKEELRLPLLQLLSSG

SEQ ID NO: 591 - protein, 159 aa, Chlamydia pneumoniae
MYMSRRHSAEKRDIPGDPIYGSVILEKFINKVMMHGKKSVARKIVYSALERFGKKLNLENVLEGFGEALENAKPILEVRSRRVGGATYQVPVEVASERRNCLAMQWIIKHARSKPGKSMEVGLATELIDCFNKQGATIKKREDTHRMAEANKAFAHYKW

SEQ ID NO: 592 - protein, 146 aa, Chlamydia pneumoniae
LPTKRALLYISMLVVVRLKREEYMPTINQLIRKRRKSSLARKKSPALQKCPQKRGVCLQVKTKTPKKPNSALRKVAWVRLSNGQEVIAYIGGEGHNLQEHSIVLIQGGRVKDLPGVRYHIVRGTLDCAAVKNRKQSRSRYGAKRPK

SEQ ID NO: 593 - protein, 268 aa, Chlamydia pneumoniae
  SITE 1...268: Xaa=unknown or other
GCMWRVVLRFLIIFILGRAVFPLRASESFSWETSTCLTVLGIPFIDIILTTNEDFVAQCGLQIGTISSTNNAKIKEIFLIYKEKFPEASISFKRKEPLNLSQSHLSDLGILCMRNGETYAEGMANKENGPALKQPKDLRLVLRCPNQPDTLLYSEKEAEKGIETNTCLCNQGYTLLDGQLILYGDSIEKFLKETKRKNNHTLVDLCDSQVVTTFLGRFWSLLNYVQVLFLSEDSAKXLAGIPDLAQXRNCFPTPYLCFLFIPTILFTS

SEQ ID NO: 594 - protein, 648 aa, Chlamydia pneumoniae
MFVMKKLVRLCVVLLSLLPNVLFSSDLLREEGIKKMMDKLIEYHVDAQEVSTDILSRSLSSYIQSFDPHKSYLSNQEVAVFLQSPETKKRLLKNYKAGNFAIYRNINQLIHESILRARQWRNEWVKNPKELVLEASSYQISKQPMQWSKSLDEVKQRQRALLLSYLSLHLAGASSSRYEGKEEQLAALCLRQIENHENVYLGINDHGVAMDRDEEAYQFHIRVVKALAHSLDAHTAYFSKDEALAMRIQLEKGMCGIGVVLKEDIDGVVVREIIPGGPAAKSGDLQLGDIIYRVDGKDIEHLSFRGVLDCLRGSHGSTVVLDIHRGESDHTIALRREKILLEDRRVDVSYEPYGDGVIGKVTLHSFYEGENQVSSEQDLRRAIQGLKEKNLLGLVLDIRENTGGFLSQAIKVSGLFMTNGVVVVSRYADGTMKCYRTVSPKKFYDGPLAILVSKSSASAAEIVAQTLQDYGVALVVGDEQTYGKGTIQHQTITGDASQDDCFKVTVGKYYSPSGKSTQLQGVKSDILIPSLYAEDRLGERFLEHPLPADCCDNVLHDPLTDLDTQTRPWFQKYYLPNLQKQETLWREMLPQLTKNSEQRLSENSNFQAFLSQIKSSEKTDLSYGSNDLQLEESINILKDMILLQQCRK

SEQ ID NO: 595 - protein, 199 aa, Chlamydia pneumoniae
  SITE 1...199: Xaa=unknown or other
ENGMSSNLHPVGGTGTGAAAPESVLNIVEEIAASGSVTAGLQAITSSPGMVNLLIGWAKTKFIQPIRESKLFQSRACQITLLVLGILLVVAGLACMFIFHSQLGANAFWLIIPAAIGLIKLLVTSLCFDEACTSEKLMVFQKWAGVLEDQLDDGILNNSNKIFGHVKTEGNTSRAXTPVLNDGRGXPVLSPLVSKIARV

SEQ ID NO: 596 - protein, 556 aa, Chlamydia pneumoniae [sequence omitted]

SEQ ID NO: 597 - protein, 90 aa, Chlamydia pneumoniae
MKKAVLIAAMFCGVVSLSSCCRIVDCCFEDPCAPSSCNPCEVIRKKERSCGGNACGSYVPSCSNPCGSTECNSQSPQVKGCTSPDGRCKQ

SEQ ID NO: 598 - protein, 516 aa, Chlamydia pneumoniae
MKSLWSKDKRIMNWENVRVRVAPSPTGDPHVGTAYMALFNEIFAKRFKGKMILRIEDTDRTRSRQDYEENIFSALRWCGIQWDEGPDVGGPYGPYRQSERTKIYQGYVETLLKTDCAYKCFATPQELAEMRAVASTLGYRGGYDRRYRYLSPEEVASREAAGQPYTIRLKVPLSGECVFEDYSKGRVVFPWADVDDQVLVKSDGFPTYHFANVIDDHLMGITHVLRGEEWLSSTPKHLLLYEAFGWEPPVFLHMPLLLNPDGTKLSKRKNPTSIFYYRDSGYVKEAFVNFLTLMGYSMEGDEEVYSLERIIETFNPRRIGKSGAVFDIQKLDWMNKHYLNHEGSPECLLKELQGWLLNDEFFLKILPLCQSRITTLAEFINLTSFFFSGLLEYRVEELLPQALSPEKAAILLYSYVKYLEKTDQWTKETCYLGSKWLAQAFNVHHKKAIIPLLYVAITGKKQGLPLFDSIEILGKPRARARLVYAEKLLGGVPKKLAATVDKFMQREDFEEATFDL

SEQ ID NO: 599 - protein, 181 aa, Chlamydia pneumoniae
MACEQHEGCYELEEREEREEIEDIKDSDTKWVSITQAAKLHNVTRQAIYVAIKQKKLKASKETRWEIDIKDLEEYKRNRYSRKKSLYQGELVFDNGKGCYSINQVAQILGIPVQKVYYATRTGTIRGERKGAAWVIHVSEIERYKNEYLSKQAAKKLKGAEPKEHQAPNFEPPTEIFPESN

SEQ ID NO: 600 - protein, 373 aa, Chlamydia pneumoniae
MSIAIAREQHAAILDMHPKPSIAMFSSEQARTSWEKRQAHPYLYRLLEIIWGVVKFLLGLIFFIPLGLFWVLQKICQNFILLGAGGWIFRPICRDSNLLRQAYAARLFSASFQDHVSSVRRVCLQYDEVFIDGLELRLPNAKPDRWMLISNGNSDCLEYRTVLQGEKDWIFRIAEESQSNILIFNYPGVMKSQGNITRNNVVKSYQACVRYLRDEPAGPQARQIVAYGYSLGASVQAEALSKEIADGSDSVRWFVVKDRGARSTGAVAKQFIGSLGVWLANLTHWNINSEKRSKDLHCPELFIYGKDSQGNLIGDGLFKKETCFAAPFLDPKNLEECSGKKIPVAQTGLRHDHILSDDVIKEVAGHIRRHFDN

SEQ ID NO: 601 - protein, 564 aa, Chlamydia pneumoniae
QYKNLLWDFSPKGPCGIKFMTNSDNASAAGLLWAHPKEDPAFLGMIIKEFHLPPTVAQIFISRGFQTIQEIHKFLYSHLSSLYDPGLFLDMSKAVERLLLARDRKEHVMIYGDSDVDGMTGVALLVEFLRDIDVHVSYFFLGAILKQHGETSTLIAKLKEEGITLLITVDCGITAGKEVSDITRQGIDVIITDHHMPTGKIPHCVVTLNPKLRDHTYPNRELTGVGVAFKLARGVLNALISRNLVPKSQGSLKKLLDLVTLGTITDVGVLLGENRVMVRYGIKEIARGARPGLNKLCALCGVEKSEVTSTDIVLKIAPKLNSLGRLDDPAKGVELLLTQDDERVDALIMELDNINRERQRIEAEVFQDVQEILNSNPEILKQAAIVLSSTAWHARVIPIISARLAKTYNKPVVIIAIQRGIGKGSARTIGSFPLLGVLKKCSSLLLSYGGHDFAAGVIMKEDKVEDFKKKFVHLVNSSLKKGDTLPHLEIDAYADFDAIDYDLLASMELFEPFGKGNLMPIFYSKVRQVRYPKVLPGNHLKLYLSQKERNLEGVASVWEDTLMH

SEQ ID NO: 602 - protein, 997 aa, Chlamydia pneumoniae
RKRSFGCYIFSPNTDCKHFSKGSVYILLKGLRSIVAKYQQGGGKELQSFEKDLQNLYNCFSHTEAISWTLGEDQVLEIRHPLQQFLDVWGEGFVIGKEGCAFLEVKDIQDRLATVNQIEKNRQSDLVRWHEQYRHAKCSMDLQERLSAPIPYQNLFLENMKLNMRKFSRGENILRLGIDFVGGRQLLLSFKDHQGKQLTDKEDILKVSDELCARLNKLGVSEIELRREGDYIHLSVPGSSTISSSEILGTSKMSFHVVNERFSSYSASRYEVQRFLDYLWFTSQAQGKTSPEEINTFASALFNEEVDVPPSVHEAITKLKSEGLAFSPSGCETPSTDLDTTFSMIAIGKDAEQKANPLVIVFRNYALDGASLKDIRPEFAAGEGYVLNFSVKDTSPKKMAEKLSPTESFHTWTSAYCQEGISGTANGQYSANRGWRMAVVIDGYMVSSPILNVPLKNHASVSGKFTHREVSKLASDLKSGAMSFVPEVLSEETISSDLGKKQCTQGIISACCGLAMLIVLMSVYYRFGGVIASGAVLLNLLLIWAALQYLDAPLTLSGLAGIVLAMGMAVDANVLVFERIREEFLLSQSLKKSVEKGYTKAFGAIFDSNLTTVLASALLFFLDTGPIKGFALTLILGIFSSMFTALFMTKFFFMLWMNKTQHTQLHMMNKFVGIKHDFLRGCKKLWAVSGSVFLLGCVALGFGAWNSVLGMDFKGGYAFTFNPKEHGISDVAQMRGKVVHKLQEAGLSSRDFRIQTFGSSEKIKIYFSDKALSYTKADTSLSPKINDHELALAVGLLSETGLDFSTETLNETQNFWSKVSSKLSKKMRYQATIGLLGALAIILLYVSLRFEWQYAFSAVCALIHDLLATCAVLFIAHFFLKKIQIDLQAIGALMTVLGYSLNNTLIIFDRIREDRQANLFTPMHVLVNDALQKTFSRTVMTTATTLSVLLMLLFIGGSSVFNFAFIMTIGILLGTLSSLYIAPPLLLFMVRKENRSK

SEQ ID NO: 603 - protein, 435 aa, Chlamydia pneumoniae
SGAMKQKVKRNFAIIICVFALALYYVLPTCLYYAKPLDKKIDGNEAEHIIKSFTKQAQQVRKDVIPRVSAILSSLHLRGHIQQHPAIPDIVSVRFKRGEDAEDFIGNLVHGEPNVPIKSARLHVVGYSREHDDHVIQVASSINTSLVESDFSFVSYSSENEQEMASSILQRVYSACTCPKQKDCSCSYPSIWETAPKEQLLQYAKNLSSGFEVFSSRLSAFCQQSFSSNQDRLAFLSRLSSLSNDAAIDVEDQKLLKSVYETLSQTACIRSLDCPYIEGLRLDCSESSLFFSSIEYCPKERKIFLTLHSDLLAQRTSLSKEQRLDFDSRLAVEKQKLSKNLTVQVEDYNNGFSFQWMDKDTQGKIILQGERLLQGIAEHLTALTLHRPAAESCDLIPENFPVFCRQPRESEVLAVTSFLPIQIANTFLKAPFTSY

SEQ ID NO: 604 - protein, 367 aa, Chlamydia pneumoniae
  SITE 1...367: Xaa=unknown or other
YEISSHIHFRFDSHSNGHLVAAEXGNVHYVPNAQNLPKKILGGVLACFGLALLGCAAFAAGVCQTIFPCIGLMILGLVLLGFAYLQYSKGWSRFERPLFRETKVFEKPINWLGCLSLLQSWKKIRPGCYYHPGCPQVEICEGSQEIVTKIFQKKSDRNTSIFLIQEMDQIALRQGIEKSSLSRKTFAIDPSVVSSLLSEIQREEQQYLDPKVISWSSEDQASDRTHPKSAIYVNISDAAQEPQGRCYIDAYTKAFFTVLDQIGDPNIVKKHTIYVLTPILGVPDALPKEEQENLKLLSQAAFLYSAEQVAKRMREEKQDSIRIKFIFTDPTSPTSLYFSPHHSSTPHSVTPISLSGFVGEQESYTFA

SEQ ID NO: 605 - protein, 261 aa, Chlamydia pneumoniae
VTYALINDPVDLSLATNNAESKFPSLQRLPNHVAIIMDGNRRWYKKHREECGHTHTSGHYYGAKVLPNILNAVLDLGIKVLTLYTFSTENFGRPKEEIQEIFNIFYTQLDKQLPYLMENEICLRCIGDLSKLPKGIQTKINHVSRMTASFSRLELVLAVNYGGKDELVRAFKKLHVDILNKKISSDDLSESLISSYLDTSGLTDPDLLIRTGGEMRVSNFLLWQIAYTELYITDTLWPDFTPQDLFEAINVYQQRSRRGGK

SEQ ID NO: 606 - protein, 308 aa, Chlamydia pneumoniae
VLNSNKFKSKTGAYGDLFQRVVVHSLVLTFLVLLLYSSLFPLTSFALGFITATCGAVGTYEYSSMAKAKMHYPLSTFSAIGSFLFLALSFLSIRWGHSLPGFFDALPWTLLIVWVVWSIFRVRKSTIGALQLSGVTLFSILYVGIPIRLFLHVLYSFIHTQEPYLGIWWASFLIATTKGADIFGYFFGKAFGNKKIAPQISPNKTVVGFVAGCLGATLISFIFFLQIPTRFASYFPMPAILIPLGLALGITGFFGDIIESIFKRDAHLKNSNKLKAVGGMLDTLDSLLLSTPIAYLFLLITQSKEFIG

SEQ ID NO: 607 - protein, 220 aa, Chlamydia pneumoniae
RVYWMIITIDGPSGTGKSTTAKALADHLHFNYCNTGKMYRTLAYARLQSPWATLPLTKFLEEPPFSFTFATGQPLESFFNGHLLTSELTTQEVANAASELSQLPEVRAFMQDLQRRYAQLGNCVFEGRDMGSKVFPNADLKIFLTSSPEVRAQRRLKDLPEGTLSPEQLQAELVKRDAADAQRAHDPLVIPENGIVIDSSDLTIRQVLEKILALLFRNEL

SEQ ID NO: 608 - protein, 234 aa, Chlamydia pneumoniae
LFGFDNKTSSGENFSFTISKRAMIFRICKFFTWVAFSLFYKLKVYGVKKNFIKGPAIIAVNHNSFLDPIALHMCVHECIYHLARASLFNIPWLWKQWGCFPVRQDEGNSAAFKIASRLFNKRKKLVIYPEGARSPDGQLQPGKVGIGMMAAKSRVPIIPVYIRGTFEAFNRHQKIPHVWKTITCVFGTPMYFDDIIQNPEIKNKETYQIITNQTMNKIAELKAWYESGCKGDVP

SEQ ID NO: 609 - protein, 580 aa, Chlamydia pneumoniae
  SITE 1...580: Xaa=unknown or other
LPSSKHGMNRGAKETSPKLMSTLLSILSVICSQAIAKAFPNLEDWAPEITPSTKEHFGHYQCNDAMKLARVLKKAPRAIAEAIVAELPQEPFSLIEIAGAGFINFTFSPVFLNQQLEHFKDALKLGFQVSQPKXIIIDFSSPNIAKDMHVGHLRSTIIGDSLARIFSYVGHDVLRLNHIGDWGTAFGMLITYLQENPCDYSDLEDLTSLYKKAYVCFTNDEEFKKRSQQNVVALQAKDPQAIAIWEKICETSEKAFQKIYDILDIVVEKRGESFYNPFLPEIIEDLEKKGLLTVSNDAKCVFHEAFSIPFMVQKSDGGYNYATTDLAAMRYRIEEDHADKIIIVTDLGQSLHFQLLEATAIAAGYLQPGIFSHVGFGLVLDPQGKKLKTRSGENVKLRELLDTAIEKAEEALREHRPELTDEAIQERAPVIGINAIKYSDLSSHRTSDYVFSFEKMLRFEGNTAMFLLYAYVRIQGIKRRLGISQLSLEGPPEIQEPAEELLALTLLRFPEALESTIKELCPHFLTDYLYNLTHKFNGFFRDSHIQDSPYAKSRLFLCALAEQVLATGMHLLGLKTLERL

SEQ ID NO: 610 - protein, 458 aa, Chlamydia pneumoniae
MQIAQVFGCGRLNGEVKVSGAKNAATKLLVASLLSDQKCTLRNVPDIGDVSLTVELCKSLGAHVSWDKETEVLEIYTPEIQCTRVPPTFSNVNRIPILLLGALLGRCPEGVYVPTVGGDAIGERTLNFHFEGLKQLGVQISSDSSGYYAKAPRGLKGNYIHLPYPSVGATENLILAAIHAKGRTVIKNVALEAEILDLVLFLQKAGADITTDNDRTIDIFGTGGLGSVDHTILPDKIEAASFGMAAVVSGGRVFVRNAKQELLIPFLKMLRSIGGGFLVSESGIEFFQERPLVGGVVLETDVHPGFLTDWQQPFAVLLSQAQGSSVIHETVHENRLGYLHGLQHMGAECQLFHQCLSTKACRYAIGNFPHSAVIHGATPLWASHLVIPDLRAGFAYVMAALIAEGGGSIIENTHLLDRGYTNWVGKLRSLGAKIQIFDMEQEELTTSPKSLALRDASL

SEQ ID NO: 611 - protein, 96 aa, Chlamydia pneumoniae
HNDMPWYLSTDEKADTQLPCAEDHEGSRGDFHGQSHGLLKIPEPVIVELRRVVASPSGTLDEHRFPRQHLPPRGVLEKILFPTRRPKILRLWSATS

SEQ ID NO: 612 - protein, 183 aa, Chlamydia pneumoniae
IMAAPINQPSTTTQITQTGQTTTTTTVGSLGEHSVTTTGSGAAAQTSQTVTLIADHEMQDIASQDGSAVSFSAEHSFSTLPPETGSVGATAQSAQSAGLFSLSGRTQRRDSEISSSSDGSSISRTSSNASSGETSRAESSPDLGDLDSLSGSERAEGAEDLKDLEAYLKVRFHIMILPIKRLF

SEQ ID NO: 613 - protein, 550 aa, Chlamydia pneumoniae
MKPRSSFIFVRNGDWSTAESIKVSNAKTKENITKPADLEMCIAKFCVGYETIHSDWTGRVKPTMEERSGATGNYNHLMLSMKFKTAVVYGPWNAKESSSGYTPSAWRRGAKVETGPIWDDVGGLKGINWKTTPAPDFSFINETPGGGAHSTSHTGPGTPVGATVVPNVNVNLGGIKVDLGGINLGGITTNVTTEEGGGTNITSTKSTSTDDKVSITSTGSQSTIEEDTIQFDDPGQGEDDNAIPGTNTPPPPGPPPNLSSSRLLTISNASLNQVLQNVRQHLNTAYDSNGNSVSDLNQDLGQVVKNSENGVNFPTVILPKTTGDTDPSGQATGGVTEGGGHIRNIIQRNTQSTGQSEGATPTPQPTIAKIVTSLRKANVSSSSVLPQPQVATTITPQARTASTSTTSIGTGTESTSTTSTGTGTGSVSTQSTGVGTPTTTTRSTGTSATTTTSSASTQTPQAPLPSGTRHVATISLVRNAAGRSIVLQQGGRSQSFPIPPSGTGTQNMGAQLWAAASQVASTLGQVVNQAATAGSQPSSRRSSPTSPRRK

SEQ ID NO: 614 - protein, 96 aa, Chlamydia pneumoniae
DRPPCCNTIDLPAALRTKEIVATCLVPEGRGAWGVCVEADDVVVVAEVPVDRVVVVGVPTPVLCVETLPVPVPVLVVDVLSVPVPMLVVDVLAVLA

SEQ ID NO: 615 - protein, 241 aa, Chlamydia pneumoniae
VEDMAGHSKWANTKHRKERADHKKGKIFSRIIKELISAVKLGGADPKSNARLRMVIQKAKENNIPNENIERNLKKATSAEQKNFEEVTYELYGHGGVGIIVEAMTDNKNRTASDMRIAINKRGGSLVEPGSVLYNFARKGACTVAKSSIDEEVIFSYAIEAGAEDLDTEDEENFLVICAPSELASVKEKLISQGATCSEDRLIYLPLRLVDCDEKDGEANLALIDWLEQIEDVDDVYHNMS

SEQ ID NO: 616 - protein, 195 aa, Chlamydia pneumoniae
SAERGFRHPIVMVETVLHNFQRYLSKYLYRVFRFPCRQKTFLSSHRVLARPSFPVDYCPGKIYDLQEIYEELNAQLFQGALRLQIGWFGRKATRKGKSVVLGLFHENEQLIRIHRSLDRQEIPRFFMEYLVYHEMVHSVVPREYSLSGRSIFHGKKFKEYEQRFPLYDRAVAWEKANAYLLRGYKKRVGGGYGRA

SEQ ID NO: 617 - protein, 188 aa, Chlamydia pneumoniae
  SITE 1...188: Xaa=unknown or other
SIFGRVWXXFMTAEKQNTGILGLEIRYTLPSDATYMLKWLNDPKILRGFPIQTEAEIRETVNFWVGFYRYHSSLTAVYNGNVAGVATLVLNPYVKVSHHALISIIVGEEFRNKGIGTALLNNLIHLAKTRFKLEVLYLEVYEGNPALHLYQRFGFVEVGRQNRFYKDEIGYLAKTTMEKGSIERRKRF

SEQ ID NO: 618 - protein, 139 aa, Chlamydia pneumoniae
  SITE 1...139: Xaa=unknown or other
DEIRPNDLRIDTFRSSGAGGQHVNVTESAVRITHLPSGVVVSCQNERSQIQNRESCMKMLQAKLYQQVLQERLEKQSLDRKDKKEIAWGSQIRNYVFQPYTLVKDVRTGHETGNVQAMLDGELLDEFIKAYLAEFGXVS

SEQ ID NO: 619 - protein, 211 aa, Chlamydia pneumoniae
  SITE 1...211: Xaa=unknown or other
LRGLFDLDKKQKELQVLEEESSEENFWQDSVHAGKISEQIVSLRRQIQEYQELKSKIDAIEFFLEDADALEDPAICEDLEKEFLFCEKKLAVWETQRLLSGEADKNSCFLTINAGAGGTESCDWVEMLFRMYSRWATKHQWALEVVDRLDGEVVGIKHVTVKFSGMYAYGYAKAERGVHRLVRISPFDSNGKRHTSFASVDVFPEIDXRLR

SEQ ID NO: 620 - protein, 90 aa, Chlamydia pneumoniae
ESPMSQKNKNSAFMHPVNISTDLAVIVGKGPMPRTEIVKKVWEYIKKHNCQDQKNKRNILPDANLAKVFGSSDPIDMFQMTKALSKHIVK

SEQ ID NO: 621 - protein, 218 aa, Chlamydia pneumoniae
SATSHVPMIKSSLILLSGGQGTRFGSKIPKQYLPLNGTPLVLHSLKILSSLPQIAEVIVVCDPSYQETFQEYPVSFAIPGERRQDSVFSGLQQVSYPWVIIHDGARPFIYPDEIHDLLETAEKIGATALASPIPYTIKQRNPVRTLDRDNLAIIHTPQCIKTEILREGLALAKEKQLTLVDDIEAAEIIGKPSQLVFNKHPQIKISYPEDLTIAQALL

SEQ ID NO: 622 - protein, 267 aa, Chlamydia pneumoniae
MTKVALLIAYQGTAYSGWQQQPNDLSIQEVIESSLKKITKTRTPLIASGRTDAGVHAYGQVAHFRAPDHPLFANANLTKKALNAILPKDIVIRDVALFDDNFHARYLTIAKEYRYSLSRLAKPLPWQRHFCYTPRHPFSTELMQEGANLLIGTHDFASFANHGRDYNSTVRTIYTLDIVDKGDSLSIICRGNGFLYKMVRNLVGALLDVGKGAYPPEHLLDILEQKNRREGPSAAPAYGLSLHHVCYSSPYNNFCCEQCSVSTSNEG

SEQ ID NO: 623 - protein, 263 aa, Chlamydia pneumoniae
EGLRWRSVKSFLRQCWIYSMLVSDEFQLCLRSGMYLEDYDVFFFDLDGLLVDTEPCFYRAFLQACAEFSLEVHWDFSTYYSHTTLGTEIFSKKFIEQYPQAQEYMAEIFAKRLQIYYKSLEHAGPALMPGVEAFIELVLSLNKTFGVVTNSPRDATHTLRTMYPILNKFLFWVTRENYARPKPYGDSYDYAYRTFAREGMKVIGFEDSVKGLRALSKIPATLVCINSMAEITPEDYPELKGKEFFSYPSFDVLTEHCSQQKLL

SEQ ID NO: 624 - protein, 291 aa, Chlamydia pneumoniae
KNPNALLKKIQHRLVKMHDKNKVLYLQANHLNQKRKRHNPLNTYHSSNTTETRRLPTYYKSNIVLKMILRISTVSLLTSCSFSKNSRTCFVTPERITSQKDCPVLLHPKSTTISPPLYDWISPNREVITAYSFYCRGQGNSIITPEGVLYDCDGLHHSITKEEFRYIHPRLIEVVRLLQQDHPKVSIIEAFCCPKHFHFLEASGISLSQLHLQGTAATFALDPPLPMEKLLATIKKLYKKNSDPSLSNFIVTEATLTNPELRLTQQDLGSHTEITVEILDNLQNKEALSSA

SEQ ID NO: 625 - protein, 123 aa, Chlamydia pneumoniae
IVLSFFLGKTKVTPRFLMNERTLLLLLKKKKGLFLAILDLTQTESSLTTPELEKVLKQKKIFLSCIDRVDLQIKEFRHAFSSELPQDIQEELEEIRDVIIRILDTDKRNYAQKKKEFGIYERP

SEQ ID NO: 626 - protein, 380 aa, Chlamydia pneumoniae
IRINATMHRKKRNLVFMNVPDSKNLHPPAYELLEIKARITQSYKEASAILTAIPDGILLLSETGHFLICNSQAREILGIDENLEILNRSFTDVLPDTCLGFSIQEALESLKVPKTLRLSLCKESKEKEVELFIRKNEISGYLFIQIRDRSDYKQLENAIERYKNIAELGKMTATLAHEIRNPLSGIVGFASILKKEISSPRHQRMLSSIISGTRSLNNLVSSMLEYTKSQPLNLKIINLQDFFSSLIPLLSVSFPNCKFVREGAQPLFRSIDPDRMNSVVWNLVKNAVETGNSPITLTLHTSGDISVTNPGTIPSEIMDKLFTPFFTTKREGNGLGLAEAQKIIRLHGGDIQLKTSDSAVSFFIIIPELLAALPKERAAS

SEQ ID NO: 627 - protein, 216 aa, Chlamydia pneumoniae
IHSFLSTRTVCVRQKKLRKISKELQQRYSRLQEEKQVKEKILEESMNHFADLFEKAQKENMAYKKKLADLEGAAAPTEIGEDDDWVLTDSASLSQKKIRELVEENQELLKALAFKSNELTQLVADAVEAEKEISKLREHIEEQKEGLRALDKMHAQAIKDCEVAQRKCCDLESLLSPVREDAGMRFELEVELQRLQEENAQLRAEVERLEQEQFQG

SEQ ID NO: 628 - protein, 212 aa, Chlamydia pneumoniae
GVGSMTSRRDAGRLYNVFNQSQKDIQRAHDREASQRACEGTEMDCAERQQLEKDLRRQLKSMQEWIEMRGTIHQQEKAWRKQNAKLERLQEDLRLTGIAFDEQSLFYREYKEKYLSQKLDMQKILQEVNAEKSEKACLESLVHDYEKQLEQKDANLKKAAAVWEEELGKQQQEDYEQTQEIRRLNTFILEYQDSLREAEKVEKDFQRATTKV

SEQ ID NO: 629 - protein, 290 aa, Chlamydia pneumoniae
ISLRRKILRPNNFSIGDCSSNMATPAQKSPTFQDPSFVRELGSNHPVFSPLTLEERGEMAIARVQQCGWNHTIVKVSLIILALLTILGGGLLVGLLPAVPMFIGTGLIALGAVIFALALILCLYDSQGLPEELPPVPEPQQIQIEDLRNETREVLEGTLLEVLLKDRDAKDPAVPQVVVDCEKRLGMLDRKLRREEEILYRSTAHLKDEERYEFLLELLEMRSLVADRLEFNRRSYERFVQGIMTVRSEEGEKEISRLQDLISLQQQTVQDLRSRIDDEQKRCWTALQRI

SEQ ID NO: 630 - protein, 337 aa, Chlamydia pneumoniae
PCHLRHEYPDGSGLDLIKIIKQSSPHTPVLVVTAYGSIENAVEAMHQGAFNYLTKPFSSEALFAFISKAEELKNLVHENLFLHSQTTPDSHPLIAESKAMKDLLAIAKKAASSSANIFIHGESGCGKEVLSFFIHHNSPRANHPYIKVNCAAIPETLLESELFGHEKGAFTGATTKKAGRFELAHKGTLLLDEITEVPVNLQAKLLRAIQEKEIEHLGGTKTLSVDVRILATSNRKLKEAIDDKSFRQDLYYRLNVIPLHLPPLRDRQDDILPLANYFLNKFCRMNNTPLKTLSPKAQELLLNYPWPGNIRELSNVLERVVILENTSLLTEDMLALA

SEQ ID NO: 631 - protein, 223 aa, Chlamydia pneumoniae
SYGELFILSTLLKHHVTLGDKMRPHRKHVSSKSLALKQSASTHVEITTKAFRLSMPLKQLILEKSDHLPPMETIRVVLTSHKDKLGTEVHVVASHGKEILQTKVHNANPYTAVINAFKKIRTMANKHSNKRKDRTKHDLGLAAKEERIAIQEEQEDRLSNRVASCRRPRCLGFSKNSWVCSRISEKEDLQEKDEHSYAISRRGYPPARVCRRKLPDLLERARA

SEQ ID NO: 632 - protein, 254 aa, Chlamydia pneumoniae
SSMQICVTGVVLRSRPLGKNHTLTTLFTPEGLFTFFAKQGQTLQCDYRETLVPISLGKYTLHRNGSRLPKLTHGDILNAFEAIKQTYALLEASGKMIQALLASQWKEKPSHKLFSLFLNFLHRIPESSNPEFFAAIFVLKLLQYEGILDLTPACSLCKASLPYACYRYQGHKLCKKHQHKQAISIEKEEEQILQAIIHAKKFSELLAIAEFPIAIAEKIFYLFDSLQEEKKSERNSSEDPYHEILRLSKVVHPY

SEQ ID NO: 633 - protein, 207 aa, Chlamydia pneumoniae
LFLYGDHNLGFACRYLFFFIVLFASGSFGNQLLSVPCWLSEEESFYTHRFDFSKSYPDMENMEIQAQRKKRVEFNLTGEFPKLETLNYQGSFGHLRAKCRGVYPVLYALNFSCSSCKMDMDFRGKWNRSSTITISNQKESINLKLPKDVGVIVNTKTSLKGNVCPGSTFIKQGWGVWNKIYHNDLVGFSEVTLIFNVSSEGGTITFS

SEQ ID NO: 634 - protein, 219 aa, Chlamydia pneumoniae
SLIMRCTAYCTASAYNLHVLFHLLKPRYPTILSREYVLANLDSTQASNQLAIFFPFGVAVFWGWEESEEIKLLQTIVTASPEILPQPEIDCYNFHYGDKLQIRRDRLTLADTTLNTKLAIAFGLAQSVKLTTFETTIYKTIEDSKRLPQDLATKGKISMSRKAIAKKIGKLFLDKASVNLHSDILDEPDFFWDHPETQAIYRDVLSCLDIEARINVLIV

SEQ ID NO: 635 - protein, 368 aa, Chlamydia pneumoniae
VLGAKCMAFKRKTRWLWQVLILSVGLNMLFLLLFYSAIFRKDIYKLHLFSGPLIAKSSRKVYLSEDFLNEISQASLDDLISLFKDERYMYGRPIKLWALSVAIASHHIDITPVLSKPLTYTELKGSSVRWLLPNIDLKDFPVILDYLRCHKYPYTSKGLFLLIEKMVQEGWVDEDCLYHFCSTPEFLYLRTLLVGADVQASSVASLARMVIRCGSERFFHFCNEESRTSMISATQRQKVLKSYLDCEESLAALLLLVHDSDVVLHEFCDEDLEKVIRLMPQESPYSQNFFSRLQHSPRRELACMSTRRVEAPRVQEDQDEEYVVQDGDSLWLIAKRFGIPMDKIIQKNGLNHHRLFPGKVLKLPAKQS

SEQ ID NO: 636 - protein, 797 aa, Chlamydia pneumoniae
  SITE 1...797: Xaa=unknown or other
LRLSSMRIPITLLQXYFSEPLSTKEILEACDHIGIEXEIENTTLYSFASVITAKILHTIPHPNADKLRVATLTDGEKEHQVVCGAPNCEAGLIVALALPGAKLFDSEGQAYTIKKSKLRGVESQGMCCGADELGLDELQIQERALLELPEATPLGEDLATVLGNTSLEISLTPNLGHCASFLGLAREICHVTQANLVIPKEFSFENLPTTALDMGNDPDICPFFSYVVITGISAQPSPIKLQESLQALKQKPINAIVDITNYIMLSLGQPLHAYDASHVALDSLRVEKLSTPESLTLLNGETVLLPSGVPVVRDDHSLLGLGGVMGAKAPSFQETTTTTVIKAAYFLPEALRASQKLLPIPSESAYRFTRGIDPQNVVPALQAAIHYILEIFPEATISPIYSSGEICRELKEVALRPKTLQRILGKSFSIEILSQKLQSLGFSTTPQETSLLVKVPSYRHDINEEIDLVEEICRTESWNIETQNPVSCYTPIYKLKRETAGFLANAGLQEFFTPDLLDPETVALTRKEKEEISLQGSKHTTVLRSSLLPGLLKSAATNLNRQAPSVQAFEIGTVYAKHGEQCQETQTLAILLTEDGESRSWLPKPSLSFYSLKGWVERLLYHHHLSIDALTLESSALCEFHPYQQGVLRIHKQSFATLGQVHPELAKKAQIKHPVFFAELNLDLLCKMLKKTTKLYKPYAIYPSSFRDLTLTVPEDIPANLLRQKLLHEGSKWLESVTIISIYQDKSLETRNKNVSLRLVFQDYERTLSNQDIEEEYCRLVALLNELLTDTKGTINS

SEQ ID NO: 637 - protein, 328 aa, Chlamydia pneumoniae
RDYQFMKQLLFCVCVFAMSCSAYASPRRQDPSVMKETFRNNYGIIVSGQEWVKRGSDGTITKVLKNGATLHEVYSGGLLHGEITLTFPHTTALDVVQIYDQGRLVSRKTFFVNGLPSQEELFNEDGTFVLTRWPDNNDSDTITKPYFIETTYQGHVIEGSYTSFNGKYSSSIHNGEGVRSVFSSNNILLSEETFNEGVMVKYTTFYPNRDPESITHYQNGQPHGLRLTYLQGGIPNTIEEWRYGFQDGTTIVFKNGCKTSEIAYVKGVKEGLELRYNEQEIVAEEVSWRNDFLHGERKIYAGGIQKHEWYYRGRSVSKAKFERLNAAG

SEQ ID NO: 638 - protein, 460 aa, Chlamydia pneumoniae
WESSRSRVTENLKKMRAEKVRENISKVNSEMVMLLPKDTRTWEMERRYMSTYEQLGILIKAKYRKKQEASVKKYQVAFEEKRQSPMPTLRHLEMKNEGICLKRLQQRVDKMQRPYEMAQQAWNRATDNYRPFLMALTRIEHELRLADYNNWGQPEDLCIAYANVEKRAEPYKKSLLEIRQVLEDYAKLRSAISFIQDKRLWIEKESEDLRILINPFFSSFHWEDDAGGSREMNKYVPWWQLSRVTRKDLLAALVFGIRIALVVAGIGITIALAIGIMIGLVSGYFGGTVDMILSRFTEIWETMPVLFILMLVISITQQKSLLLNTVLLGCFSWTGFSRYVRIEVLKQRDRGYVLAATNLGYSHYYIMVHQILPNAIVPVISLVPFAMMAMISCEAGLTFLGLGEESSASWGNLMREGVTGFPAESAVLWPPAIILTMLLIAIALIGDGVRDALDPRLQDS

SEQ ID NO: 639 - protein, 510 aa, Chlamydia pneumoniae
VLKYILKRLVLIPLTLFAIVSINFVILNAAPGDVLEEKSRDALGEAGKSDKMRSYKGPDRYLQFREHYGLTLPIFFNTRPKITHKKIQTALQELANANNTTPSAKNAAKSLVYWGDCAKFVMPALLFEADDASRDDKYRHIAADLFIRGGVLQGFVGPNLSPEQRAQNKEIAESNAFLVRQLNEEDLDTKVEALKGWFQDHGGTEVFCYSSKQFWKTFFLETRFARYMSRVLRLDFGTLRNDAHKTVISEVIKRLRCSLVLSILPMIVGFVLCQIFGMIMALKRNRWIDHSLNFIFLILFSIPVFVAVPWILDNFVINKTIPFTTIPMPYSGLRSPPEVFNELSTLGRIFDLVSHGFLPFCAVSYGALAAQSRLSRSIFLEVLSQDFICAAKARGLRWFDILYKHVGKNAAVSIVTSLASSFRNVTWRGVGCRNPIQYRWLWELLLSGNFKSRSQCSSIFCACRIGSIFSGIFARRYLLRTLRSSSSARGKEDINAEASFLLSTFSICLL

SEQ ID NO: 640 - protein, 713 aa, Chlamydia pneumoniae
  SITE 1...713: Xaa=unknown or other
KRRESGHMYKRCVLDKILKGIVAGSLILLYWSSDLLERDIKSIKGNVRDIQEDIREISRVVKQQQTSQAIPAAPGVMLAPKLVRDEAFALLFGDPSYPNLLSLDPYKQQTLPELLGTNFHPHGILRTAHVGKPEXLSLLMALICRGLLRSLYSSLASPHVGKYEEFSPDLAVKIEEHLVEDGSGDKEFHIYLRPNVFWRPIDPKALPKHVQLDEVFQRPHPVTAHDIKFFYDAVMNPYVATMRAVALRSCYEDVVSVSVENDLKLVVRWKAHTVINEEGKEERKVLYSAFSNTLSLQPLPRFVYQYFANGEKIIEDENIDTYRTNSIWAQNFTMHWANNYIVSCGAYYFAGMDDEKIVFSRNPDFYDPLAALIDKRFVYFKESTDSLFQDFKTGKIDISYLPPNQRDNFYSFMKSSAYNKQVAKGGAVRETVSADRAYTYIGWNCFSLFFQSRQVRCAMNMAIDRERIIEQCLDGQGYTISGPFASSSPSYNKQIEGWHYSPEEAARLLEEEGWIDTDGDGIREKVIDGVIVPFRFRLCYYVKSVTAHTIADYVATACKEIGIECSLLGLDMADLSQAFDEKNFDALLMGWCLGIPPEDPRALWHSEGAMEKGSANVVGFHNEEADKIIDRLSYEYDLKERNRLYHRFHEIIHEEAPYAFLFSRHCSLLYKDYVKNIFVPTHRTDLIPEAQDETVNVTMVWLEKKEDPCLSTS

SEQ ID NO: 641 - protein, 210 aa, Chlamydia pneumoniae
QFPRIHADDIINSMDEITPNYPLLRQDSLWNRVRVSWRADLSVSSRYEIASAIAILGLLVAFCASAAVSIIFTANPSCSGIYRWLFGFRAFTYPIGYRSTNHRNYSFTLWYLLVSSTTRVITLSICFYTFYLQIIFLFLYSAWKPLRQPLFCHRLLIIWPISGLSCRILNKENKNEKINVSPSFSSCASCCRFCFWIRILFSTTRRSSRF

SEQ ID NO: 642 - protein, 338 aa, Chlamydia pneumoniae
DSGFMKPLGFQENLEALCNKTSRQLLKYLIKQILFVCGASLLIALEFSFFLYFFLFSGKTVIPAFCLACFFLTLFVCLVTRLYLLSGKGDFFEDLASEYLQGAVPPNKRSQNIVEEQSHLAAAATKLSINLQNQEYSLLSEIFKFLPKHDLIRKFSCFCFWKDYFLFRECLLQKAIEAYIKVVQAIPVDLSAHVSLADAYVALSGLYADPRKYPEFDANYWIPSGRYSAEIQEKFFATARRAIEEFQILNEYAPGNAWVHAQLAYSYHDLQMPMEEIQEYEIVLKLKPNDVETMSKLGILYFQQGMNAKGLRIYEEIKKRDYKKSQKLIKFYGVEYKY

SEQ ID NO: 643 - protein, 350 aa, Chlamydia pneumoniae
WKIMRLIVLMQCLVSLFLAKKVTVTTPAYLLANFGGPRHAKDLQEFLISLLTDRDVTGTFLPRVLHRHLFTFIAKKRVPKVLPQYQSLQNWSPIYFDTETLAKTLSEILRAPVIPFHRYLPSTHEKTLLALRTLHTRHVIGIPLFPHFTYSVTGSIVRFFMKHVPEIPISWIPQFGSDSKFVSLITCHIRDFLQKLGILEKECCFLFSVHGLPVRYISQGDPYSKQCYESFSAITTNFKQSENFLCFQSKFGPGKWLSPSTAQLCQNIDTDKPNVIVVPFGFISDHLETLYEIERDYLPLLRSRGYRALRIPAIYSSPLWVSTLVDIVKENSTVVAEELIKSGKKHTGIR

SEQ ID NO: 644 - protein, 257 aa, Chlamydia pneumoniae
NSEAQLNVKIKFSWKVNFLICLLAVGLIFFGCSRVKREVLVGRDATWFPKQFGIYTSDTNAFLNDLVSEINYKENLNINIVNQDWVHLFENLDDKKTQGAFTSVLPTLEMLEHYQFSDPILLTGPVLVVAQDSPYQSIEDLKGRLIGVYKFDSSVLVAQNIPDAVISLYQHVPIALEALTSNCYDALLAPVIEVTALIETAYKGRLKIISKPLNADGLRLAILKGTNGDLLEGFNAGLVKTRRSGKYDAIKQRYRLP

SEQ ID NO: 645 - protein, 196 aa, Chlamydia pneumoniae
LRKLCSSRGDVRILAGKYKGKSLKTFSNPHIRPTSGLVKEAFFSICREDIEGAAFLDLFAGMGAIGFEALSRGAASVVFVDISIKAIQLIHTNSALLGEQLPVVIFRQDAQSAIQRLIKQKRSFDLIYIDPPYELCNCYVETLLQKIVSGNILNPEGTLFLENASDEEIACEGLTLRRRRKLGKTYLAEYIVEKDP

SEQ ID NO: 646 - protein, 262 aa, Chlamydia pneumoniae
SSYSRRQLRFYTGSLQMHIYGLADLHLALGVPEKTMEVFGDPWIGYHQKICSEWQAVVHPEDIVLLPGDISWAMNLSEAHKDFAFIGDLPGTKYMIRGNHDYWSSASTSKILQALPPSLYYLNQGFALLTPHLAVVGVRLWDSPTICVKKENFLTPSTQEQSYTEQDEKIFLRELGRLKRAFAALPKEVTEVIVMTHYPPISSDGTPGPISEFLEADGRVSLCLFGHIHKVQRPIDGFGNIRGIHYILVAADYVNFVPQEVM

SEQ ID NO: 647 - protein, 330 aa, Chlamydia pneumoniae
PNLVSGYADAIRKNLLYFEDTEIEYFLILSGDQLYNMDFRSIVDTAIRTHVDMVLVAQPIPEKDAYRMGVLDIDSEGKLIDFYEKPQEKEVLKRFQLSSEDRRIHKLTEDSGDFLGSMGIYLFRRDSLFSLLREEEGNDFGKHLIQAQMKRGQVQTLLYNGYWADIGTIESYYEANIALTQKPHAEKRGLNCYDDNGMIYSKNHHLPGAIITDSMISSSLLCEGCVINTSHVSRSVLGIRSKIGENSVVDQSIIMGNARYGSPSMPSLGIGKDCEIRKAIIDENCCIGNGVKLQNLKGYIKYDSPDKKLFVRDNIIIVPQGTHIPDNYIF

SEQ ID NO: 648 - protein, 225 aa, Chlamydia pneumoniae
VSFLYFVKNGRRLWRMMNYEDAKLRGQAVAILYQIGAIKFGKHILASGEETPLYVDMRLVISSPEVLQTVATLIWRLRPSFNSSLLCGVPYTALTLATSISLKYNIPMVLRRKELQNVDPSDAIKVEGLFTPGQTCLVINDMVSSGKSIIETAVALEENGLVVREALVFLDRRKEACQPLGPQGIKVSSVFTVPTLIKALIAYGKLSSGDLTLANKISEILEIES

SEQ ID NO: 649 - protein, 464 aa, Chlamydia pneumoniae
MKEERSSEILPRVKETKKHAYVSMQEKSCVGECAVVASESEEAESVTVTKIAKLQRMGIEELNILARQYGVKNIGSLTKSQVVFEIVKAKSERPDELLIGEGVLEVLPDGFGFLRSPTYNYLPSAEDIYVSPAQIRRFDLKKGDTIIGTIRSPKEKEKYFALLKVDKINGSTPDKAKERVLFENLTPLYPNQRIVMEMGKDHLAERVLDLTAPIGKGQRGLIVAPPRSGKTVILQSIAHAIAVNNPDIVLIVLLIDERPEEVTDMIRQVRGEVVASTFDEQPERHIQVAEMVIEKARRLVEHGNDVVILLDSITRLARAYNTVQPHSGKILTGGVDASALHKPKRFFGAARNIEGGGSLTILATALIDTGSRMDEVIFEEFKGTGNMELVLDRRLSDRRTYPAIDLIKSGTRKEELLYHPSELERVYLFRQAIADLTTIDAMHLLLGRLKKTNSNAEFLLSLKE

SEQ ID NO: 650 - protein, 238 aa, Chlamydia pneumoniae
RRNRRDAKTSEREDGISYDFIRSYSCEYLNWKKLGRMLKLLKVSITGDLSSGKTEACQVFQELGAYVVSADEISHSFLIPHTRIGRRVIDLLGSDVVVDGAFDAQAIAAKVFYNSVLLQGLEAILHPEVCRIIEEQYHQSIQDGNYPFFVAEVPLLYEIHYAKWFDSVILVMANEDIRRERFMKKTGRSSEDFDQRCSRFLNVEEKLAQADVVVENNGTKKELHQKIEEYFYALKGAL

SEQ ID NO: 651 - protein, 870 aa, Chlamydia pneumoniae
MKKLFVLDASGFIFRAYFALPEMKNHQGQATQAVFGFIRSLNKLIKEFSPEYMISVFDGPNNKQSRQAIYADYKSNRQKKFEDIPPQIALVKEYCSLIGLAYLEKESVEADDVIASIAKKAREENYKVYVCTADKDLLQLVNDHVVAWNPWADQGVVGISEVIERYGIPPGNIPDYLALVGDSSDNIPGLPGCGPKKAAALLKQFGSVEGLLENLDAVKGLSQTMLSERQETLKLSKRLALLDSNIPIPVPIESLTFPQHPVDEEKLIHFYIQQGFKTLVPSKQTEAATVDVQIIKDAESLTNILNLVQGGDIAFAVAYTGNHLLSLKLEGLALTQGSGVFFIALEEEGTKILPILKDFFLREDLTFYGYNLKRDCHALLNAGIVIREISYDLALAEHLTNGGGKISFQSLLVNHGFTETAHRFAKEWGNSGLPIGRLPEQPEQYFGEFVAYLPIIKDAILEEINRKNLNHILSDIEMPLEKVLFSMERAGVPLDVEELAILEALFETELAVLTEEIYDLSGRPFNIKSPKQLSDILYNELGLRPIDKAKSTRAEVLEALRSEHPIIEKLLAFRTIEKLLSTYVKALPKQVDSHTQRIHPSFDQTGAVTGRLACRDPNLQNIPIRSERGILLRKAFRLSEKNSYFLSADYSQIELRFLAHLSQDKSLKFAFESGEDIHAFTASQVFHVPLEQVSKEQRMQAKTVNFGIVYGQQAFGLAKVLKISIGEVQELIQAYFSRYPEIAHFVEETIQQAAKDLRVTTMLGRERIIDSWNEFPGSRAASGRFAVNTRIQGSAAELIKLAMLDISQAIKQQQMKSRMLLQIHDELLFEVPEEEIEEMQRLVREKMESAMTLSVPIVVNILIGKNWAEC

SEQ ID NO: 652 - protein, 333 aa, Chlamydia pneumoniae
MKTLWHFVSKAFLSIVGLCCGVVLAFVVIFALIASSLGNGDATFVSLPDAQGEVKDLGKTAPIIAVIEMKDVIASSKNTAKTIQNILEGFEKAPLKDRVKGIVIDMDCPGGEVFEIDRIYSMLRFWKERKGFPIYIYVNGLCASGGYYVSCAATKIYATSSSLIGSIGVRSGPFFNVKEGLNRYGVESDLLTAGKDKAPMNPYTPWTSHDREERQATLDFLYGQFVDIVTQNRPLLTKEKLVHTLGARIFSPEKAKQEGYIDVVGATKEQVLQDIVAVCKIEDNYRVIGSGGDGWWKRVASAAASSPLVTGMIKHDILPLSHDAAYIPPYLAL

SEQ ID NO: 653 - protein, 551 aa, Chlamydia pneumoniae
VFIRHKVGKEFMQSSEVKPFSRLRAYLCPIYKSEFSKFVPLFLLAFFVGFNYCLLKNMKDTLVIVGSDAGAEVIPFLKVWGIVPGAVIVTMVYGWLGSRYPRDTVFYCFMAAFLGFFFLFAVIIYPVGDSLHLNSLADKLQELLPQGLRGFIVMVRYWSYSIYYVMSELWSSVVLSMLFWGLANQITTITEAGRFYALINTGLNLSSICAGEISYWMGKQTFVAYSFACDSWHSVMLNLTMLITCSGLIMIWLYRRIHHLTIDTSIPPSRRVLAEEGAATANLKEKKKPKAKARNLFLHLIQSRYLLGLAIIVLSYNLVIHLFEVVWKDQVSQIYSSHVEFNGYMSRITTLIGVVSVLAAVLLTGQCIRKWGWTVGALVTPLVMLVSGLLFFGTIFAAKRDISIFGGVLGMTPLALAAWTGGMQNVLSRGTKFTFFDQTKEMAFIPLSPEDKNHGKAAIDGVVSRIGKSGGSLIYQGLLVIFSSVAASLNVIALVLLIIMVVWIAVVAYIGKEYYSRAADAVATLKQPKEPSSSIVREAQESVEQEEMAVL

SEQ ID NO: 654 - protein, 377 aa, Chlamydia pneumoniae
  SITE 1...377: Xaa=unknown or other
ITLAEFAGTXAYLEEYVDIIRSKSILRKMISTAKEIEKRALEQPKNVAEALDEAQNSFFKISQSTSVSQYTLVADKLRGLTTTTDKPYLVQLQERQELFLQNAQGDNKSFFTGIPTHFIDLDQLIHGFSPSNLMILAARPAMGKTALALNIAENLCFQNRLPIGIFSLEMTVDQLIHRMICSRSEVDSKKISIGDLSGHDFQRIVSVINEMQEHTLLIDDQPGLKVSDLRARARRMKESYDIQFLIIDYLQLLSGSGTLRATESRQTEISEISRMLKTLARELNIPILCLSQLSRKVEDRANHRPMMSDLRESGSIEQDSDLVMFLLRREYYDPNDKPGTAELIIAKNRHGSIGSVPLVFEKELARFRNYSAFECIS

SEQ ID NO: 655 - protein, 611 aa, Chlamydia pneumoniae
MWTHPIAYDVIVVGAGHAGCEAAYCSAKMGVSVLMLTSNLDTIAKLSCNPAVGGIGKGHIVREIDALGGIMAEVTDQSGIQFRILNQTKGPAVRAPRAQVDKQLYHIHMKRLLENTPGLHIMQATVESLLDKEGVISGVTTKEGWMFSGKTVVLSSGTFMRGLIHIGDRNFSGGRLGDPSSQGLSEDLKKRGFPISRLKTGTPPRLLASSINFSCMEEQPGDLGVGFVHRTEPFQPPLPQLSCFITHTMEKTKAIISANLHRSALYGGCIEGVGPRYCPSIEDKIVKFSDKERHHVFLEPEGLHTQEIYANGLSTSMPFDVQYDMIRSVLGLENAIITRPAYAIEYDYIHGNVIHPTLESKLIEGLFLCGQINGTTGYEEAAAQGLIAGINAVNKVFNRPPFIPSRQESYIGVMLDDLTTQILDEPYRMFTGRAEHRLLLRQDNACARLSHYGYELGLLSEERYELVKKQNQLLEEEKVRLQKTFRQYGQSVVSLAKALSRPEVSYDMLREAFPNDIRDLGAVLNASLEMEIKYSGYIDRQKILIQSLEKAESLLIPEDLDYKQITALSLEAQEKLAKFTPRTLGSASRISGIASADIQVLMIALKKHAHH

SEQ ID NO: 656 - protein, 217 aa, Chlamydia pneumoniae
KNMPTTNCIFLDLRGHSILHQLQIEEALLRVANQNFCIINSGAKDSIVLGISRNLNQDVHISRAQADHIPIIRRYSGGGTVFIDSNTLMVSWIMNSSEASAQPQELLAWTYGIYSPLLPNTFSIRENDYVLGHKKIGGNAQYIQRHRWVHHTTFLWDIDLDKLSYYLPIPQQQPTYRNQRSHEEFLTTLRPWFPSRDDFLERIKASGSLLFYLGRIS

SEQ ID NO: 657 - protein, 144 aa, Chlamydia pneumoniae
MEQTLSIIKPDSVSKAHIGEILSIFEQSGLRIAAMKMMHLSQTEAEGFYFVHRERPFFQELVDFMVSGPVVVLVLEGANAVSRNRELMGATNPAEAASGTIRAKFGESIGVNAVHGSDTLENAAVEIAYFFSKIEVVNASKPLV

SEQ ID NO: 658 - protein, 207 aa, Chlamydia pneumoniae
MYDYIRGTLTYVHTGAIVIECQGIGYHIAITERWAIECIRALHQDFLVFTHVIFRETEHLLYGFHSREERECFRILISFSGIGPKLALAILNALPLKVLCSVVRSEDIRALASVSGIGKKTAEKLMVELKQKLPDLLPLDSRVETSQTHTTSSCLEEGIQALAALGYSKIAAERMIAEAIKDLPEGSSLTDILPIALKKNFSGVNKD

SEQ ID NO: 659 - protein, 168 aa, Chlamydia pneumoniae
VSELIIGVDPGTIVAGYAIIAVEQRYQLRPYSYGAIRLSSDMPLPMRYKTLFEQLSGVLDDTQPNAMVLETQFVNKNPQSTMKLAMARGIVLLAAAQRDILIFEYAPNVAKKAVVGKGHASKRQVQVMVSKILNVPEVLHPSNEDIADAFALAICHTHVARSPLCGVR

SEQ ID NO: 660 - protein, 323 aa, Chlamydia pneumoniae
RYSVRLLSILKLHLFSLRSSSSLSPHYYHSCSRSMLHLLCRWKDADIMEWQQICNILSGVCSRMSGKLVSLQKETQDSCHQEHERIHLQYREQLSALEEEYRRREEAKNQDLEKLQQENTWLQNRLAEKLQQIRHQSDIIDEIKKELLQSVQRTEISEGRRLCYEHKIKQLEEQLQRYVSQHGAPSIEIEEDKSSAAYAEINRLKKSLIDLQQEKDIYIKTYHSEIAKLREKLQRQEGAQTSSEVCSIEKLTEVQTDLAEKKKAIALLQDIVEDQYCQLRDLHKEKGMAMPSNTKLDHLKGLLGKEPESEVDVVFSESKSLGS

SEQ ID NO: 661 - protein, 282 aa, Chlamydia pneumoniae
KGYNYVYFTRDPVIETVITSREGYKLSVRNTKHFSQDPFMVEAIEVISLGNICFFRNCDHSKPFLVPAGDYEVMEVRDTKINLKAVGLDRGVKIAGGREALIKLTKSTPLPVIDEKPLADSPEEGTEPTSPSKKEKKEARKDSFKGEKWKEKKKLSRRRNHKEIAEVTGASQEILDTVKEELWEESQENEIVEQKKFSLLPPPAKLISEVISQTVVDPVVTSADLNESLQALVRESSDLINALLSADDAIHFPETEEEPTSASFEESSAMFFPETSSATEEE

SEQ ID NO: 662 - protein, 336 aa, Chlamydia pneumoniae
AMKVVINGFGRIGRLVFRQILKRNSSVEVLAINDLVPGDALTYLFKFDSTHGRFPEDVRCEADHLIVGKRKIQFLSERNVQNLPWKDLGVDLVIECTGLFTKKEDAEKHIQAGAKRVLISAPGKGDIPTFVMGVNHKTFNPEKDFVISNASCTTNCLAPIAKVLLDNFGITEGLMTTVHAATATQLVVDGPSKKDWRGGRGCLQNIIPASTGAAKAVTLCLPELKGKLTGMAFRVPIEDVSVVDLTVRLDKSTTYDDICKAMKQASETDLKGILDYTDEQVVSSDFIGSEYSSIFDALAGIALNDRFFKLVAWYDNETGYATRIVDLLEYVEKNSK

SEQ ID NO: 663 - protein, 129 aa, Chlamydia pneumoniae
MQHARKKFRVGRTSSHNRCMLANMLKSLIHYERIETTLPKAKELRRHADKMITLAKKNSLAARRIAIGRLMVRYNKLTSKEARQAKGGDTSVYNVDRLVVNKLFDELGNRFVERKGGYTRILKLQNRTW

SEQ ID NO: 664 - protein, 337 aa, Chlamydia pneumoniae
ASRKRNGPHFRKCSKTCFAYWFRSSRYLISFAMTGVLHEYMAIEGVIEDVTNIILNLKGALLKKYPMQDSSLGRTTQVLKASISIDASDLAAANGQKEVTLQDLLQEGDFEAVNPDQVIFTVTQPIQLEVDLRIAFGRGYTPSERIVLEDKGVYEIVLDAAFSPVTLVNYFVEDTRVGQDTDFDRLVLIVETDGRVTPKEALAFSTQILTKHFSIFENMDEKKIVFEEAISIEKENKDDILHKLILGINEIELSVRSTNCLSNANIETIGELVIMPEPRLLQFRNFGKKSLCEIKNKLKEMKLELGMDLTQFGVGLDNVKEKMKWYAEKIRAKNIKG

SEQ ID NO: 665 - protein, 82 aa, Chlamydia pneumoniae
LPAKKKAQSVVLGKEKGMSDNAHNLLYDKFELPEAVKMLPVEGLPIDKHARFIAEPLERGMGHTLGNALRRALLIGLEAPGI

SEQ ID NO: 666 - protein, 133 aa, Chlamydia pneumoniae
  SITE 1...133: Xaa=unknown or other
LVKNQAQAKKSVKRKQLKNIPSGVVHVKATFNNTIVSITDPAGNVISWASAGKVGYSGSXKSSAFAATVAAQDAAKTAMNSGLKEXXVCLKGTGAGRESAVRALISAGLVVSVIRDETPVPHNGCRPRKRRRV

SEQ ID NO: 667 - protein, 122 aa, Chlamydia pneumoniae
MPRIIGIDIPAKKKLKISLTYIYGIGSARSDEIIKKLKLDPEARASELTEEEVGRLNSLLQSEYTVEGDLRRRVQSDIKRLIAIHSYRGQRHRLSLPVRGQRTKTNSRTRKGKRKTVAGKKK

SEQ ID NO: 668 - protein, 462 aa, Chlamydia pneumoniae
LFRPYMTTLRQFFLITELRQKLFYTFALLTACRVGVFIPVPGINGELAVAYFKQLLGSGQNLFQLADIFSGGAFAQMTVIALGVVPYISASIIVQLFLVFMPALQREMRESSDQGKRRIGRLTRLFTVALAVIQSLLFAKFALRMNLTIPGIVLPTLLSSKLFGVPWIFYITTVVVMTTGTLLLMWIGEQISDKGIGNGISLIIALGILSSFPSVLGSIVNKLNLGSQDSSDLGLISILILALVFVFVLITTILIIEGVRKIPVQYARRVIGRREVPGGGSYLPLKVNYAGVIPVIFASSLLMFPATIGQFIASESSWMKRIAALLAPGSLVYSICYVLLIIFFTYFWTATQFHPEQIASEMKKNNAFIPGIRQGKPTQHYLEYTMNRVTLLGALFLAAIAILPSLLGCLLRVDSNVSYFLGGTAMLIVVGVVLDTMKQVDAFLLMRRYDSVLKTDRTKGRH

SEQ ID NO: 669 - protein, 144 aa, Chlamydia pneumoniae
MIKLESLFDISERKRRKKLLGRGPSSGHGKTSGRGHKGDGSRSGYKRRFGYEGGGVPLYRRVPTRGFSHKRFDKCVEEITTGRLAELFQEGEAITLDALKAKKAIARQAVRVKVILKGDLEKTFVWQDTAVVLSQGVQNLLGIT

SEQ ID NO: 670 - protein, 165 aa, Chlamydia pneumoniae
MSLSKNSHKEDQLEEKVLVVNRCSKVVKGGRKFSFSALILVGDGKGRLGYGFAKANELTDAIRKGGEAAKKNLMKIEALEDGSIPHEVLVHHDGAQLLLKPAKPGTGIVAGSRIRLILEMAGIKDIVAKSFGSNNPMNQVKAAFKALTGLSPRKDLLRRGAAIND

SEQ ID NO: 671 - protein, 93 aa, Chlamydia pneumoniae
LEWVSEPLFKVHFWISPLGFLTLQKFPIPSTLQVSVEKNTLISVKGLDKQLVGEFAASIRAKRPPEPYKGKGIRYENEYVRRKAGKAAKTGKK

SEQ ID NO: 672 - protein, 126 aa, Chlamydia pneumoniae
MSRKAREPILLPQGVEVSIQDDKIIVKGPKGSLTQKSVKEVEITLKDNSIFVHAAPHVVDRPSCMQGLYWALISNMVQGVHLGFEKRLEMIGVGFRASVQGAFLDLSIGVSHPTKISYPIYSSGIS

SEQ ID NO: 673 - protein, 133 aa, Chlamydia pneumoniae
  SITE 1...133: Xaa=unknown or other
MGMTSDSIADLLTRIRNALMAEHLYVDVEHSKMREAIVKILKHKGFVAHYLVXEXNXKRAMRVFLQYSDDRKPVIHQLKRVSKPSRRVYVSAAKIPYVFGNMGISVLSTSQGVMEGSLARSKNIGGELLCLVW

SEQ ID NO: 674 - protein, 180 aa, Chlamydia pneumoniae
MSRLKKFYTEEIRKSLFEKFGYANKMQIPVLKKIVLSMGLAEAAKDKNLFQAHLEELTMISGQKPLVTKARNSIAGFKLREGQGIGAKVTLRGIRMYDFMDRFCNIVSPRIRDFRGFSNKGDGRGCYSVGLDDQQIFPEINLDRVKRTQGLNITWVTTAQTDDECTTLLELMGLRFKKAQ

SEQ ID NO: 675 - protein, 111 aa, Chlamydia pneumoniae
MKKQNIRVGDKVFILAGNDKGKEGKVLSLTEDKVVVEGVNVRIKNIKRSQQNPKGKRISIEAPIHISNVRLTIAGEPAKLSVKVTEQGRELWQRRPDGTSQLYRLVRGKKG

SEQ ID NO: 676 - protein, 79 aa, Chlamydia pneumoniae
MIQQESQLKVADNTGAKKVKCFKVLGGSRRRYATVGDVIVCSVRDVEPNSSIKKGRRYQSCDRAHTSAYYKKRWVYFKI

SEQ ID NO: 677 - protein, 86 aa, Chlamydia pneumoniae
MASEPRGSRKVKIGVVVSAKMEKTVVVRVERIFSHPQYLKVVRSSKKYYAHTELKVSEGDKVKIQETRPLSKLKRWRVIEHVGVVS

SEQ ID NO: 678 - protein, 138 aa, Chlamydia pneumoniae
  SITE 1...138: Xaa=unknown or other
MLMPKRTKFRKQQXGQFAGLSKGATFVDFGEYAMQTLERGLVTSRKIEACRVAINRYLKRRGKVWIRIFPDKSVTKKPAETRMGKGKGAPDHWVAVVRPGRILFEVANVSKEDAQDALRRAAAKLGIKTRFVKRVERV

SEQ ID NO: 679 - protein, 223 aa, Chlamydia pneumoniae
MGQKGCPIGFRTGVTKKWRSLWYGNKQEFGKFLIEDVRIRQFLRKKPSCQGAAGFVVRRMSGKIEVTIQTARPGLVIGKKGAEVDLLKEELRALTGKEVWLEIAEIKRPELNAKLVADNIARQIERRVSFRRAMKKAMQSVMDAGAVGVKIQVSGRLAGAEIARSEWYKNGRVPLHTLRADIDYATACAETTYGIIGIKVWINLGENSSSTTPNNPAAPSAAA

SEQ ID NO: 680 - protein, 115 aa, Chlamydia pneumoniae
RRHSMFKATARYIRVQPRKARLAAGLMRNLSVQEAEEQLGFSQLKAGRCLKKVLNSAVANAELHENIKRENLSVTEVRVDAGPVYKRSKSKSRGGRSPILKRTSHLTVIVGEKER

SEQ ID NO: 681 - protein, 284 aa, Chlamydia pneumoniae
MFKKFKPVTPGTRQLVLPAFDELTTRGELRGTKSKRSLRPNKKLSFFKKSSGGRDNLGHISCRHRGGGAKQLYRVVDFKRNKDGITAKVVTVEYDPNRSAYIALLSYEDGEKRYILAPKGIQRGDVVVSGEGSPFKPGCCMTLKSIPLGLSVHNIEMRPSSGGKLVRSAGLAAQVIAKSPGYVTLKMPSGEFRMLNEGCRATIGEVSNADHNLRVDGKAGRRRWMGVRPTVRGTAMNPVDHPHGGGEGRHNGYIPRTPWGKVTKGLKTRDKNKSNKWIVKDRRK

SEQ ID NO: 682 - protein, 112 aa, Chlamydia pneumoniae
DMKDPYDVIKRHYVTEKAKMLEHLSAGTGEGKKKGSFCKDPKFVFIVSHDATKPLIAQALEAIYVDKNVKVKSVNTINVKPQPARMFRGRRKGKTSGFKKAIVTFYQGHSVG

SEQ ID NO: 683 - protein, 224 aa, Chlamydia pneumoniae
WFYYQNLDFSGNKIGEVEVADSLFADEGDGLQLIKDYIVAIRANKRQWSACTRNRSEVSHSTKKPFKQKGTGNSRQGCLASPQFRGGGIVFGPKPKFNQHVRINRKERKAAIRLLLAQKIQTNKLTVVDDTVFVDALTAPKTQSALRFLKDCNVECRSILFIDHLDHVEKNENLRLSLRNLTAVKGFVYGININGYDLASAHNIVISKKALQELVERLVSETKD

SEQ ID NO: 684 - protein, 235 aa, Chlamydia pneumoniae
LFLQEESKSLLLMDKFMRSHISVMGKKEGMIHIFDKDGSLVACSVIRVEPNVVTQIKTKESDGYFSLQIGAEEMNAPAHTITKRVSKPKLGHLRKAGGRVFRFLKEVRGSEEALNGVSLGDAFGLEVFEDVSSVDVRGISKGKGFQGVMKKFGFRGGPGSHGSGFHRHAGSIGMRSTPGRCFPGSKRPSHMGAENVTVKNLEVIKVDLEKKVLLVKGAIPGARGSIVIVKHSSRT

SEQ ID NO: 685 - protein, 100 aa, Chlamydia pneumoniae
KVASKKFFRSDFFKIKIKLAYLPDFVFCHMLYKPIPADAAVKAPEIAAEQATVIGKGMSLTPSTTNSKAFSRRVKTFLFRVATCSLRNALSALRITSPLN

SEQ ID NO: 686 - protein, 334 aa, Chlamydia pneumoniae
KWRLTQLDRQEVQQVRCCCQLPKNQRLSAPLLRKGFIVFNNFFTNPGNKLAKFVGATKSLDKCFKLSKAVSDCVVGSLEEAGCTGDALTSARNAQGMLKTTREVVALANVLNGAVPSIVNSTQRCYQYTRQAFELGSKTKERKTPGEYSKMLLTRGDYLLAASREACTAVGATTYSATFGVLRPLMLINKLTAKPFLDKATVGNFGTAVAGIMTINHMAGVAGAVGGIALEQKLFKRAKESLYNERCALENQQSQLSGDVILSAERALRKEHVATLKRNVLTLLEKALELVVDGVKLIPLPITVACSAAISGALTAASAGIGLYSIWQKTKSGK

SEQ ID NO: 687 - protein, 321 aa, Chlamydia pneumoniae
LNLKVVYFGTPTFAATVLQDLLHHKIQITAVVTRVDKPQKRSAQLIPSPVKTIALTHGLPLLQPSKASDPQFIEELRAFNADVFIVVAYGAILRQIVLDIPRYGCYNLHAGLLPAYRGAAPIQRCIMEGATESGNTVIRMDAGMDTGDMANITRVPIGPDMTSGELADALASQGAEVLIKTLQQIESGQLQLVSQDAALATIAPKLSKEEGQVPWDKPAKEAYAHIRGVTPAPGAWTLFSFSEKAPKRLMIRKASLLAEAGRYGAPGTVVVTDRQELAIACSEGAICLHEVQVEGKGSTNSKSFLNGYPAKKLKIVFTLNN

SEQ ID NO: 688 - protein, 279 aa, Chlamydia pneumoniae
MASIHPTAIIEPGAKIGKDVVIEPYVVIKATVTLCDNVVVKSYAYIDGNTTIGKGTTIWPSAMIGNKPQDLKYQGEKTYVTIGENCEIREFAIITSSTFEGTTVSIGNNCLIMPWAHVAHNCTIGNNVVLSNHAQLAGHVQVGDYAILGGMVGVHQFVRIGAHAMVGALSGIRRDVPPYTIGSGNPYQLAGINKVGLQRRQVPFATRLALIKAFKKIYRADGCFFESLEETLEEYGDIPEVKNFIEFCQSPSKRGIERSIDKQALEEESADKEGVLIES

SEQ ID NO: 689 - protein, 153 aa, Chlamydia pneumoniae
MNQPSVIKLRELLDLLPHRYPFLLVDKVLSYDIEARSITAQKNVTINEPFFMGHFPNAPIMPGVLILEALAQAAGVLIGLVLENDRNKRIALFLGIQKAKFRQAVRPGDVLTLQADFSLISSKGGKAWAQARVDSQLVTEAELSFALVDKESI

SEQ ID NO: 690 - protein, 166 aa, Chlamydia pneumoniae
  SITE 1...166: Xaa=unknown or other
SIKQVFVNKKIXVSIARLTRPVYYQHQDIFLAAFPSDELKISYTLHYPQSSTIGTQYKSLVINEESFRQEIAPCRTFALYNELCFLMEKGLIGGGCLDNAVVFKDDGIISRGQLRFADEPVRHKILDLIGDLSLVGRPFVAHVLAVGSGHSSNIAFGKKILEALEL

SEQ ID NO: 691 - protein, 152 aa, Chlamydia pneumoniae
  SITE 1...152: Xaa=unknown or other
MLERTQRTLKREVRYSGVGIHLGKSSTLHLQPAQTNTGIVFQRQSASGNYENVPALLDHVYTTGRSTTLSRGSAVIATVEHLMAALRSNNIDNLIIQCSGEEIPIGDGSSNVFVELIDQAGICEQEDXGFHCETNTSCILSTSGHFFSSFSL

SEQ ID NO: 692 - protein, 541 aa, Chlamydia pneumoniae
VLRIFCFVISWCLIAFAQPDLSGFVSILGAACGYGFFWYSLEPLKKPSLPLRTLFVSCFFWIFTIEGIHFSWMLSDQYIGKLIYLVWLTLITILSVLFSGFSCLLVAIVRQKRTAFLWSLPGVWVAIEMLRFYGIFSGMSFDYLGWPMTASAYGRQFGGFLGWAGQSFAVIAVNMSFYCLLLKKPHAKMLWVLTLLLPYTFGAIHYEYLKHAFQQDKRALRVAVVQPAHPPIRPKLKSPIVVWEQLLQLVSPIQQPIDLLIFPEVVVPFGKHRQVYPYESCAHLLSSFAPLPEGKAFLSNSDCATALSQHFQCPVIIGLERWVKKENVLYWYNSAEVISHKGISVGYDKRILVPGGEYIPGGKFGSLICRQLFPKYALGCKRLPGRRSGVVQVRGLPRIGITICYEETFGYRLQSYKRQGAELLVNLTNDGWYPESRLPKVHFLHGMLRNQEFGMPCVRACQTGVTATVDSLGRILKILPYDTRETKAPSGVLETSLPLFNYKTLYGYCGDYPMILIAFCAVSYLGGGFLGYRLLAKKEIR

SEQ ID NO: 693 - protein, 155 aa, Chlamydia pneumoniae
MLKKKPVSFSCIDGHIYKIFPNDLNANNTVFGGLLMSLLDRLALVVAERHTESVCVTAFVDALRFYAPAYMGENLICKAAVNRTWRTSLEVGVKVWAENIYKQERRHITSAYFTFVAVNEDNQPIPVHQIVPETPEEKRRYNEADRRRQARLELK

SEQ ID NO: 694 - protein, 252 aa, Chlamydia pneumoniae
KEIMSLLKDTVFTCLDCEMTGLDVKKDRIIEIAAVRFTFDSVISSIEFLINPERVVSAESQRVHHISNAMLRDQPKIAEVFPQIKAFFKEGDYIVGHSVGFDLQVLAQEMERIGETFLSKYTIIDTLRLAKEYGDSPNNSLESLAVHFNVPYDGNHRAMKDVEININIFKHLCKRFRTLEQLKQVLAKPIKMKYMPLGKHKGRCFSEIPLAYLQWASKMDFDSDLLFSIRHEIKHRQKGTGFSQVNNPFMEL

SEQ ID NO: 695 - protein, 142 aa, Chlamydia pneumoniae
PMGRYRRVSHSSQETLLLGTELGQVLVPGAVLLLFGDYGAGKTEFVRGIVSGYLGDTIAEEVASPSFSILHVYGNEPKRLCHYDLYRIDQKNQEYIFQDAEEDDVLCIEWADRLPKPRFCDTINIYITMQTNMEREIIIEKR

SEQ ID NO: 696 - protein, 191 aa, Chlamydia pneumoniae
  SITE 1...191: Xaa=unknown or other
FSKLXEDAVRILEQDKKIWRETEIQISSEKPQVNENTKRIYICPFTGKVFADNVYANPQDAIYDWLSSCPQNMEKQGGVRIKRFLVSEDPDVIKEYAVPPKEPIIKTVFASAITGKLFHSLPPLLEDFISSYLRPMTLEEVQNQTKFQLESSFLSLLQDALVEDKIAAFIESLADDTAFHVYISQWVDTEE

SEQ ID NO: 697 - protein, 102 aa, Chlamydia pneumoniae
MVKIISSENFDSFIASGLVLVDFFAEWCGPCRMLTPILENLAAELPHVTIGKINIDENSKPAETYEVSSIPTLILFKDGNEVARVVGLKDKEFLTNLINKHA

SEQ ID NO: 698 - protein, 156 aa, Chlamydia pneumoniae
MRVVLHCPDIPQNTGNIGRTCVALGAELILVRPLGFSLADKFVKRAGMDYWDKLQLTVVDSIEEALHDVPEDQIFCLCTKGSASYTEFSLPSSGTYVFGSESKGLPKEILKKYYKNCLRIPMQQDIRSLNLATSVGIVLYEVVRQKTVALQKNPTV

SEQ ID NO: 699 - protein, 258 aa, Chlamydia pneumoniae
MNRRWNLVLATVALALSVASCDVRSKDKDKDQGSLVEYKDNKDTNDIELSDNQKLSRTFGHLLARQLRKSEDMFFDIAEVAKGLQAELVCKSAPLTETEYEEKMAEVQKLVFEKKSKENLSLAEKFLKENSKNAGVVEVQPSKLQYKIIKEGAGKAISGKPSALLHYKGSFINGQVFSSSEGNNEPILLPLGQTIPGFALGMQGMKEGETRVLYIHPDLAYGTAGQLPPNSLLIFEINLIQASADEVAAVPQEGNQGE

SEQ ID NO: 700 - protein, 584 aa, Chlamydia pneumoniae
  SITE 1...584: Xaa=unknown or other
MKYRTHRCNELTSNHIGENVQLAGWVHRYRNHGGVVFIXLRDRFGITQIVCREDEQPELHQRLDAVRSEWVLSVRGKVCPRLAGMENPNLATGHIEVEVASFEVLSKSQNLPFSIADDHINVNEELRLEYRYLDMRRGDIIEKLLCRHQVMLACRNFMDAQGFTEIVTPVLGKSTPEGARDYLVPSRIYPGKFYALPQSPQLFKQLLMVGGLDRYFQIATCFRDEDLRADRQPEFAQIDIEMSFGDTQDLLPIIEQLVATLFATQGIEIPLPLAKMTYQEAKDSYGTDKPDLRFDLKLKDCRDYAKRSSFSIFLDQLAHGGTIKGFCVPGGATMSRKQLDGYTEFVKRYGAMGLVWIKNQEGKVASNIAKFMDEEVFHELFAYFDAKDQDILLLIAAPESVANQSLDHLRRLIAKERELYSDNQYNFVWITDFPLFSLEDGKIVAEHHPFTAPLEEDIPLLETDPLAVRSSSYDLVLNGYEIASGSQRIHNPDLQSQIFTILKISPESIQEKFGFFIKALSFGTPPHLGIALGLDRLVMVLTAAESIREVIAFPKTQKASDLMMNAPSEIMSSQLKELSIKVAF

SEQ ID NO: 701 - protein, 430 aa, Chlamydia pneumoniae
VTVTLPKGVFDIFPYLADAKQLWRHTSLWHSVEKAIHTVCMLYGFCEIRTPIFEKSEVFLHVGEESDVVKKEVYSFLDRKGRSMTLRPEGTAAVVRSFLEHGASHRSDNKFYYILPMFRYERQQAGRYRQHHQFGVEAIGVRHPLRDAEVLALLWDFYSRVGLQHMQIQLNFLGGSETRFRYDKVLRAYLKESMGELSALSQQRFSTNVLRILDSKEPEDQEIIRQAPPILDYVSDEDLKYFNEILDALRVLEIPYAINPRLVRGLDYYSDLVFEATTTFQEVSYALGGGGRYDGLISAFGGASLPACGFGVGLERAIQTLLAQKRIEPQFPHKLRLIPMEPDADQFCLEWSQHLRRLGIPTEVDWSHKKVKGALKAASTEQVSFVCLIGERELISQQLVIKNMSLRKEFFGTKEEVEQRLLYEIQNTPL

SEQ ID NO: 702 - protein, 352 aa, Chlamydia pneumoniae
MNVWTKFFQPPKHIKEIEDQEVVKKKYKYWRIRIFYSMFIGYIFYYFTRKSFTFAMPTLIADLGFDKAQLGIIGSTLYFSYGISKFVSGVMSDQSNPRYFMAIGLMITGLTNIFFGMSSSIVLFALWWGLNGWFQGWGWPPCARLLTHWYAKSERGTWWSVWSTSHNIGGALIPILTGFIIDYSGWRGAMYVPGILCIGMGLVLINRLRDTPQSLGLPPIEKYKRDPHHAHHEGKSASEGTEEIERELSTREILFTYVLTNQWLWFLAAASFFIYIVRMAVNDWSALFLIETKHYAAVKANFCVSLFEIGGLFGMLVAGWLSDKISKGNRGPMKRPLLFRFAVCYFRHVVFT

SEQ ID NO: 703 - protein, 122 aa, Chlamydia pneumoniae
NVLFSLGLLFAILGMWFSRSHNQWWVDGTLLFVIGFFLYGPQMMIGLAAAELSHKKAAGTASGFTGWFAYFGATFAGYPLGKVTDVWGWKGFFIALLACASIALLLFLPTWNATEKNTRSKA

SEQ ID NO: 704 - protein, 1243 aa, Chlamydia pneumoniae
GFFLTWIPLHCHSQYSVLDAMSSIKDFVAKGQEFGIPALALTDHGNLYGAVDFYKECTQKGIQPIIGCECYIAPGSRFDKKKEKRSRAAHHLILLCKNEQGYRNLCILTSLAFTEGFYYFPRIDKDLLRQYSEGLICLSGCLSSSVSDAALKSPEALLLELQWFQDLFKDDYFTEVQLHKMSEESIAGFKEEWLKQEYYSLIEKQIKVNTAVLEASKRLGIPTVATNDIHYINANDWQAHEILLNVQSGETVRIAKQNTHIPNPKRKVYRSREYYFKSPAQMAELFKDIPEVISNTLEVAKRCDFTFDFSKKHYPIYVPESLKTLNSYTEEDRYQASAVFLKQLAEEALPKKYSSEVLAHIAKKFPHRDPIDIVKERMDMEMAIIIPKGMCDYLLIVWDIIHWAKANGIPVGPGRGSGAGSVLLFLLGITEIEPIRFDLFFERFINPERLSYPDIDIDICMAGRERVINYAIERHGKDNVAQIITFGTMKAKMAVKDVGRTLDMALSKVNHIAKHIPDLNTTLSKALETDPDLHQLYINDAESAQVIDMALCLEGSIRNTGVHAAGVIICGDQLTNHIPICISKDSTMITTQYSMKPVESVGMLKVDLLGLKTLTSINIAMSAIEKKTGQSLAMATLPLDDATTFSLLHQGKTMGIFQMESKGMQELAKNLRPDLFEEIIAMGALYRPGPMDMIPSFINRKHGKEIIEYDHPLMESILKETYGIMVYQEQVMQIAGALASYSLGEGDVLRRAMGKKDFQQMEQEREKFCKRACNNGIDPELATVIFDKMEKFAAYGFNKSHAAAYGLITYTTAYLKANYPKEWLAALLTCDSDDIEKIGKLIREAQSMGIPILPPHINVSSNHFVATDEGIRFAMGAIKGIGRGLIESIVEERDHHGPYESIRDFIQRSDLKKVSKKSIESLIDAGCFDCFDSNRDLLLASVEPLYEAIAKDKKEAASGVMTFFTLGAMDRKNEVPICLPKDIPTRSKKELLKKEKELLGIYLTEHPMDTVRDHLSRLSVVLAGEFENLPHGSVVRTVFIIDKVTTKISSKAQKKFAVLRVSDGIDSYELPIWPDMYEEQQELLEEDRLIYAILVLDKRSDSLRISCRWMKDLSIVNENIIYECDQAFDRIKNQVQKMSFTMSTSGKETKAKGNKPNENGHTQALAPVTLSLDLNELRHSHLCILKKIVQKHPGSRTLVLVFTQDNERVASMSPDDAYFVCEDIEELRQELVTADLPVRVITV

SEQ ID NO: 705 - protein, 307 aa, Chlamydia pneumoniae
NISLLCKIQKRYFMKKLILYFAAFVASLFCGVFLWDRVPCAQKIMRLAADHSSEVFSKSCRFVRKISGFEELQVFERHVSPEQALALFPEYRDGKSFVELAFIPHTLMHVRFSKEEPVKKHIISQEGEILWSLVNGEMVLHTGTWTCSKGFRECLLLHAGKQDMRVIQTLATLGGTTSRESLAQALALKNIRAERVIKECQKKKLIFASGNQIGTHFQQFQPIRGCTTTLNNNPVWLQKPRHAAVFPAQYSEDRVRHLVKMIFGDNFLIVRSSMVYVPVYKISLVSADNSVRVEYINAVTGKSFQDL

SEQ ID NO: 706 - protein, 171 aa, Chlamydia pneumoniae
WRFVVVSPRLIMKFLLYVPLLLVLVSTGCDAKPVSFEPFSGKLSTQRFEPQHSAEEYFSQGQEFLKKGNFRKALLCFGIITHHFPRDILRNQAQYLIGVCYFTQDHPDLADKAFASYLQLPDAEYSEELFQMKYAIAQRFAQGKRKRICRLEGFPKLMNADEDAYAFMTRF

SEQ ID NO: 707 - protein, 167 aa, Chlamydia pneumoniae
RCVRIYDEILTAFPSKDLGAQALYSKAALLIVKNDLTEATKTLKKLTLQFPLHILSSEAFVRLSEIYLQQAKKEPHNLQYLHFAKLNEEAMKKQHPNHPLNEVVSANVGAMREHYARGLYATGRFYEKKKKAEAANIYYRTAITNYPDTLLVAKCQKRLDRISKHTS

SEQ ID NO: 708 - protein, 212 aa, Chlamydia pneumoniae
IEYLSILPKIEINMRLFSLGTIYLFFSLALSSCCGYSILNSPYHLSSLGKSLLQERIFIAPIKEDPHGQLCSALTYELSKRSFAISGRSSCAGYTLKVELLNGIDKNIGFTYAPNKLGDKTHRHFIVSNEGRLSLSAKVQLINNDTQEVLIDQCVARESVDFDFEPDLGTANAHEFALGQFEMHSEAIKSARRILSIRLAETIAQQVYYDLF

SEQ ID NO: 709 - protein, 150 aa, Chlamydia pneumoniae
LLNRYTMTFFEGETVFPAVLSELHSMLDLIKRAGKQSKCPQEKLLKLELACEELLVNIISYAYQGENSPGTIAISCISHRGDLEVVIKDHGPSFNPLAVSINIQEDLPLEQRKLGGLGIFLAKSSVDEFLYAREDHCNIVHLKMLNGQHS

SEQ ID NO: 710 - protein, 152 aa, Chlamydia pneumoniae
RITINQRKYTMSLDFFEEFYHQSILNTGTSFPEGYLNIAEILSYPHCTDANTDFLCSQSDNDFIIAESKDKLTLFNADFAIWLVPELVQGQAVTRGYIAVSQGEGNYEPEMAFEASGQYNQSSLILEALQLYLKDIKDTENALRSFRFNNDH

SEQ ID NO: 711 - protein, 436 aa, Chlamydia pneumoniae
MKRPFFTYLCIIFYGSCASLSLHAGLSFPEVRGATAAVVHADSGKVFYDKDIDAVIYPASMTKIATALFILKHYPTVLDTLIKVKQDAIASITPQAKKQSGYRSPPHWLETDGSTIQLHLREELLGWDLFHALLVCSANDAANVLAMACCGSVEKFMDKLNFFLKEEIGCTHTHFNNPHGLHHPNHYTTTRDLISIMRCALKEPPFRGVISTTSYKIGATNLHGERILSPTNKLLLPGSTYHYPPALGGKTGTTKTAGKNLIMAAEKNNRLLVTIATGYSGPVSDLYQDVIALCETVFNEPLLRKELVPPSDCLQLEIANLGKLSCPLPEGLYYDFYASEDREPLSVSFIAHADAFPIEQGDLLGHWVFYDDEGKKISSQPFYAPCRFERTIKPWKLYMKRVFTSYRTYMSITMLLMYFRIRKHRKYKNLKHYSKI

SEQ ID NO: 712 - protein, 371 aa, Chlamydia pneumoniae
RGILYVTMVPFRQHHAYQLLKQLHTSAISEADRVSYYFKQNRSLGSKDRQWIQNIIFNILRHRRLLETLILDSGEQVTPEALVAKVNEGVLENLDSYSAIPWPVRYSISDDLAHFLVQDYGEEQAEEIAKIWLTEAPITIRVNTDKISVKELQEKLEYPSSPGELPEALHFSKRHPLQSTEAFRRGFFEIQDENSQRISQGISLTDKDIVLDFCAGAGGKSLIFAQKAKHVVINDSRKAILQTAKHRLLRAGARNFSLADQLRLGSFSVVIVDAPCSGTGVFRRHPEHKWQFSKKLLLNYVRVQKSILKQASAYVGPRGRLVYITCSLLKEENEAHVAYMHSLGWKEVHRKTLPLQVGKGDAFFTSHFQKI

SEQ ID NO: 713 - protein, 388 aa, Chlamydia pneumoniae
VPLSMILDFQFSIGYYLRVLELAIRDGTRILAYDRKRLLLDAWPVNDPLPTNYDTSVSTIRQVIHELFSWSAISYSISSRLLAIIELRLHEEKPQTGWLYRLFFPSKYHIKKAIVDKLCMFKSLILFESKRPVDKIVQAANKVFSKGKSNFSSWEDFTHEVTVSEVQTPLAGEVQRRLAADASLQMIIEALTTLLEGHTAYLPLSLELLNQFIGEKAQPLKTLSEKSYVLLRELIQLFSLSAEDFQTIIMSIISDSLSEVLANSLIGNQPLTFHGKTFVGLWQETALASPEDSKLALGFLAEVLRKVIVEKKLHVSKSDNTTPEEVGNIYSIRDQNPALWDKMITMLLMRWLLDYDRDIGIALRKAAEYYNPHPSFWRQFLRLWQRRP

SEQ ID NO: 714 - protein, 82 aa, Chlamydia pneumoniae
FTSPYLGAGQCVSVVDNLKTYDLGRNYTQVLACASQIDEFADKGENEALVMKDILYLVRQDRSKELGDFLMMWSEEHASEVN

SEQ ID NO: 715 - protein, 264 aa, Chlamydia pneumoniae
SMGTPISGNDGDRNTISDPLEESAAEEGDSDLEDRVSESATQVIETIADTGIPEATPSEGTNSDLNSDLVDRVEYEARGSLLTTMLARIRKAVSQIWMHVKTKRHPKEQGVRSLGDIPCDLLKATRLPKETAEPPYFYALETALASCRSFFFHVFLRLFTLLRRQHPEAPLDLCGTDPISPEAAVAFALILRSCCKWVATDAVQEGLPLEVIEEAGMYNAFSLEATTTVEEVSKRLSELLYSDKRIDGLANVRGITKINLPLLI

SEQ ID NO: 716 - protein, 385 aa, Chlamydia pneumoniae
RIAMGINPSGNRSPDDVWVRGAQGDSSSTQGTGATNSNLGAHNVTTSTSQPQVASKAKQLWQTVREFFLGKKSPDSSQGASGPAMQSPSGPTIRPTRPAPPPPTTGGANAKRPATHGKGRAPQPPTAGSSSGSEQPTAMSSEVAKLVSELKDAVHSHAESQKVLKKVSQELQTKWTDWENNRGPDYLLHGYRVIARALQQTYTEQSMLIEGTSSTGPVPQAVTVAKDAVTQTVRGAIKNLENPKPGNDPDGVLMQVVISLGIEGPTLDPGESIQNFLETRVSDFGGDDSDIDYTSDIARLGSALDRVRENHPNEMPRIWIALARELGAAVHSHATSVRIANAGKNHTRDVVRMANESSRLLQGMKVLSVGAWANTMTVLIGDLFE

SEQ ID NO: 717 - protein, 216 aa, Chlamydia pneumoniae
KIIMSVNPSGNSKNDLWITGAHDQHPDVKESGVTSANLGSHRVTASGGRQGLLARIKEAVTGFFSRMSFFRSGAPRGSQQPSAPSADTVRSPLPGGDARATEGAGRNLIKKGYQPGMKVTIPQVPGGGAQRSSGSTTLKPTRPAPPPPKTGGTNAKRPATHGKGPAPQPPKTGGTNAKRAATHGKGPAPQPPKGILKQPGQSGTSGKKRVSWSDED

SEQ ID NO: 718 - protein, 404 aa, Chlamydia pneumoniae
GYMDKLTVQDLSPEEKKVLVRVDFNVPMQDGKILDDIRIRSAMPTINYLLKKHAAVILMSHLGRPKGQGFQEEYSLQPVVDVLEGYLGHHVPLAPDCVGEVARQAVAQLSPGRVLLLENLRFHIGEEHPEKDPTFAAELSSYGDFYVNDAFGTSHRKHASVYVVPQAFPGRAAAGLLMEKELEFLGRHLLTSPKRPFTAILGGAKISSKIGVIEALLNQVDYLLLAGGMGFTFLQALGKSLGNSLVEKSALDLARNVLKIAKSRNVTIVLPSDVKAAENLQSKEYSVISIDQGIPPHLQGFDIGPRTTEEFIRIINQSATVFWNGPVGVYEVPPFDSGSIAIANALGNHPSAVTVVGGGDAAAVVALAGCSTKVSHVSTGGGASLEFLEQGFLPGTEVLSPSKS

SEQ ID NO: 719 - protein, 121 aa, Chlamydia pneumoniae
WNKALKAKKKSMDNKAPAGSVINQESTISLIMFKLMARIPRAKPIPKTAPTTTCVVDIGSPKIEAKAIVNAEPIPTENPRDGVNSVILQPTVSITRHPQIARPMTKPMPPNAMSLINVYDV

SEQ ID NO: 720 - protein, 428 aa, Chlamydia pneumoniae
YSMLPLIIFVLLCGFYTSWNIGANDVANAVGPSVGSGVLTLRQAVVIAAIFEFFGALLLGDRVAGTIESSIVSVTNPMIASGDYMYGMTAALLATGVWLQLASFFGWPVSTTHSIVGAVIGFGLVLGKGTIIYWNSVGIILISWILSPFMGGCVAYLIFSFIRRHIFYKNDPVLAMVRVAPFLAALVIMTLGTVMISGGVILKVSSTPWAVSGVLVCGLLSYIITFYYVHTKHCSYISDTPKKGSLTYRLKERGGNYGRKYLVVERIFAYLQIIVACFMAFAHGSNDVANAIAPVAGVLRQAYPASYTSYTLIRLMAFGGIGLVIGLAIWGWRVIETVGCKITELTPSRGFSVGMGSALTIALASILGLPISTTHVVVGAVLGIGLARGIRAINLNIIKDIVLSWFITLPAGALLSILFFFALRALFH

SEQ ID NO: 721 - protein, 248 aa, Chlamydia pneumoniae
NGIRSHKSFTRSFRQVIIAKKAILMQTLARLFGQSPFAPLQAHLEMVVSCVEYMLPIFTALRDGRYEELLEMAKLVSDKEYQADCIKNDMRNHLPAGLFMPISRAGILEIISIQDSIADTAEDVAILLTIRRLNFYPSMETLFFRFLEKNLEAFELTMTLLHEFNQLLESSFGGRKADKARLLVGRVAKSEHESDVLQRELMQIFFSDDFIIPEKEFYLWLQVIRRTAGISDSSEKLAHRINMTLEEK

SEQ ID NO: 722 - protein, 161 aa, Chlamydia pneumoniae
KIIEISVPIIFFCIEREAVSKLWPWKLTWPETENGGQGSNRRIACAETDFPDPDSPMIAKVCPSLIVNDKDWTMGYCWRCFAKVMDRSSICKMGLEAISRLQDRLGKLLLRKRLFLCKPLLVYLANLHLLLYKLIWKWWSLVWNTCFLYSLLSEMEDMKNY

SEQ ID NO: 723 - protein, 344 aa, Chlamydia pneumoniae
LHKNSLFRNNNLPKRSCKRLMASNPILQIEDLSITLAKQRQQYPIVQSLSFTINEGQTLAIIGESGSGKSVSAHAILRLLPCPPFSVSGQVNFQGHNLLTASRSIQKKIIGTEISMIFQNPQASLNPVFTIEQQFREIIHTHLALTAEVAKEKMLYALEETGFHDPRLCLNLYPHQLSGGMLQRICIAMALLCSPKLLIADEPTTALDVSVQYQILQLLKTLQKKTGMSLLIITHNMGVVAETADDVLVLYAGRMVECAPAVQMFHNPSHPYTRDLLASRPSLQPQQLGSFNPIPGQPPHYTAFPSGCRYHPRCSKILNRCSAEAPEIYPVREGHKVRCWLYDD

SEQ ID NO: 724 - protein, 324 aa, Chlamydia pneumoniae
MTTNFPQPLIQATSLTKHYYKRSFWFQGKTIASRPVDDVSFSLYSRRAVGLIGESGSGKSTLALALAGLLPLTSGFLTFNGTPIKLHSKHGRHQLRSQVRLVFQNPQASLNPRKTILDSLGHSLLYHKLVPKEKVLATVREYLELVGLSEEYFYRYPHQLSGGQQQRVSIARALLGVPQLIICDEIVSALDLSIQAQILNMLAELQKKLSLTYLFISHDLAVVRSFCTEVFIMYKGQIVEKGNTKRIFSDPQHPYTRMLLNAQLPETPDQRQSKPIFQEYHKDSEESCSTGCYFYNRCPQKQEACKSEIIPNQGDAHHTYRCIH

SEQ ID NO: 725 - protein, 143 aa, Chlamydia pneumoniae
  SITE 1...143: Xaa=unknown or other
AYCWRARWRAMQLAGATTIPVILKHVIADGTAAEATLIENIQRVNLNPIEMAEAFKRLIHVFGLTQDXVAYKVGKKRSTVANYLRLLALSKTIQESLLQGQITLGHAKVILTLEDPILREKLNEIIIQEHLAVREAELIANSL

SEQ ID NO: 726 - protein, 91 aa, Chlamydia pneumoniae
EKSGDIVTEEISKDTIIEVAIDDIRVSPFQPRRVFSNEELQELIASIKAVGLIHPPVVREICTGDRVLYYELIAGEPAGGPCSSQEQLRYL

SEQ ID NO: 727 - protein, 238 aa, Chlamydia pneumoniae
RKIHKNLRHAYRFSTPNCRSFMQKLVHNIWKKFYSFSSAIAICIVLASFLSLKIVSNTYKHSQAKRNSILLLTRAAEVAVSQGFLPSKSALSSLEQAYHLGGESMKPYAGFLASCFYIHNEPLRGAYYAGLAYNNSQALQLPHPIQKLLKEISEAQADQLYDVALSKSYQLLQTANSSPEYPTLSFLTLLRVIELKELLHQDVSQDFAALKSSPLFHQFERMYSDGEWTLSKRFGKKG

SEQ ID NO: 728 - protein, 289 aa, Chlamydia pneumoniae
GRTPCECFILGDSCRRRGSLVKKIRVHDSGLIDLDDLEKLLNEGAQFVSIPHVSNVTGCVQPLQQVAELVHRYDAYLAVDGAQGAPHLPIDVQLWDVDFYVFSSHKIYGPTGIGVLYGKKDLLDQLPPVEGGGDMVAIYDHQNPEYLPAPMKFEAGTPNIAGVLGLGAALDYLDGLSAKFIYDKEIALTTYLHKELLEIPGVEILGPSIEEPRGALIGMTIDGAHPLDLGFLLDLRGIAVRTGHQCAQPAMERWNVGHVLRVSLGIYNDEDDIDQFILVLQDSLDKIRR

SEQ ID NO: 729 - protein, 137 aa, Chlamydia pneumoniae
SVKNLKEDFPIFAAKAKENEPFIYLDSAATTQKPQQVIDAVANFYTSSYATVNRAIYSSSRNVTEAYAAVREKVRKWVSAASDSEIVFTRGTTAGLNLLAISVNDLWIPKGGVVLVSEAEHHANVLSWEIPVGGEVL

SEQ ID NO: 730 - protein, 410 aa, Chlamydia pneumoniae
RHFLLLLRVLLCKKLRKLATLNIASSLLQKRCLVAFLGFRSFLFFLIANNLATGASELIKQHWLHNNHSLAFECILINGKYEPSLSQLPEGVIVCGIDEARGSLSSFMQGFDVNKHPLAFLNAVCSEDRGVVIYIPEEMQTSDPIFVRHISFPTVSDHDVIFSPRIVVILGQRASAQIQISHDVDLEMVGSSKTIVNGVTELFVGEGADLTVFMVPGYSEEDTLSWSTIATVEKDAICRMTQNLLESCQGFGWFDNTSYIVGKKGHAESLVLVQSPRKTWVNNLMSHDAEETVSRQNIKSILYSGHFLFEGTISISSQGDLSDANQKHDTLLLSSEARVSTFPRLEIETDEVKASHGATVGPLDPQQIFYMRSRGMTEAEAQEKLIHGFLKQGLVSDTFLGSSFQLNQTS

SEQ ID NO: 731 - protein, 256 aa, Chlamydia pneumoniae
  SITE 1...256: Xaa=unknown or other
MLKIKHLHASCNDVKILDDFNLNIQPGXMHVIMGPNGAGKSTLAKILAGDESVLVSSGEIALQEQNLLSMLPEERSRAGLFVGFQMPPEIPGVNNKMFLRDAYNARRRANQEGDISIDEFNTLLSTVLETYEYNATTDLFLDRNVNEGFSGGERKRNEICQMLVLEPEMVLLDEPDSGLDVDALRLICRVLEKYRELHPTSSLCIVTHNPKLGNLIRPDVVHLLLDGRVALSGDVSLMHELEAKSYQEVTKRVAWR

SEQ ID NO: 732 - protein, 484 aa, Chlamydia pneumoniae
MGESVKVFLEEREDYPYGFVTPIESQGLTRGLSEETIEEIAALRNEPQFIIDFRLQAYRYWKQLHEPAWARLHYGPIAYDDIVYFSSPKQKKPLGRLEDADPEILDTFKKLGIPLDEQKRLLNVENVAVDLVFDSVSIGTTFKEALEKAGVIFCSLGEAIQEHPNLVKKYLGSVVSHRDNFFAALNAAVFSDGSFVYVPKGVKCPMDISTYFRINNKEAGQFERTLIVVEDGGYASYLEGCTAPAYSSNQLHAAVVELVAHEHAVIRYSTVQNWYAGDKKTGKGGIYNFVTKRGLCAGYRSKISWSQVEVGAAITWKYPSCILKGDESVGEFYSVALTSGKMQADTGTKMLHVGKRTTSTVISKGISSDESKNTFRSLVSLGKKAEHSSNYTQCDSMLIGKASGAYTDPKIVVENSTSSIEHEATTSKLREDQLLYLRSRGLSPEEAVSLVIHGFCREIIEQLPLEFAQEASKLLLIKLENSVG

SEQ ID NO: 733 - protein, 351 aa, Chlamydia pneumoniae
LRSTNHVLGEISMEEAAKHLAKEFLCSGINLFLSGEYEQAEKRLKETLELDSTAALAYCYLGIIALETGRVSEALNWCSKGLASEPGDSYLRYCYGVALDRGNQYEAAIEQYSAYVALHPDDVECWFSLGSVYHRLKRLQEALDCFDKILALDPWNPQSLYNKAVILSEMDDEAESIRLLEVAVAKNPLYWKAWVKLGFLLSRSKRWDKATEAYERVVQLRPDLSDGHYNLGLCYLTLDKTRLALKAFQEALFLNAEDADAHFYVGLAHLDLKQMREAYEAFNSALSINLEHERAHYLLGYLHHMQGETDKATKELLFLQKKDSTFAPLLQKTVVSDPSSMQFERRLDTIS

SEQ ID NO: 734 - protein, 660 aa, Chlamydia pneumoniae
LPLTFDCFLDFLFPENSVIKLQLKRNSFVGQAIEVQNLVTRLLSLFPYEEGTCPCSAIFDAVFPNEEGHILIQEVISLQEQKWIMECLNQHKADIEELKEALDQVFNELPANYDKILYTDILRLIVDPERFSPVLPSEVHRLSLSEFTELQGRYVVLRSAFSTILEDAFIEVHFKSWRKSEFLQYLAAKRQEEALRKQRYPTPYVDYLEEEKTRQYKMFCQEHLDTFLAYLFSKTPYKEGLEPYYDILDLWINELDNGAHRALSWNEHYLFLKERVSHLSEHLPALFSTFREFNELQRPLLGKYPISIVRNKRQTEQDLAASFYPVYGYGYLRPHAYGQAATLGSIFKLVSAYSVLSQRILWGHNEEPANPLVIIDKNSFGYRSSKPHVGFFKDGTPIPTFFRGGSLPGNDFMGRGFIDLVSALEMSSNPYFSLLVGEGLGDPEDLADAASLFGFGEKTGLGLPGEYAGRVPHDLAYNRSGLYATAIGQHTLVVTPLQTAVMLASLVNGGVVYVPKLLLGEWEGEHVSYLSSKKKRTIFMPDAVVEVLKTGMRNVIWGQYGTARAIQSQFPPQLLSRIIGKTSTAESIMRVGLDREYGTMKMKDIWFAAVGFSDQDLSLPTIVVIVYLRLGEFGRDAAPMAVKMIDMWEKIQQRESFLRG

SEQ ID NO: 735 - protein, 139 aa, Chlamydia pneumoniae
EKWVLRHCWDSKLRGKIGKKPILVDRRGNFIQEMEGAVPEAPGTKLQLTLSAELQAYADALLLEYEKTETFRSAKSLKKREKLPPLFPWIKGGAIIALDPNNGEILAMASSPRYRNNDFVNAKVAEDSKAVRSSIYLDG

SEQ ID NO: 736 - protein, 286 aa, Chlamydia pneumoniae
FSDESEAHNIHSMKRPKKFPIYLSIAQKTNRLLSGIVIAFAVIALRLWYLAVVEHEQKLEEAYKPQIRVLPQYVERATICDRFGKTLAVNQLQYDVSVAYGAIRDLPTRAWRVDEHGHKQLIPVRKHYIMCLSELLSQELHLDREAIEDAIHAKASVLGSVPYLVAANVSERTYLKLKMLSKDWPGLHVEAVVRRHYPQESVASDILGYVGPISLQEYKRVTQELSQLRECVRAYEEGEDPKLPEGLASIDQVRALLESVESNAYSLNALVGKMGVEALLGLKITR

SEQ ID NO: 737 - protein, 391 aa, Chlamydia pneumoniae
  SITE 1...391: Xaa=unknown or other
VSMKKLLKSALLSAAFAGSVGSLQALPVGNPSDPSLLIDGTIWEGAAGDPCDPCATWCDAISLRAGFYGDYVFDRILKVDAPKTFSMGAKPTGSAAANYTTAVDRPNPAYNKHLHDAEWFTNAGFIALNIWDRFDVFCTLGASNGYIRGNXYRFNLVGLFGVKGTTVNANXLPNVSLSNGVVELYTDTSFSWSVGARGALWECGCATLGAEFQYAQSKPKVEELNVICNVSQFSVNKPKGYKGVAFPLPTDAGVATATGTKSATINYHEWQVGASLSYRLNSLVPYIGVQWSRATFDADNIRIAQPKLPTAVLNLTAWNPSLLGNATALSTTDSFSDFMQIVSCQINKFKSRKACGVTVGATLVDADKWSLTAEARLINERAAHVSGQFRF

SEQ ID NO: 738 - protein, 292 aa, Chlamydia pneumoniae
MPLLTYSNFEIEVQSLESQSCKLTIKDLMSAGAHFGHQTRRWNPKMKLYIFEEKNGLYIINLAKTLQQLRNALPHIRKVIQDNKTVLFVGTKKQAKCVIREAAIEAGEFFIAERWLGGMLTNMTTIRNSIKTLDKIEKDLSRNQAYLTKKEAALLAKRHQKLLRNLEGIRYMKKAPGLLVVVDPSYEKIAVAEAKKLGIPVLALVDTNCDPTPIDHVIPCNDDSLKSIRLIINVIKENIIEAKHKLGIEIVSPVKSLEVPDLSAFESSQDDESDEENREEDLLAKKFDGEAN

SEQ ID NO: 739 - protein, 282 aa, Chlamydia pneumoniae
MSDFSMETLKTLRQQTGVGLTKCKEALEACGGNLEEAVVYLRKLGLASAGKKEHRETKEGIIAAKTDANGTALIEVNVETDFVANNAVFREFVSNLLNDILKYKVDTVEALSQAASSQDPSLSVDELRAVTMQTVGENIRISRVAYFPKATNSTVGIYSHGNGKTVALTMLSGSSTADSLAKDIAMHVVAAQPQFLSKESVPAEAIAKEKEVIASQIQGKPQEVIEKIVTGKLNTFFQEACLLEQPFIKNADLSIQSLIDDFSKTSGSSVAIEQFILWKIGA

SEQ ID NO: 740 - protein, 248 aa, Chlamydia pneumoniae
MAKQTRRVLFKISGEALSKDSSNRIDEMRLSRLVSELRAVRNNDIEIALVIGGGNILRGLAEQKELQINRVSADQMGMLATLINGMAVADALKAEDIPCLLTSTLSCPQLADLYTPQKSIEALDQGKILICTTGAGSPYLTTDTGAALRACELNVDVLIKATMHVDGVYDKDPRLFPDAVKYDFVSYKDFLSNQLGVMDASAISLCMDSHIPIRVFSFLQHSLEKALFDPTIGTLVSEDVNHVCSPRH

SEQ ID NO: 741 - protein, 180 aa, Chlamydia pneumoniae
MSVLQDTEKKMAAALDFFHKEVKSFRTGKAHPALVETVVVDVYGTTMRLSDIASISVADLRQLVISPYDGNNASAIAKGIIAANLNLQPEVEGSIIRIKVPEPTADYRQEMIKQLRRKCEEAKINVRNIRREANDKLKKDSALTEDVVKGNEKKIQELTDKFCKQLDELTKQKEAEIASI

SEQ ID NO: 742 - protein, 172 aa, Chlamydia pneumoniae
LMVHSPTHQCYHCQQPATICYTEIDKDKVIRSYVCATCPCPSHYYNNEHLSLSKGVGVLTLECGNCKTVWHSKQDDEQLLGCHQCYTNFKNQITSKLKSERVVSSSFTMEKGQGSLHIGRAPGEASNTNPLLKLIALNEALQDTLEREDYEQAAVIRDQINHLKTKNPDDPS

SEQ ID NO: 743 - protein, 358 aa, Chlamydia pneumoniae
MTLPNDLLETLVKRKESPQANKVWPVTTFSLARNLSVSKFLPCLSKEQKLEILQFITSHFNHIEGFGEFIVLPLKDTPLWQKEFLLEHFLLPYDLVGNPEGEALVVSRSGDFLAAINFQDHLVLHGIDFQGNVEKTLDQLVQLDSYLHSKLSFAFSSEFGFLTTNPKNCGTGLKSQCFLHIPALLYSKEFTNLIDEEVEIITSSLLLGVTGFPGNIVVLSNRCSLGLTEELLLSSLRITASKLSVAEVAAKKRLSEENSGDLKNLILRSLGLLTHSCQLELKETLDALSWIQLGIDLGLIKVTENHPLWNPLFWQIRRAHLALQKQAENSRDLQKDTISHLRASVLKELTKGLSPESF

SEQ ID NO: 744 - protein, 561 aa, Chlamydia pneumoniae
SCCGYPSVPSLQRQPSAAVNIIQPLLSHDAIVSASEATRHVIISDIAGNVDKVSDLLAALDCPGTSVDMTEYEVKYANPAALVSYCQDVLGTLAEDDAFQMFIQPGTNKIFVVSSPRLANKAEQLLKSLDVPEMAHTLDDPASTALALGGTGTTSPKSLRFFMYKLKYQNGEVIANALQDIGYNLYVTTAMDEDFINTLNSIQWLEVNNSIVIIGNQGNVDRVIGLLNGLDLPPKQVYIEVLILDTSLEKSWDFGVQWVALGDEQSKVAYASGLLNNTGIATPTKATVPPGTPNPGSIPLPTPGQLTGFSDMLNSSSAFGLGIIGNVLSHKGKSFLTLGGLLSALDQDGDTVIVLNPRIMAQDTQQASFFVGQTVPYQTTNTIIQETGTVTQNIDYEDIGVNLVVTSTVAPNNVVTLQIEQTISELHSASGSLTPVTDKTYAATRLQIPDGCFLVMSGHIRDKTTKVVSGVPLLNSIPLIRGLFSRTIDQRQKRNIMMFIKPKVISSFEEGTRVTNKEGYRYNWEADEGSMQVAPRHAPECQGPPSLQAESDFKIIEIEAQ

SEQ ID NO: 745 - protein, 381 aa, Chlamydia pneumoniae
  SITE 1...381: Xaa=unknown or other
LKKNPVKTVILNIGRKILQGIKKXKKKIGIXSGLFFLDLVLLGVSXQRPTETSANVKHNLRDEKLAACPKNSAASLSAKKSHTKKTTPGSIPSKVFSKFDATQDKTFQKTSGSAFPAKPTTLKELEERKKPRPERRTTADVKRSPRFLPTQEVEEPVPAASKEQLDSIQVWEEKQNYARRAVNAINLSIKKQLEEQTSTVTEKDVQPKTQATPHASKKNVASPSTSMPGIEKAATTVAVPQDKSEEEKVKERLTKRELTCEDLKDNGYTVNFEDISILELLQFVSKISGTNFVFDSNDLQFNVTIVSHDPTSVDDLSTILLQVLKMHDLKVVEQGNNVLIYRNPHLSKLSTVVTDSSLKETCEAVVVTRVFRLYSVSPLQQ

SEQ ID NO: 746 - protein, 94 aa, Chlamydia pneumoniae
FCFSSQTCILSNCSLEAAGTGSSTSCVGKKRGDLFTSAVVLRSGRGFFLSSSSFRVVGFAGNADPEVFWKVLSWVASNLEKTLLGIEPGVVFLV

SEQ ID NO: 747 - protein, 502 aa, Chlamydia pneumoniae
MDCRGGIPLPEPQVIGGYHVKKILSKKLRSRVVHGLHPETRHSTVIKVFSPSPSFTSRSVYNFLKEAQSLHQITHPNIVKFHRYGKWQDCLYIAMEYIEGISLREYILAQFISLPQAIDIIFDIAQALEHLHSRNILHKDIKPENILITPQGKIKLIDFGLADWDTEIQRAHPSVIGTPYYMSPEQRQGESHSPASDIYALGLLAYELILGHLSLGRVFLSLVPERISKILAKALQPSPNNRYSSTREFIQDIHHYRMSGDMQEDLRIKDHTVALYEQLQTQRFWLAPETLRFPDFISGVLYHQGYPLYPHAYDTLLEGDVFNLWLGYSPISNATIALSVVKSLVCQQDLQRPLLDRVCEINECLIRMKIPIDEMGISILCLEISKENKELSWIACGKTVFWIKRQGRVVQDFESFSPGLGKITSLQIRETKVAWEIGDEAVVCTLELEESVASLKTLSLAELQDRRQKAIFCPIESIHGGIQSRQHGSNSPSTLISLKRIR

SEQ ID NO: 748 - protein, 374 aa, Chlamydia pneumoniae
RYFMAVAADSSASWLKSRNNFLSSLGKTEEQVAAPEFPKELCQHKIREKFRLEDVQVSIKFRGSITAVEATKEFGVHLLIQPMVVQPWEVENLLFLTSEEDLQELMVAVFDDASLASYFYEKDKLLGFHYYFVAEACKLFEELQWVPSLSAKVGGDAIFTATSLQGSFQVVDISLRLDGKNVRCRLLLPEDTFQSCQKFFSGLHDESDLHNIDQTQQISLSVEVGYSQLTQEEWHQVVPGSFIMLDSCLYDPETEESGALLTVQKHQFFGGRFLTPSSGEFKITSYPNLTHEDPPLPENPQASAAPLPGYSRLVVEVARYSLAVSEFIKLNLGSILSLGNHPAYGVDIILDGAKVGRGEIIALGDVLGIRVLEV

SEQ ID NO: 749 - protein, 281 aa, Chlamydia pneumoniae
FMELKKTAESLYSAKTDNHTVYQNSPEPRDSRDVKVFSLEGKQTRQEKTTSSKGNTRTESRKFADEEKRVDDEIAEVGSKEEEQESQEFCLAENAFAGMSLIDIAAAGSAEAVVEVAPIAVSSIDTQWIENIILSTVESMVISEINGEQLVELVLDASSSVPEAFVGANLTLVQSGQDLSVKFSSFVDATQMAEAADLVTNNPSQLSSLVSALKGHQLTLKEFSVGNLLVQLPKIEEVQTPLHMIASTIRHREEKDQRDQNQKQKQDDKEQDSYKIEEARL

SEQ ID NO: 750 - protein, 174 aa, Chlamydia pneumoniae
YAVAKYPLEPVLAIKKDRVDRAEKVVKEKRRLLEIEQEKLREKEAERDKVKNHYMQKIQQLRDLLDEGTTSDAVLQIKSYIKVVAVQLSEEEEKVNKQKEVVLAASKELEKAEVNLAKRRKEEEKTRLHKEEWMKEALKEEVALKKKNKTRWGSCFSNCARKKNVNQGEASSWN

SEQ ID NO: 751 - protein, 442 aa, Chlamydia pneumoniae
MDQLTTDFDTLMSQLGDVNLTTVVGRITEVVGMLIKAVVPNVRVGEVCLVKRNGMEPLVTEVVGFTQSFAFLSPLGELSGVSPSSEVIPTGLPLHIRAGNGLLGRVLNGLGEPIDVETKGPLQNVDQTFPIFRAPPDPLHRAKLRQILSTGVRCIDGMLTVARGQRIGIFAGAGVGKSSLLGMIARNAEEADVNVIALIGERGREVREFIEGDLGEEGMKRSVIVVSTSDQSSQLRLNAAYVGTAIAEYFRDQGKTVVLMMDSVTRFARALREVGLAAGEPPARAGYTPSVFSTLPRLLERSGASDKGTITAFYTVLVAGDDMNEPVADEVKSILDGHIVLSNALAQAYHYPAIDVLASISRLLTAIVPEEQRRIIGKAREVLAKYKANEMLIRIGEYRRGSDREIDFAIDHIDKLNRFLKQDIHEKTNYEEAAQQLRAIFR

SEQ ID NO: 752 - protein, 235 aa, Chlamydia pneumoniae
AFKTVKRFFCFMIDPVECFPNLDGDAEAQSITQNSGTPLASELKKDISPFALGSYAAPKDTTLVQGFKPNPMAMMQDQNSNLIDPELQEALESEELQEQINNLKGRLWDFRSTFEDSQTTAQFADEHFQAVGVIIDLINEDLNTIAEHTQQDARKEDKEEGSVTRKIIDWVSSGEEVLNRALLYFSDRDGNRESLANFLKVQYAVQRATQRAELFASIVGTSVSSVKTIMTTQLG

SEQ ID NO: 753 - protein, 91 aa, Chlamydia pneumoniae
RSRGEKSMATNKSCTAFDFNKMLDGVCTYVKGVQQYLTELETSTQGTVDLGTMFNLQFRMQILSQYMESVSNILTAVNTEMITMARAVKGS

SEQ ID NO: 754 - protein, 102 aa, Chlamydia pneumoniae
TTINNQVLGFINYLYLGRYSMFNMENTAKEEKNSQPLLDLEQDMQDHDRAQELKASVQDKVHKLHALLREGSDKESFGQQQSLLAGYVALQKVLGRINRKMI

SEQ ID NO: 755 - protein, 440 aa, Chlamydia pneumoniae
  SITE 1...440: Xaa=unknown or other
PELIFGAEFHLDSGKTYILGTDPTTCDIVFNDLSVSHQHAKITVGNDGGILIEDLDSKNGVIVEGRKIDKTSTLSSNQVVALGTTLFLLIDHHAPADTIVASLSPDDYSLFGRQQDAEALERQEAQEEEEKQKRATLPAGSFILTLFVGGLAILFGIGTASLFHTKEVVPLENIDYQEDLAQVINQFPTVRYTFNKTNSQLFLIGHVKNSTDKSELLYKVDALSFVKSVDDNVIDDEAVWQEMNILLSKRPEFKGISMHSPEPGKFIITGYVKTEEQAACLVDYLNIHFNSLSLLENKVVVXTXMLKAIAGHLLQGGFANIHVAFVNGEVILTGYVNNDDAEKFRAVVQELSGIPGVRLVKNFAVLLPAEEGIIDLNLRYPNRYRVTGYSRYGEISINVVVNGRILTRGDVIDGMTVTSIQPNAIFLEKXGLKYKIDYNK

SEQ ID NO: 756 - protein, 202 aa, Chlamydia pneumoniae
RTSPRQDPQPKSAEPSLKNTARDETPLKENKPVEEKANKKATPDSPEKKDQPEEGSKKEGSKIEATPLDSQKESEDKEAEEAFVQEEEENLTEDNKEDSDSAADANDDTASDHTAEDNKETPKKVENEKSAVLSPFHVQDLFRFDQTIFPAEIDDIAKKNISVDLTQPSRFLLKVLAGANIWSRVPFRLRKNLYFRYGSYNL

SEQ ID NO: 757 - protein, 255 aa, Chlamydia pneumoniae
MAVRLIVDEGPLSGVIFVLEDGISWSIGRDSSANDIPIEDPKLGASQAIINKTDGSYYITNLDDTIPIVVNGVAIQETTQLKNEDTILLGSNQYSFLSDEFDPQDLVYDFDIPEENFSNDSGDLSDSNEQGKDLEPRQTSETNHSPKPKEKLTKDQGSSDPITSGDQELADAFLASAKAEKNQPRAKVAKKGLKESSNESLNPKEQNAKDSPKGEERTNKPQNAIMEDNGLRLGKIRNQSQQNPLLKTQPGMRLP

SEQ ID NO: 758 - protein, 162 aa, Chlamydia pneumoniae
LDLKEEKAGFRNEIVSIPQGTKTTIAALENTSMLEKLIKNFATYMGITSTLELDADGAYVLPISEVVKVRAQQNADNEIVLSASLGALPPSADTAKLYLQMMIGNLFGRETGGSALGLDSEGNVVMVRRFSGDTTYDDFVRHVESFMNFSETWLSDLGLGKQ

SEQ ID NO: 759 - protein, 341 aa, Chlamydia pneumoniae
VLMVLGVVGISYREAALKERERAIQYLQSFEKNLFLAQRFLGKGGAFIPLLTCHRAELYYYSESPEIAQAALLSELTSQGIRPYRHRGLSCFTHLFQVTSGIDSLIFGETEIQGQVKRAYLKGSKERELPFDLHFLFQKALKEGKEYRSRIGFPDHQVTIESVVQEILLSYDKSIYTNFLFVGYSDINRKVAAYLYQHGYHRITFCSRQQVTAPYRTLSRETLSFRQPYDVIFFGSSESASQFSDLSCESLASIPKRIVFDFNVPRTFLWKETPTGFVYLDIDFISECVQKRLQCTKEGVNKAKLLLTCAAKKQWEIYEKKSSHITQRQISSPRIPSVLSY

SEQ ID NO: 760 - protein, 426 aa, Chlamydia pneumoniae
MAAYTEASILSLASLDHIRLRAGMYIGRLGNGSQKEDGIYTLFKEVVDNGIDEFIMGHGKSLKISASDKQISIQDQGRGIPLGKLIDCVSKINTGAKYTQDVFHFSVGLNGVGLKAVNALSEIFSVRSVRKKKYHLATFHRGVLQESKQGSTKDPDGTFVSFTPDPSIFPEFTFNHDFLKDKIRQYTYLHSGLEIRFNDEVFISHNGLKDLFDAEITEPPLYSPLFFQNEDLTFIFSHLEGNTERYFSFVNGQETLDGGTHLTAFKEAIVKGVNEFFGKTFVSNDIREGIVGCIAIKIASPIFESQTKNKLGNTQIRSSLIKDVKEAIVQALRKDKVAPELLLEKIKFNEKTRKNIQFIKQDLKSKQKKVHYKIPKLRDCKFHYNDRSLYGEASSIFLTEGSLRPHQFLLQEIPSHKLSFHFEESL

SEQ ID NO: 761 - protein, 125 aa, Chlamydia pneumoniae
WTFFCLLLRSCFINWIFFRVFSLNFIFSKRSSGATLSLRRACTIASFTSLIKEDRICVFPSLFFVCDSKIGEAIFIAMQPTMPSRMSLETNVFPKNSLTPFTMASLKAVRCVPPSRVSCPLTKEK

SEQ ID NO: 762 - protein, 210 aa, Chlamydia pneumoniae
GLFDFPYRRESASASILASRNPLTQAVFSLRGKPMNVFSLEETKMYKNDELFYLATALGITQNEIQHLRYNKVILATDADVDGMHIRNLLITFFLKTLLPLVENNHLFILETPLFKVRNKTTTLYYYSEQEKMQALQQFGKKDSSLEITRFKGLGEISPKEFAAFIGPEIRLTPVTITSLESISSILQFYMGKNTKERKQFIMDNLITDF

SEQ ID NO: 763 - protein, 479 aa, Chlamydia pneumoniae
FMRDVSELFRTHFMHYASYVILERAIPHILDGLKPVQRRLLWTLFLMDDGKMHKVANIAGRTMALHPHGDAPIVEALVVLANKGYLIDTQGNFGNPLTGDPHAAARYIEARLSPLARETLFNTDLIAFHDSYDGREKEPDILPAKLPVLLLHGVDGIAVGMTTKIFPHNFAELLKAQIAILNDKKFTVFPDFPSGGLMDPSEYQDGLGSITLRASIDIINDKTLVVKQICPQSTTETLIRSIENAAKRGTIKIDTIQDFSTDVPHIEIKLPKGSRAKEMLPLLFEHTECQVILYSKPTVIYENKPVECSISEILKLHTTALQGYLEKELLLLQEQLTLDHYHKTLEYIFIKHKLYDSVREVLAINKKISADDLHQAVLHALEPWLHELATPVTKQDTSQLASLTIKKILCFNEEACTKELLAIEKKQAAIQKDLGRIKEVTVKYLKGLLERHGHLGERKTQITNFKTAKTSILKQQTLI

SEQ ID NO: 764 - protein, 109 aa, Chlamydia pneumoniae
RAVMSFTYFLALPVDRLMQERFLCSPKRWAPFINSPLYLTLIADHDTPYLAKNLDKFPLPVEQWEKTVLHVSSLLKSIFLCSDLSSLRLLACTKFEILTLNDLYCAQNI

SEQ ID NO: 765 - protein, 325 aa, Chlamydia pneumoniae
MKTVTSFTVCKENSGRLDKYLTEVHPKYSRAFYQEHILSGLVQINGQINTRVATRLNCGDIVTIDIQEKEELLELLPEAIPLDKVYEDGMILVINKPRDMVVHPAPGHFHGTLVHALLHEIGERLKEEFPEEPWRPGIVHRLDKDTSGLIITAKTRQAKKVFSELFSTKRLKKSYLAVCIGKPRSTTIHTHISRHQNKRKEMTVSSQGKEAVTHCQVLAFNGKLSFVALSPETGRTHQLRVHMKHLGTPILGDPVYGIPSMNSSYGLDKQQLHAYSVDFTHPETRQFCSLKAGLPEDMRSLLIKEFRNETTILNKNLLESILKEQ

SEQ ID NO: 766 - protein, 82 aa, Chlamydia pneumoniae
LRITMKEFLAYIIKNLVDRPEEVRIKEVQGTHTIIYELSVAKPDIGKIIGKEGRTIKAIRTLLVSVASRNNVRVSLEIMEEK

SEQ ID NO: 767 - protein, 273 aa, Chlamydia pneumoniae
  SITE 1...273: Xaa=unknown or other
KRMVMFNNKMILIAGPCVIEGEDITLEIAGKLQSILAPYSDRIQWFFKSSYDKANRSSLNSFRGPGLTEGLRILAKVKETFGVGILTDVHTPQDAYAAAEVCNILQVPAFLCXQTDLLVATAETGAIVNLKKGQFLSPWDMEGPINKVLSTGNNKILLTERGCSFGYNNLVSDMRSIPVLSRSGFPVIFDATHSVQLPGALSTESGGLTEFVPTLSRAALAAGAHGLFIETHTNPKIAKSDAASMLSLEEFAALLPTWDQLFTCVSSFDMVSA

SEQ ID NO: 768 - protein, 162 aa, Chlamydia pneumoniae
MTKFLYCGLFYSLGLLVLAFGTMVAIIQVDQICDVSCMNKHFQESPPFLKIKKVNVSKQICSPEERFFHCKIDKSCMELHFPQSSYSCKEYLTRISGHILTQNFEKQMQFRGNSGLLNYQDGSLHVYDCRFQVDPVPGYGSPDKEDSSSGGMKTLYLSLFRN

SEQ ID NO: 769 - protein, 240 aa, Chlamydia pneumoniae
MPILSVCNLVKKYNKKPVTNDVSFQINPGEIVGLLGPNGAGKTTAFYLTVGLIRPDSGKIIFKNVDVTKKTMDHRARLGIGYLAQEPTIFKELTVQDNLICILEIIYKARKQQSHLLNTLVDDLQLGSCLHKKAGTLSGGERRRLEIACVLALNPSVLLLDEPFANVDPLVIQNVKYLIKILAGRGIGILITDHNAKELLSIADRCYLIIDGKIFFEGSSSQMISNPMVKQHYLGDSFSY

SEQ ID NO: 770 - protein, 299 aa, Chlamydia pneumoniae
RTSTRLDYRSGCILSKILPFPELWKMLLGFLCDCPCASWQCAAVANCYDSVFMSRPEHKPNIPYITKATRRGLRMKTLAYLASLKDARQLAYDFLKDPGSLARLAKALIAPKEALQEGNLFFYGCSNIEDILEEMRRPHRILLLGFSYCQKPKACPEGRFNDACRYDPSHPTCASCSIGTMMRLNARRYTTVIIPTFIDIAKHLHTLKKRYPGYQILFAVTACELSLKMFGDYASVMNLKGVGIRLTGRICNTFKAFKLAERGVKPGVTILEEDGFEVLARILTEYSSAPFPRDFCEIH

SEQ ID NO: 771 - protein, 438 aa, Chlamydia pneumoniae
VYKSLVTFKCGEHLGAIWAYFTASTVVALNPTATMDHVKAAILEEAKELDNSSFQLASSIKSAMTSIVNSSGSFSVTVNSSTLQYTIYSEKNGKVEINQILLNYGSTGFLPEITKLAKTNAESTARSYFRFKALAAVESENVQNKIEDLQSQLQQFTNMKTELFDGQLLSQASELRALPLLSAVASVLIDRYMPKEVDYLNEIYKKLYYSNLGSSVGNSIIDAISQYVNGATYFNFASYVGQQPAVGAGGANAFPGSQESAQAKLDQERKQAALYLQETRGALTVIEEQRARVLKDDKITNEQRSTILDSLRNYEDNINSISGSLVLLQNYLQPLSIAGGSVAGTFEVKEGQEQWQARLQILEEALVSGLVGNMINGGMFPLQSTIQSDQQSFADMGQNFQLDLQMHLTSMQQEWTVVATSLQLLNQMYLSLARSLTG

SEQ ID NO: 772 - protein, 422 aa, Chlamydia pneumoniae
ADIDMIYSTSISTFYKKLSLVSSMHSFAQRHRESLEHIANYEKTTAERDILKRLIEVLDQRASERYRSAVEKLHKYEVERATVAKSIPVAAIHEKPLSSTHASVQVTASTPAATGSGVGAYYNAVKQKWAQDLIVELNTVMTTIMASVNSKNPANKDVFDKLNTELQALVAAGNNLTEENFQTLYNFPEEIFTAIQRADTFTGGMKTDFTNQLAGKYGNQATLTQTFADGRVEGFKDILTAVQGVLTPEQFTIFAEIATELQALADHVGNFDEAGLQRIEDAGEKLAAVINSSDLTRNDKIMFCQHITDLYSDQVAALGSFDTVLDASIYVNQHQGTMFSNLSSFVGSLIGTFAPIDLSSSQGDISSAALAGALQTARGLNSRFNELTAEQQKLINECINLWLPLSVVSTLVLSGLILQHLL

SEQ ID NO: 773 - protein, 645 aa, Chlamydia pneumoniae
  SITE 1...645: Xaa=unknown or other
KYYLFSMSTFSIQNRLRTISGESTRIIKLDHKYSGFDPRSVPAINLEELNSGIYALRHLMNALQSENTNVAALLNPNNTIFPTTSWTDYKHSRPQASSPRAPSSQTPTDIVSAAALALVLVIDGGLAELVASVTEIDLGALSTISTVRQLMASYLGLTTLTAEQEKVVFSSSYVPSEKNLLEHVKQEKAAEIQAKQEEIKAVLEAKGVSTEEIEAILKEYPDIYAADFFKEFIEEPLHTYRAKVGAPIQEMNENAIQLLPTPPAITPDNVNEVNGMNTLSTILQAIDDAIKQAPALGGDQEIITILQTLVPLVDKTTFTKAEFDLIYTATQLPNTASLKLYLTDRQIAEYRGKITKVYQNSIQNLSETKRVVENNRSMLETQLSMFQQAQNCFVTWISQANALNIAITNKYISAVLTTSMEMYGGLLCLSYMYERLADDEKAIFDKSVNEYLPIHIVVGGSWVNGWIAKMAAYQELAEYSLGTAVTSQDQIKAYLQTRGNEFKATRHFFHNIGDQMYQFANETVFGNCLTTANGAIQPDLGGFIREAMTNVGTVEADYVSNAQRILNEFNTAATAHVLQLQLQIAELQKKADDLDPGKASFTENRKFAVAALDHIGELRRCFNFYDFXLSATKARGFFKTFDRRN

SEQ ID NO: 774 - protein, 284 aa, Chlamydia pneumoniae
  SITE 1...284: Xaa=unknown or other
TQEKPLSLRTVNLLLPLWITSESLGDALISMIXNSQLPKQEAFLKPLIEEINFNNLAANALNSLLQITNEFSTTSVYYSLSSYLVQSKTGQNLFAGDYYETLLAAAREREYIYRDTARCKQAINLVNGLLQKINSLPGATSAQKQEMLNATTYYQYSLSVTLNQLTVLESLLAGLKMTLQTTSNNKYDKSVFKIESFDDWIPTLAALESFLTSGFPNISATGGLGPLFTQVQSDQQTYTSQGQTQQLNLQNQMTTIQQEWTLVSTSMQVLNGILSQLAGAIYSN

SEQ ID NO: 775 - protein, 212 aa, Chlamydia pneumoniae
DRSLLLLFVSAGVPPAAASSIGSSVNQLYKTSKSTGSDYKTQISAGYDAYKSINDAYGRARNDATRDVINNVSTPALTRSVPRARTEARGPEKTDQALARVISGNSRTLGDVYSQVSALQSVMQIIQSNPQANNEEIRQKLTSAVTKPPQFGYPYVQLSNDSTQKFIAKLESLFAEGSRTAAEIKALSFETNSLFIQQVLVNIGSLYSGYLQ

SEQ ID NO: 776 - protein, 478 aa, Chlamydia pneumoniae
VFMVNPIGPGPIDETERTPPADLSAQGLEASAANKSAEAQRIAGAEAKPKESKTDSVERWSILRSAVNALMSLADKLGIASSNSSSSTSRSADVDSTTATAPTPPPPTFDDYKTQAQTAYDTIFTSTSLADIQAALVSLQDAVTNIKDTAATDEETAIAAEWETKNADAVKVGAQITELAKYASDNQAILDSLGKLTSFDLLQAALLQSVANNNKAAELLKEMQDNPVVPGKTPAIAQSLVDQTDATATQIEKDGNAIRDAYFAGQNASGAVENAKSNNSISNIDSAKAAIATAKTQIAEAQKKFPDSPILQEAEQMVIQAEKDLKNIKPADGSDVPNPGTTVGGSKQQGSSIGSIRVSMLLDDAENETASILMSGFRQMIHMFNTENPDSQAAQQELAAQARAAKAAGDDSAAAALADAQKALEAALGKAGQQQGILNALGQIASAAVCERRSSSRCSKFYRVICKPALQDLKIYRF

SEQ ID NO: 777 - protein, 438 aa, Chlamydia pneumoniae
PAWSSVSTLNIDTKDTMKKQVYQWLASVVLLALTISGYAELPLSEQKVKSHTYTTLDEVKDYLSKRGFVETRKQDGVLRIAGDVRARWLYFREDIKNPSDKDKYNPLPVNRYRSEFYLYIDYRAERNWLSSKMNWTAIAGGENTAAGVDINRAFLGYRFYKNPETRTDFFMEIGRSGLGDLFESEVQFQSNFDGLHIYWTRELSKDYPYQVIVHGGPFVVNMTKKHYAWVVEGILNRLPKQFFVKCSVVDWNTFVPSETSTTEKAATNAMKYKYCVWQWLVGKHSQVPWINGQKKPLYLYGAFLMNPLAKATKTTLNGKENLAWFIGGTLGGLRKAGDWSATVRYEYVEALSVPEIDVSGIGRGNLLKFWFAQAIAANYDPKEANGFTNYKGFSALYMYGITDSLSFRAYGAYSKPANDKLGSDFTFRKFDLGIISAF

SEQ ID NO: 778 - protein, 321 aa, Chlamydia pneumoniae
ALLAPLSLGILTSSIFQLNLLSDICLARYVHEIGPLYLMYSLKIYQLPIHLFGFGVFTVLLPAISRCVQREDHERGLKLMKFVLTLTMSVMIIMTAGLLLLALPGVRVLYEHGLFPQSAVYAIVRVLRGYGASIIPMALAPLVSVLFYAQRQYAVPLFIGIGTALANIVLSLVLGRWVLKDVSGISYATSITAWVQLYFLWYYSSKRLPMYSKLLWESIRRSIKVMGTTMLACMITLGLNILTQTTYVIFLNPLTPLAWPLSSITAQAIAFLSESCIFLAFLFGFAKLLRVEDLINLASFEYWRGQRGLLQRQHVMQDTQN

SEQ ID NO: 779 - protein, 225 aa, Chlamydia pneumoniae
MSRKDNEVSLARSIFNILSGTFCSRITGIFREIAMATYFGADPIVAAFWLGFRTVFFLRKILGGLILEQAFIPHFEFLRAQSLDRAAFFFRRFSRLIKGSTIIFTLLIEAVLWVVLQYVEEGTYDMILLTMILLPCGIFLMMYNVNGALLHCENKFFGVGLAPVVVNIIWIFFVIAARHSDPRERIIGLSVALVIGFFFEWLITVPGVWKFLLEAKSPPQEHDSV

SEQ ID NO: 780 - protein, 293 aa, Chlamydia pneumoniae
MKVLPPPSIPLLGAHTSTAGGLKNAIYEGRDIGASTVQIFTANQRQWQRRALKEEVIEDFKAALKETDLSYIMSHAGYLINPGAPDPVILEKSRIGIYQEILDCITLGISFVNFHPGAALKSSKEDCMNKIVSSFSQSAPLFDSSPPLVVLLETTAGQGTLIGSNFEELGYLVQNLKNQIPIGVCVDTCHIFAAGYDITSPQGWEDVLNEFDEYVGLSYLRAFHLNDSMFPLGANKDRHAPLGEGYIGKESFKFLMTDERTRKIPKYLETPGGPENWQKEIGELLKFSKNRDS

SEQ ID NO: 781 - protein, 152 aa, Chlamydia pneumoniae
MARYCGPKNRVARRFGANIFGRSRNPLLKKPHPPGQHGMQRKKKSDYGLQLEEKQKLKACYGMIMEKQLVKAFKEVIHKQGNVAQMFLERFECRLDNMVYRMGFAKTIFAAQQLVAHGHILVNGRRVDRRSFFLRPGMQISLKRKNLNDFSL

SEQ ID NO: 782 - protein, 324 aa, Chlamydia pneumoniae
MEKKYYALAYYYITRVDNPHEEIALHKKFLEDLDVSCRIYISEQGINGQFSGYEPHAELYMQWLKERPNFSKIKFKIHHIKENIFPRITVKYRKELAALGCEVDLSKQAKHISPQEWHEKLQENRCLILDVRNNYEWKIGHFDNATLPDIQTFREFPEYAEKLAQECDPETTPVMMYCTGGIRCELYSPVLLEKGFKEVYQLDGGVIAYGQQVGTGKWLGKLFVFDDRLAIPIDESDPDVAPIAECCHCQTPSDAYYNCANTDCNALFLCCDECIHQHQGCCGEECSQSPRVRKFDSSRGNKPFRRAHLCEISENSESASCCLI

SEQ ID NO: 783 - protein, 222 aa, Chlamydia pneumoniae
MLMMLMMIIGITGGSGAGKTTLTQNIKEIFGEDVSVICQDNYYKDRSHYTPEERANLIWDHPDAFDNDLLISDIKRLKNNEIVQAPVFDFVLGNRSKTEIETIYPSKVILVEGILVFENQELRDLMDIRIFVDTDADERILRRMVRDVQEQGDSVDCIMSRYLSMVKPMHEKFIEPTRKYADIIVHGNYRQNVVTNILSQKIKNHLENALESDETYYMVNSK

SEQ ID NO: 784 - protein, 503 aa, Chlamydia pneumoniae
LRLAGSLADRFQKRNIILATRFIEILCTILGTYFFFIQSVVGGYVVLILMACHTTIFGPAKLGILPEMLPSEQLSQANGIMTAATYTGSILGSCLAPLLVDVTHRLGVNSYVWPTLMCVIVSIISTLISFCIRPSNVKNVKQKITLVSFKDLWKVLKDTRMIHYLTVSIFLGSFFLLIGAYTQLEIIPFVEFILKYPKHYGAYLFPIVALGVGTGSYITGKISGKDIKIGYVPLAAIGLALVFMGLYAFACSILFVLFFLLALGFLGGVYQVPLHAYVQYASPEHKRGQILAANNFLDFFGVLVAAGVIRVLGSNLGLSPETSFFYIGWFVLAVSIWTLWIWREHVYRLLLGIILRRQLGYYLKIHQSSSPKCYFVAVQSYREIRRVLAALTKTVRSRVIILDQKLVPGWRAWLLSWCVPTVVSSVRDNDSEAQDAWAVLQANHLKTSLKKFPDVSVVCLGLPKNVERFTSILQEQGIDLHPIQLVQKEGKKRVIYTLVFPHA

SEQ ID NO: 785 - protein, 644 aa, Chlamydia pneumoniae
IHGLKISEIKILLLSSILQTQGDLHYILQLLTHPQLQQPIDQNKVPYLIKKLSSEWGKISSKERASGQQMKALGDLILEEYPFHQEGGRVSQVEVWETTVPLIYFIQERINLYLSSSQHSYEDLFQNVFSCLEKIFVLSPEETSFITTLRNSLFPTFATSSCSLLFFTDFCLDFLLHFHKPSPLYDKPGPYIGSLSSLSLIPKGYVFILGANKTTSSDIFDLLNRTTTHEELAFSSTEDEENFHFLQILVSTKHELHISYISSAAQFNLPSPFLNHIKDTLDLPVETLPTQPYLSAFFKNKACLHTSQEYNYSLAHAFYSKKALLPSLFIPTVKQVNLPQHLSLNEIIKGIFSPLDLFLKTNYNLRISYPEHLKKQQKLFPTKHQIEDFWNECFVDKEHDLIPSISPHAEELFTYYREKTILLRNGLDKDPKHSPYTVTFSSSIFEERPYHESYLFPPLSLSFQGNPVQIHGTIHGVCNEGLYLCSIDPRDSLKKTTRTLGSLPETSSEQKQLLERYVALAVLQMSQHLSSDSALIKLTSFNTKENHHPPFSDPEGYLRKVLEVYHLMSSQPIPLLSPLCWKTLDDEEKFHQAVLSAISEEAKNPSLPIFWQFHNRNIEEILNHVGASERLKILSLFRGPCEAV

SEQ ID NO: 786 - protein, 439 aa, Chlamydia pneumoniae
PVKPFNIFDSNSSIQGKFFLEASAGTGKTFTIEQIVLRALIEGSLTHVEHALAITFTNASTNELKVRIKDNLAQTLRELKAVLNSQPASLPTYLDINCNVKQIYMQVRNALATLDQMSLFTIHGFCNFVLEQYFPKTRLIHKNPALTHSQLVLHHITNYLKQDLWKNVLFQEQFHLLAVRYNVTSKHTSSLVDKLLASYTQPISSYFSSRVERLEQISLWHQQIYNSLLEIPKQVFLDQLTAHISGFKKQPFSILDDLHHFVDLLYTSETHSSLFSFFKIAETFNFKHRLARYKPCAAFTVLENMSWVERTLEFCNLDRIFNTLLVDLQEYLKQNYTPWLSPDESVFALEKLLSSSEAQPVVQALREQYQLVLIDEFQDTDKQQWSIFSNLFISPKFTGSLFLIGDPKQSIYEWRSADLPTYLTAKSSFSEDKQLQLVN

SEQ ID NO: 787 - protein, 489 aa, Chlamydia pneumoniae
LMNFKIQTSNNGASFRISLFLRNLQDRYFLSETPSNLFMNGEVRIFLPILQPNLRFQKTSNYSLSINYRSTPKLMEAINQIFGKISPFLEIPGYLPIEYHALNPQSSETFENPPHAPIHFFFYETIKDQALWIFSEALRLQKEQKIPLGNMVVLVSDSNQAFELISYATIPVSFSKNKSIFHLTETHILTTALLEAILHPENYEKISKILFSSLFGLSLDEVTTKKEDFTIYFQSLHSYISHHGLLATFYRVMTTQGNVLFSSPRGDLIFQEMEKLCGYLDTISSYPYHQLLHLKNFSETGRWEEELAISSYSEDLETLKITTIHSSKGLEYDIVFCPGIEKSKKNKSSSELLREMYVACTRAKKQLYLPISTQPPSLQRSSALTNYVKLEGTQSSAYDLAIHLHQEHPDLFSYSLPKDHGHATTVLNLPLLETFALKVTPPKTIFSFSSTKFLLDTHKDSQSIPYSNSRFQNNSFLWEKKQEFLYTKF

SEQ ID NO: 788 - protein, 260 aa, Chlamydia pneumoniae
GPWTCYHSVESATFRDVRSKSDTPENYFFLLIYKIPIGHSQRLAIDPIFQLPISKQQLPLGEKTGILIHKILESIQFSLLQDTEYLMSTIMRFIKHTHLEGFEETILKLLSKTFFSPLTFSSQTFSLSQVLPNKIFRETSFLFLENQELWQGVIDLFFEHEGKYYIIDWKTSFLGETNSDYSKSNLSIYIKQEKLDYQGRIYVKAVRKFLNQFEIDDDVELGVIFIRGIDTQGNGFFALNSSEDIPNFNPKAIQKCQAYH

SEQ ID NO: 789 - protein, 344 aa, Chlamydia pneumoniae
CKVLFKLMSYSLRNKKTKICVYIIIALGILSFRSIPQEVYDKIRSSFVSLHVKFFPKIKQAPSSHLANLELENLVLKERVASLEEKLKLYEVSNHTPPLFPEILTPYFHKLVEGKVVYRDYTHWSSSCWVNVGKTHGIKKNSPVLSGNVLVGLVDYVGEHQSRIRLITDVGMKPSVVAMRGDIQSWWIKHSLRELIRQVEQISHAYILEKDKYEKISQLQELDSLIQGEGENQALLRGILSGVGGALWKEGSLCLEGEGFYFSEGKTLLPGDILVTTGLDGVFPPGLLVARVTKVKAPRDGACTFKIEAQSLEEKLMELDQLFILPPLEFNPNDRPDIFGLLWD

SEQ ID NO: 790 - protein, 395 aa, Chlamydia pneumoniae
MSFFNHIPTFSPDAILGLQNVFFADKRPEKVNLVIGVYEHPQKRYGGLSCIRKAQTVILEEEQNKSYLPISGLQIFLDEMRELVFGAVDPSAIVGFQSLGGTGALHLGARLLSVAKGSGKVYVPEQTWSNHIRIFSQEGLEVIRYPYYSKEQKQLLFEPLIAFLKEVEKNSVILLHGCCHNPTGVDFTEDMWKELAILMKERELIPFFDTAYQGFAHGIELDRKPIEIFISEGNTVLVAASSSKNFALYGERVGYFAVHSTFTDELVKIHSFLEEKIRGEYSSPQRWGVEIVSTILSNPYLKEEWQSELNFIRESLGKMRTRFVQALRKVAGHTFDFLLSQHGFFAYPGFSDKQVLFLREQHAVYTTAGGRMNLNGITEKNIDHVVQSFIQAYEL

SEQ ID NO: 791 - protein, 733 aa, Chlamydia pneumoniae
EYIFRLKTGDIVDYLEKLQVLIEEGQSANFLSLWEEYCFNDVVRGRELVEILEKVKSSSLASLFGKIVDTVVPLWEKIPEGKDKDRVLQLILDLQTSNSQMFFDIATEYVNKKYSGEENFNEALRVVGLRDGRDFQFSLSRFDFLMHMHKGNFVFHQGGWGVGEVMGVSFLQQKVLIEFEGIMSAKDISFETAFKSLTPLSGDHFLSRRFGDPDGFEAFAKENPIEVVEILLRDLGPKTAKEIKDELVDLVIPEADWNRWWQSAKTKIKKGTRIISPDNPKEPYVLSDAGCSHMGQLERKLGLSLNSAEKISLIYHFIRDLHSELKNIEIRKSLVKALQDLDVEEGNKSLILQRELLLSEYLGIKDASIDKEYITSLSEDDTSRLLENMPIVALQKSFLSLVRKYSSFWQQVFMQILLYTTSPTMRDFVYKTIKNDPSSVEVLKKRLLDSAHQPMMFPELFVWFFLKLGNHEDGLFDPEDKEVLRLFLESALNFMYQVASTPHKELGKKLHHYLVGQRYLAVRQMIEGASLPFLKELLLLSTKCPQFSSSDLNVLQSLAEVVQPTLKKHKSNVEEENVLWSTSESFSRMKAKLQSLVGKEMVDNAKEIEDARSLGDLRENSEYKFALEKRARLQEEIRVLSEEINRARILTKDLVFTDKVGVGCKVTLKGDAGEVVEYTILGPWDADPDSCILSLQSKLAQNMLGKKLNDVVILQGKEYKISRIQSIWEEHGA

SEQ ID NO: 792 - protein, 149 aa, Chlamydia pneumoniae
TKMMVIVMNSKSAQKIIDSIKQILTIYNIDFDPSFGSSLSSDSDADYEYLITKTQEKIQELDKRAQEILTQTGMSKEQMEVFANNPDNFSPEEWLALEKVRSSCDEYRKETENLINEITLDLHPTKESKRPKQKLSSTKKNKKKNWIPL

SEQ ID NO: 793 - protein, 469 aa, Chlamydia pneumoniae
IFMKITVNRGLDLSLQGSPKESGFYNKIDPEFVSIDLRPFQPLSLKLKVEQGDAVCSGAPIAEYKHFPNTYITSHVSGVVTAIRRGNKRSLLDVIIKKTPGPTSTEYTYDLQTLSRSDLSEIFKENGLFALIKQRPFDIPAIPTQTPRDVFINLADNRPFTPSPEKHLALFSSREEGFYVFVVGVRAIAKLFGLRPHIVFRDRLTLPTQELKTIAHLHTVSGPFPSGSPSIHIHSVAPITNEKEVVFTLSFQDVLTIGHLFLKGRILHEQVTALAGTALKSSLRRYVITTKGASFSSLINLNDISDNDTLISGDPLTGRLCKKEEEPFLGFRDHSISVLHNPTKRELFSFLRIGFNKPTFTKTYLSGFFKKKRTYTNPDTNLHGETRPIIDTDIYDKVMPMRIPVVPLIKAVITKNFDLANELGFLEVCGEDFALPTLIDPSKTEMLTIVKESLIEYAKESGILTPHQD

SEQ ID NO: 794 - protein, 313 aa, Chlamydia pneumoniae
EMSSLTLSRRPRRNRKTAAIRDLLAETHLSPKDLIAPFFVKYGNNIKEEIPSLPGVFRWSLDLLLKEIERLCTYGLRAVMLFPIIPDDLKDAYGSYSSNPKNILCHSIHEIKNAFPHLCLISDIALDPYTTHGHDGIFLNGEVLNDESVRIFGNIATLHAEMGADIVAPSDMMDGRIGYIRSKLDQSGYSKTSIMSYSVKYASCLYSPFRDALSSHVTSGDKKQYQMNPKNVLEALLESSLDEEEGADILMVKPAGLYLDVIYRIRQNTCLPLAAYQVSGEYAMILSAFQQGWLDKETLFHESLIAIKRLAQI

SEQ ID NO: 795 - protein, 128 aa, Chlamydia pneumoniae
FSGRCPFSFEVFMLGKEEEFTCKQKQCLSHFVTNLTSDVFALKNLPEVVKGALFSKYSRSVLGLRALLLKEFLSNEEDGDVCDEAYDFETDVQKAADFYQRVLDNFGDDSVGELGGAPGYGKCLYFGC

SEQ ID NO: 796 - protein, 431 aa, Chlamydia pneumoniae
ESLAEHLAMENVSILAAKVLEDARIGGSPLEKSTRYVYFDQKVRGEYLYYRDPILMTSAFKDMFLGTCDFLFDTYSALIPQVRAYFEKLYPKDSKTPASAYATSLRAKVLDCIRGLLPAATLTNLGFFGNGRFWQNLIHKLQGHNLAELRRLGDESLTELMKVIPSFVSRAEPHHHHHQAMMQYRRALKEQLKGLAEQATFSEEMSSSPSVQLVYGDPDGIYKVAAGFLFPYSNRSLTDLIDYCKKMPHEDLVQILESSVSARENRRHKSPRGLECVEFGFDILADFGAYRDLQRHRTLTQERQLLSTHHGYNFPVELLDTPMEKSYREAMERANETYNEIVQEFPEEAQYMVPMAYNIRWFFHVNARALQWICELRSQPQGHQNYRTIATGLVREVVKFNPMYELFFKFVDYSDIDLGRLNQEMRKEPTT

SEQ ID NO: 797 - protein, 292 aa, Chlamydia pneumoniae
GTLVLHALDTYRPSIESAIEKALEGFGPIGHPIRSPVEYALQGGGKRLRPGLVCMMAQGLGLNHDVMDSALAVEFVHTSTLIADDLPCMDNDDERRGRPTVHKAFDEATALLASYALIPAAYSHLRLNAKKLKEQGCDPREIDIAYNIIGDITDKNIGCSGVLGGQYDDMFFSNRGQEHVQSIMIKKTGSLFEIACISGWLFGGGDPQFAPIITSFSNNFGLLFQIKDDFSDLQKDSQQIGLNYALLFGEKAALELLARSQNNCLELLDRLSAGGLKNSSEFETIISSLGSF

SEQ ID NO: 798 - protein, 208 aa, Chlamydia pneumoniae
MTYLASSIFSPEDFLYPEIISKAHYTWDILDLMDQMLENHVFSGIHGTVESGVTLKNIEKIEIAEDAYVESGAYIVGPCILGSQTEVRHGAYLRGNVITGSRCVVGHCTEIKNSYLGHHTKAAHFAYLGDSVLSSEVNLGAGVRCANFRLDGRNIYVRSTSDKSKKIDTGRRKLGAFLGKGVAIGCNVVINPGQHILPHTRIRPGQVI

SEQ ID NO: 799 - protein, 241 aa, Chlamydia pneumoniae
NLFCFHMIGDKIILFVTEDLSLSSQLKDLASQRSDYQILVSPVFPTSFESVAIFCEYLLLPEQIFSPGIFPEEDLIVLFDTFQEEAITKVLNQGATGYLLRPITAKVLDAVIRAFLRQHEVLEHSIPDTMTFGDHTFRVLNLVIESPEGSVYLTPSEAGILKKLLINRGHLCLRKNLLAEIKGNTKEIIARNVDVHIASLRKKLGPYGSKIVTIRGVGYLFSDADSIPLQNHDNTAHPIEE

SEQ ID NO: 800 - protein, 609 aa, Chlamydia pneumoniae
MFRCILFGIFLLTCFSSGGVLYYLFCSHDFSIGPKEKSRSVWIEEEKEFTDSVLHHLPSQHQHLHILCFQGFLLQKQQKFSQAEKIFSKVYDEAQDGPFLFKEEILGSRLINSFFLEKTDVMETILCLLNQRCPNSPYYHLFKALVCYKQKLYREVIEQLAYWQEEKTRALAPLLNISIEQLLTDFLLDYISAHSLIEQKMFPEGRVILNRNINRLLKHECEWNAKTYDRIAILLSRSYFLELVESKSADIYFDYYEMVLFYLKKIYILEQCPYAELLPEEELVSLIMEHVFILPKDKLYPLIQLLEMWQKHYVHPNSSLVVQILVDRFSTHMEGAIRFCEALVSFSGLEELHQQIITTFEELLSNKVQQIKTEEAKQCVALLHILDPSISISEKLALSSDTLQNIVSGDDEQHTKLRNYLDLWEAIQSYDIDRQQLVHHLVYGAKDLWKKGGSDEKALNLLQLVLRFTSYDIECESVVFLFIKQAYKQALSSHAIARLLKLEKFISEANIPSIVISEAEKANFLADAEYLFAHEDYDKCYLYSMWLTKVAPSPQSYRLAGLCLMENKRYDEALEFLCMLSPNDSINDYKTQKALAFCQKHQSKDRAAS

SEQ ID NO: 801 - protein, 295 aa, Chlamydia pneumoniae
GWALHTEFAPFLEDLVHQQVISPLDIAFASKHISSDFEESFVFLAVSSALWRYGHPFLSLEENRIRPSLGGISETDLYRGFHNLPKEVRDKLFVVVSGRLYLRSLYTIRSKLLDKLSLLCSATPNYFPPSIDSSILSEEQNFIFNKITQGCFSIVSGGPGTGKTFLAAQLILSLVKQQPKLRIAIVSPTGKATSHIRQILMKYNIFDDMVLMQTVHHFLQEYAYRRYNSIDVLLVDEGSMVTFDLLYSLVQTLQGYEKDKKLYTSSLIILGDTNQLPPIGIGVGNPLQDLIGYFP

SEQ ID NO: 802 - protein, 205 aa, Chlamydia pneumoniae
DISHENTFFLKTSHRAKTGVVDQLTQSVLRGEMISFSPLPSISSAIEVLKNRFVKSLRQSEARLCVLTPMRHGPWGVLNLNTMIHQRLARSDPDLRIPIMVTSRYETWGLFNGDTGLLCLKTQKLHFPQHEPIDSRALSQYVYNYVMSVHKSQGSEYDEVIVIIPKGSEVFGVSILYTAITRAKYRVSVWRDPETLHKTIKKSNY

SEQ ID NO: 803 - protein, 283 aa, Chlamydia pneumoniae
IMATAHLGRQALLHLRSWTPAIRASGNLFRQQSMSLHNNVLFAGDIVGAIKNSTAISRHALGSSHYAHAALQKTEGFLGAADGVNTAVAGAMLWGQLLNGSMIFETDEETGELRRCNEADAEGCMTQKLQRRSALTITGKVARLASKTLGTATFLHEMDVVSLGANANKIGCKVTSCLNLVATGCSLTESSISLYRILSTRPETISDPENRNKPSAEFAARSKAIRNAFIAWLGDVVDLVCDALGTLSLFLPAILGVHAVLIMAILGLISCVINFVKDYAKIG

SEQ ID NO: 804 - protein, 88 aa, Chlamydia pneumoniae
YTKKTSAEKRILTAQKRELINHSFKSKVKTIVKKFEASLKLDDTQATLSNLQSVYSVVDKAVKRGIFKDNKAARIKSKATLKVNARAS

SEQ ID NO: 805 - protein, 407 aa, Chlamydia pneumoniae
YKDLFFMLLVRKWLHTCFKYWIYFLPVVTLLLPLVCYPFLSISQKIYGYFVFTTISSLGWFFALRRRENQLKTAAVQLLQTKIRKLTENNEGLRQIRESLKEHQQESAQLQIQSQKLKNSLFHLQGLLVKTKGEGQKLETLLLHRTEENRCLKMQVDSLIQECGEKTEEVQTLNRELAETLAYQQALNDEYQATFSEQRNMLDKRQIYIGKLENKVQDLMYEIRNLLQLESDIAENIPSQESNAVTGNISLQLSSELKKIAFKAENIEAASSLTASRYLHTDTSVHNYSLECRQLFDSLREENLGMLFVYARQSQRAVFANALFKTWTGYCAEDFLKFGSDIVISGGKQWMEDLHSSREECSGRLVIKTKSRGHLPFRYCLMALNKGPLCYHVLGVLYPLHKEVLQS

SEQ ID NO: 806 - protein, 591 aa, Chlamydia pneumoniae
LTKLSSKARNPLVLFQVRKLFMNTQNSQATEVSSEEESQKKLEELVALAKEQGFITYEEINEILPMSFDTPEQIDQVLIFLTGMDIQVLNQIDVERQKEKKKEAKELEGLARRTEGTPDDPVRMYLKEMGTVPLLTREEEVEISKRIEKAQVQIERIILRFRYSAKEAISIAHYLISGKERFDKIISEKEVEDKTHFLKLLPKLITLLKEEDTYLENLLLSLKQPDLSKQEAAKLNDSLEKCRIRTQAYLRCFHCRHNVTEDFGEVVFKAYDSFLHLEQQINDLKVRAERNKFAAAKLAAAKRKLYKREVAAGRTLEEFKKDVRMLQRWMDKSQEAKKEMVESNLRLVISIAKKYTNRGLSFLDLIQEGNMGLMKAVEKFEYRRGYKFSTYATWWIRQAVTRAIADQARTIRIPVHMIETINKVLRGAKKLMMETGKEPTPEELAEELGLTPDRVREIYKIAQHPISLQAEVGEGSESSFGDFLEDTAVESPAEATGYSMLKDKMKEVLKTLTDRERFVLIHRFGLLDGKPKTLEEVGSAFNVTRERIRQIEAKALRKMRHPIRSKQLRAFLDLLEEEKTGTSKVKSLKSK

SEQ ID NO: 807 - protein, 142 aa, Chlamydia pneumoniae
PCIKNIALVIAIERYQLIISKFRMWLFLGCSVEERHFKQPVLISVTFSYNEVPSACLSDKLSDACCYLEVTSLIEEIANTKPYALIEHLANELFDSLVISFGDKASKIDLEVEKERPPVPNLLNPIKFTISKELCPSPVLSA

SEQ ID NO: 808 - protein, 452 aa, Chlamydia pneumoniae
RAMSEPRFVCLSLGSNLGNRFKNLQIARTLLGEQAVLGLRSSVILETEALLLPGSPPEWDLPYFNSVLVGETTLSLRELLVTIKQIEKVVGRAEESPPWSPRTIDVDILLYGDESFCCDHTEITIPLSNLLSRPFLIALIASLCPYRRFCTQGSPYHNFTFGELAHHLPSPPGMIRRSLSPDTMLMGVVNVTNDSMSDGGMFLDPEKAVAQAEKLFTEGAAVIDFGAQATNPKVKQFLSVDQEWERLEPVLRLLKETWSNRKQYPIISLDTFYPEIILRAMDIYPIQWINDVSGGSQSMAEVARDCELSLVMNHSSSLPVDPKNILSFSVPIGEQLLSWGEKQLKMFSDVGLNANQVIFDPGIGFGKGAAQSLATLYEIAKFKRLGCPILIGHSRKSFLSLFGNHDPKDRDWETVGLSILLQQQGVDYLRVHNVAAHQKALSVAACEACAPI

SEQ ID NO: 809 - protein, 186 aa, Chlamydia pneumoniae
VKPVHPSNFENPLGVEMCKNRGVRGIVACDPRGVIGLEGKLPWHYPEDLQFFSETIQKFPIVMGRKTWETLPRKYFVDRAVVVFSHEKRQGVHGEIWVTSLEEFLLLDLSSPTFLIGGGELYSLFLENQIVRDFFISHIKKEYAGDTFFPLSLLETWTKTVLRDTQKITTCYYENHHSQNTKNISL

SEQ ID NO: 810 - protein, 264 aa, Chlamydia pneumoniae
RHGPKLCLEIPKRSQRVTMKITTVKTPKIYPYDDLYSILESSLPKLNERSIVVITSKIVSLCEGAVVELEKVSKDELIKQEADAYVFVEKYGIYLTKKWGILIPSAGIDESNVEGYFVLYPRDVLLSVNTLGDWLRNFYHLEHCGIIISDSHTTPLRRGTMGLGLCWNGFFPLYNYVGKPDCFGRALKMTYSNLLDGLSAAAVLCMGEGDEQTPIAIIEEAPKITFHSSPTTLQDMSTLAIAEDEDLYGPLLQSMAWETPAPTS

SEQ ID NO: 811 - protein, 226 aa, Chlamydia pneumoniae
GIMTSWIELLDKQIEDQHMLKHEFYQRWSEGKLEKQQLQAYAKDYYLHIKAFPCYLSALHARCDDLQIRRQILENLMDEEAGNPNHIDLWRQFALSLGVSEEELANHEFSQAAQDMVATFRRLCDMPQLAVGLGALYTYEIQIPQVCVEKIRGLKEYFGVSARGYAYFTVHQEADIKHASEEKEMLQTLVGRENPDAVLQGSQEVLDTLWNFLSSFINSTEPCSCK

SEQ ID NO: 812 - protein, 361 aa, Chlamydia pneumoniae
METKRSIYMNLPDRKKALEAAVAYIEKQFGAGSIMSLGRHSATHEISTIKTGALSLDLALGIHGVPKGRVIEIFGPESSGKTTLATHIVANAQKMGGVAAYIDAEHALDPSYASLIGVNIDDLMISQPDCGEDALSIAELLARSGAVDVIVIDSVAALVPKSELEGDIGDVHVGLQARMMSQALRKLTATLSRSQTCAVFINQIREKIGVSFGNPETTTGGRALKFYSSIRLDIRRIGSIKGSDNSDIGNRIKVKVAKNKLAPPFRIAEFDILFNEGISSAGCILDLAVEYNIIEKKGSWFNYQEKKLGQGREFVREELKRNRKLFEEIEKRIYDVIAANKTPSVHANETPQEVPAQTVEA

SEQ ID NO: 813 - protein, 180 aa, Chlamydia pneumoniae
MTDPKIEKSALRKLFISIRRDLSEERKHEASSAVASFVRSFSKESVVLSFVSFNHEIDMQEANRILIQKCTLALPKIDQENLYPVLIPSIDDLISVVHPKDPFSKQTPISSDKITHVLVPGLAFDQQGYRLGYGHGFYDRWLAQHPYPSIRTIGIGYCEQKIDRLPQESHDIPLSQIYLC

SEQ ID NO: 814 - protein, 428 aa, Chlamydia pneumoniae
  SITE 1...428: Xaa=unknown or other
MDIKKLFCLFLCSSLIAMSPIYGKTGDYEKLTLTGINIIDRNGLSETICSKEKLKKYTKVDFLAPQPYQKVMRMYKNKRGDNVSCLTAYHTNGQIKQYLECLNNRAYGRYREWHVNGNIKIQAEVIGGIADLHPSAESGWLFDQTTFAYNDEGILEAAIVYEKGLLEGSSVYYHTNGNIWKECPYHKGVPQGKFLTYTSSGKLLKEQNYQQGKRHGLSIRYSEDSEEDVLAWEEYHEGRLLKAEYLDPQTHEIYATIHEGNGIQAIYGKYAVIETRAFYRGEPYGKVTRFDNSGTQIVQTYNXLQGAKHGEEFSFILRQGNPSCFLNWHEGILNGIVKTWYPGGTLESCKELVNNKKSGLLTIYYPEGQIMATEEYDNDLLIKGEYFRPGDRHPYSKIDRGCGTAVFFSSAGTITKKIPYQDGKPLLN

SEQ ID NO: 815 - protein, 151 aa, Chlamydia pneumoniae
TTIYIKLLGRLMKKWISILILSFLSLLSILPVLAITINHVKISQRWSDLNSQILTLKVIRDHEDQVIKHNARISKDRNNLSIESLNASCKQLRPLSKERERLNKLNSNSLLAQSKEVWERKRALEKSNHQLVWNCEQMHNDFAFCASRASY

SEQ ID NO: 816 - protein, 464 aa, Chlamydia pneumoniae
  SITE 1...464: Xaa=unknown or other
AMNFKLPVYHIGLTKAENNTIKIAILQKTCKGWIVCHCEQIPEGKTWSLPKKYFAAPTTFSLQGSDILVKSSSSSLKNRKNILKVALTNLEASLALPWESLIVQPQLGKPTDRGETPLTLWIAQKNTLKKELSFLSQAQIFPDKLSCRAADIFFLAEQSPLKSLPAYLLIYGGSEEVTCIFVKNHAIAVARSFSNHSTKKSCDDIHATLQYIQETFPQTVLPAIHVAQISPNLQXILEQKLSLPLVVCQSMTYGVEDEDWEIYGDTIAAAHHGASRRPLTFPYDATSVSPAAQKHWLLRSSLLIGKYALMATVVVSLGSVLKLKSLSSSASNHFAFACPEEGVLPRSLKAAEKTVKAIGKKNSASNYPLLPTIPTSEQTLKFLLALGKSSPSIKFSYFSYTMTSYPSKDNPSLPYSALVEVKGQGQPEDIPQFLKKISSHPKLQHVSESLEDQRSFKLQFTLSS

SEQ ID NO: 817 - protein, 130 aa, Chlamydia pneumoniae
MAAPIFIKNILLRSSIVYAPLAGFSDYPYRCMSALYQPGLMFCEMVKVEGILYAPERTSKLLDYNENMRPIGAQLCGSNPETSGEAAKILEGLGFDLIDLNCGCPTDKITKDGSGSGLFEDARAYWEDFR

SEQ ID NO: 818 - protein, 235 aa, Chlamydia pneumoniae
IVDVLQIKSPKMAVGQVFLKTPELIGRILDKIINSVSIPVTVKIRSGWDMEHINVEDTVRIIRDAGASAVFVHGRTRAQGYHGPSKQEYISRAKAAAGKEFPVFGNGDIFSPEAAQAMLTTGCDGVLVARGTLGAPWIGKQIQDYLTTGSYEKIPFIKRKAAFLEHMRLVEDYYQSETKFLSETRKLCGHYLISAAKVRFLRSSLAKATSYQEVYQLVNDYEEADDSSLETFVKC

SEQ ID NO: 819 - protein, 827 aa, Chlamydia pneumoniae
  SITE 1...827: Xaa=unknown or other
MKKSLIIVESPAKIKTLQKLLGSEFVFASSIGHIVDLPAKEFGIDVDHDFEPQYQVLPDKQEVINHIRKLAAKCEKVYLSPDPDREGEAIAWHIANQLPDSPLIQRVSFNAITKNAVTEALKHPRTIDMALVNAQQARRLLDRIVGYKISPILSRKLQQRSGISAGRVQSVALKLVVDREKAIDAFVPVEYWNLRVLMQDPKTTKTFWAHLYAVQGKKWEKEIPEGKTENDVLLINSEEKARHYAELLEKSSYTITRVEAKAKRRFAPPPFITSTLQQEASRHFRFSASRTMSIAQTLYEGVDLDSEDSTGLITYMRTDSVRVDPEALTTVREYIQQTFGKEYLPEKANVYTTKKMTQDAHEAIRPTDINLTPDKLKNKLSDDQFKVYNLIWKRFVASQITPAIYDTLAVQITTDTEIDLRASGSLLKFKGFLAVYEEKQDDENDQEEDHPLPPLHAQDALIKEEVSQEQAFTKPLPRFTEASLVKELEKSGIGRPSTYATIMNKIQSREYTTKENQRLRPTELGKIISQFLETNFPRIMDIGFTALMEDELELIADNKKPWKLLLQEFWTTFLPVVITAEKEAVIPRILTNIECSKCHKGKLVKIWSKNSYFYGCSEYPECDYRTSEEELAFNKEDYAEDTPWDSPCPLCGGVMKVRHGRYGTFLGCEKYPECRGTISIHKKGEEIEQEEPIPCPAIGCNGKIFKKRSRYNKIFYSCSEYPECSVIGNSIDAVITKYSGTEKIPYKKKTPTKKKSSAKTTKAAKTPSKKGKAKSSVKKSSEKKTGPLFLPSPDLAKMIGNEXRISGRSNQKNLGLHQGTSITGTRK

SEQ ID NO: 820 - protein, 270 aa, Chlamydia pneumoniae
KPRTRNVEKLEFVTSLSSPDDDLITFNKQGLIAGPEEEKVAFLVRSNAMLDAGPETPASFPESLREQFDIFPEYVEVLYSNEGLDVWEAGCTWILNNEVTIQLRKHHRKASRWLGMYSRDEVLAHEAVHAVRMKFHEPVFEEVLAYQTSRWGWRRFFGPLFRSPGESYLLLFFTILGLGISLWYPAGILIMLVLPMYFLMRLCMAQSYLYRAMKKIRKMLGVPPLWVLLRLTDKEIKMFAKEPIPVLEHYARKRKLENVRWKQIYQSYFV

SEQ ID NO: 821 - protein, 456 aa, Chlamydia pneumoniae
IFKGNSKRLYDSSALDMFQQKQKLSLKYLPSLRMQQGLQMLQSPLTELSSYVVQEIIDNPFFDLSSLEEEEWSPCYRPTNSTFSYLNQTPGPQESLYTRLLPQIEEAFSTAEERFIAHQIAGNLSDEGLFLRNPEDFAQELELPLEKIHKVWDTIQNLSPEGIASPSLQSYWMKLLRNSSHQQAYSIVRDCYPLMTNCEFAPIMKKFSLSLSELRNILKKALGSIPWCPAAACTVKPMVSTPLPDIYLFYSSGSWKIEVSTRGLPSIKLNKETFHFYEHLPKEEQKNLSQQILSAKWLIKNLRKREQTLLQVMETLLPKQEDFLLGKIPAPYPLGIKDLAEDLSFHESTIFRAIENKAVAAPIGIFPLKHLFPRGIHQDSSHSKENVLQWIRQWIATEQTPLSDSVISDRITAKGIPCARRTVAKYRAQLKILPANKRKKLFYIRSSNSHFRDRQF

SEQ ID NO: 822 - protein, 644 aa, Chlamydia pneumoniae
KLGLIMTCISELNEAQRKAVTAPLNPVLVLAGAGAGKTRVVTYRILHLINQGIAPREILAVTFTNKAARELKERIVNQCASTNEFDVPMVCTFHSLGVFILRRSINLLNRENNFTIYDQSDAEKLIKHALQQHNLKPNLASKIQAHVSQAKNRLLFPEDLDPNDYIDPVVSIYQEYQKKLIEANALDFDDLLFLTVRLLRESPEAQELYNQLWKALLIDEYQDTNHAQYTLMQLLSKQHRNVFAVGDPDQSIYSWRGANIHNILNFENDYPNAKVLCLEENYRSYGNILNAANALIKNNASRLEKELRSVKGPGEKIRLFLGSTDREEADFVAAEILQLHRVGNIKLRDICIFYRTNSQSRTFEDALLRRRIPYEIIGGLSFYKRKEIQDILAFLRIFISKSDIVAFDRTVNLPKRGIGSTTIFALTQYAIAQGLPILKACQQALDTKDVKLSKKQQEGLQEYLALFPQIEHAYNTLSLRDFIESVVRITGYLEILKEDADTFKDRKSNLEELYHKALESEQQNPKTHLELFLDDLALKGSDDDLNLTADRVNLMTLHNGKGLEFRVSFLVGLEEQLLPHANSLGGTYENIEEERRLCYVGITRAQDLLYLTAAQVRSLWGTVRMMKPSRFLKEIPKDYMIQVR

SEQ ID NO: 823 - protein, 236 aa, Chlamydia pneumoniae
MQNATIDQLPVSWQEQLPLCWREQLKEEWSKPYMQQLLIFLKQEYKEHTVYPEENCVFSALRSTPFDQVRVVILGQDPYPGKGQAHGLSFSVPEGQRLPPSLINIFRELKTDLGIENHKGCLQSWANQGILLLNTVLTVRAGEPFSHAGKGWELFTDAIVTKLIQERTHIIFVLWGAAARKKCELLFNSKHQHAVLSSPHPSPLAAHRGFFGCSHFSKINYLLNKLNKPMINWKLP

SEQ ID NO: 824 - protein, 206 aa, Chlamydia pneumoniae
MKIVIASSHGYKIRETKTFLKRLGDFDIFSLSDFPDYKLPQEQEDSITANALTKGIHAANHLGCWVIADDTMLRVPALNGLPGPLSANFAGVGAYDKDHRKKLLDLMSSLESLVDRSAYFECCVVLVSPNQEIFKTYGICEGYISHQEKGSSGFGYDPIFVKYDYKQTFAELSEDVKNQVSHRAKALQKLAPHLQSLFEKHLLTRD

SEQ ID NO: 825 - protein, 424 aa, Chlamydia pneumoniae
LMFFQFLSFTMKKIFYSFVLLSCIFPYVGCAQVFVGLDRIFSEGEYTRCIQGKKIALISHSAAINSRGQDALSVFYSRKHDCTVEILCTLEHGYYGATPTETVGNQPSRYPNLRSVSLYGVKEVPKEVAEHCDVFVYDVQDIGVRSYSFVTVLMQIVKASERYGKQLIVLDRPNPMGGRIVDGPLPNPTTSGSLAIPYCYGMTPGELALFFKKTYAPNANVVVIPMKGWNRSMTFDETGLIWMPTSPQMPDPQSPFFYAATGILGALSVASIGVGYTLPFKVLGAPWMDGEKVADELNRMKLPGVLFLPFFYEPFFGKYKMEMCSGVLLVLQDPKIFYPVETQCTIWGVLKALYPKQVEQTLKSIERIPARRSSICNLFGGDEFLSISHKERYIVWPLRRLCKESRESFHQLRSSCLLSEYAES

SEQ ID NO: 826 - protein, 527 aa, Chlamydia pneumoniae
  SITE 1...527: Xaa=unknown or other
RVVWVFKSQFEGLSALKRGVHALTKAVTPAFGPRGYNVVIKKGKAPIVLTKNGIRIAKEIILQDAFESLGVKLAKEALLKVVEQTGDGSTTALVVIDALFTQGLKGIAAGLDPQEIKAGILLSVEMVYQQLQRQAIELQSPKDVLHVAMVAANHDVTLGTVVATVISQADLKGVFSSKDSGISKTRGLGKRVKSGYLSPYFVTRPETXDVVWEEALVLILSHSLVSLSEELIRYLELISEQNTHPLVIIAEDFDQNVLRTLILNKLRNGLPVCAVKAPGSRELRQVVLEDLAILTGATLIGQESENCEIPVSLDVLGRVKQVMITKETFTFLEGGGDAEIIQARKQELCLAIAGSTSESECQELEERLAIFIGSIPQVQITADTDTEQRERQFQLESALRATKAAMKGGIVPGGGVAFLRAAHAIEVPANLSSGMTFGFETLLQAVRTPLKVLAQNCGRSSEEVIHTILSHENPRFGYNGMTDTFEDLVDAGICDPLIVTTSSLKCAVSVSCLLLTSSFFISSRTKT

SEQ ID NO: 827 - protein, 189 aa, Chlamydia pneumoniae
SLVRNNKRVEEEVFMTLSLVGKEAPDFVAQAVVNGETCTVSLKDYLGKYVVLFFYPKDFTYVCPTELHAFQDALGEFHTRGAEVIGCSVDDIATHQQWLATKKKQGGIEGITYPLLSDEDKVISRSYHVLKPEEELSFRGVFLIDKGEIIRHLVVNDLPLGRSIEEELRTLDALIFFETNGLVCPAKLA

SEQ ID NO: 828 - protein, 136 aa, Chlamydia pneumoniae
  SITE 1...136: Xaa=unknown or other
RFDLIFQMKFTVALFGEAEKGSYDTAYFCRSLVDLHNYLGDVSSPGITLAIKTLLSDYNVVYFRVREEGYCVDSYFFGLHFLNTQTTLKNIIAIGLPGVGNQHIIEASRSLCQKHNSLLLFFDHDLYDLLTFNQPX

SEQ ID NO: 829 - protein, 205 aa, Chlamydia pneumoniae
MHAKLSFFILLSLLFSGIDCSRLHAAGRSPSLQGVLAEIEDISAKLASHEVEIVMLSERLDEQDSKFQKWTAAKPETLAQKIRELESDQKALAKTLAVLTTSVKDLQTNLQSKLQEIQKDHRALAQDLRLVRRSLLALVDSSSPGAYADFSDPVPENIYIVREGDSLSKIAKKYKLSVTELKKINKLDSDAIYAGQRLCLQRNKQ

SEQ ID NO: 830 - protein, 192 aa, Chlamydia pneumoniae
MNIHSLWKLCTLLALLALPACSLSPNYGWEDSCNTCHHTRRKKPSSFGFVPLYTEEDFNPNFTFGEYDSKEEKQYKSSQVAAFRNITFATDSYTIKGEENLAILTNLVHYMKKNPKATLYIEGHTDERGAASYNLALGARRANAIKEHLRKQGISADRLSTISYGKEHPLNSGHNELAWQQNRRTEFKIHAR

SEQ ID NO: 831 - protein, 431 aa, Chlamydia pneumoniae
MLRQLCFQVFFFCFASLVYAEELEVVVRSEHITLPIEVSCQTDTKDPKIQKYLSSLTEIFCKDIALGDCLQPTAASKESSSPLAISLRLHVPQLSVVLLQSSKTPQTLCSFTISQNLSVDRQKIHHAADTVHYALTGIPGISAGKIVFALSSLGKDQKLKQGELWTTDYDGKNLAPLTTECSLSITPKWVGVGSNFPYLYVSYKYGVPKIFLGSLENTEGKKVLPLKGNQLMPTFSPRKKLLAFVADTYGNPDLFIQPFSLTSGPMGRPRRLLNENFGTQGNPSFNPEGSQLVFISNKDGRPRLYIMSLDPEPQAPRLLTKKYRNSSCPAWSPDGKKIAFCSVIKGVRQICIYDLSSGEDYQLTTSPTNKESPSWAIDSRHLVFSAGNAEESELYLISLVTKKTNKIAIGVGEKRFPSWGAFPQQPIKRTL

SEQ ID NO: 832 - protein, 194 aa, Chlamydia pneumoniae
NDTPLCTTQPQKQAKCSPPQENVQKALQKPIPKVIKTEPPKPSPAPTVAKKTTATEKPPPSTTKKNTQLSKTQLQTLSEVAQALSLHVDKIEKSETSLKNISWPSTAQLTMHSELKATQEDELCELFRTHIALPSKGYVRIKLVLSPNGEIQECSFLSEVSAADKQLLTQRIHALPFQKFLEKYKVSKNIIFSY

SEQ ID NO: 833 - protein, 135 aa, Chlamydia pneumoniae
MKYRFTEEIEEEPLVNLTPLIDIVFVILMAFIVAVPLIKLDSIALAPGTQEQEVLSSENDSIAVIKVFADHSLTLNEHPITLQELTVRLTLLHKAYPEKTPLLLQDGETSFRTYQNVKNAIEAAGFHELHVALQN

SEQ ID NO: 834 - protein, 232 aa, Chlamydia pneumoniae
MVHFSHNPIIQAYTEADFFGKSIFFCLLILSVCTWTVLHQKLAIQKNFLKAGKSLKDFLIKNRHAPLSLDIHPELSPFADLYFTIKRGTLELLDKNRQSAPDRGPILSSEDIQSLETLLGAIMPKYKALLHKNSFIPATTISLAPFLGLLGTVWGILVAFTHISSGSSGNSAIMEGLATALGTTIIGLFVAIPSLIAFNYLKAHSSELISEIEQTAYLLLNSIEVKYRNTNL

SEQ ID NO: 835 - protein, 135 aa, Chlamydia pneumoniae
LKAISEGIATKSPIIVVPRAVASPSIMAEFPLLPELMWVKATKIPHTVPKSPRKGAKLIVVAGIKLFLCKRALYFGMMAPRSVSKDWISSEERMGPRSGADCRFLSKSSKVPRFIVKYKSAKGLSSGWISRDRGA

SEQ ID NO: 836 - protein, 676 aa, Chlamydia pneumoniae
  SITE 1...676: Xaa=unknown or other
IIQVQNSFLRVATSLDYRHSDWGSRFTASKGSHIYWKNPGEIGSPLKISWQLPKGFVVEEEHWPTPKVFEEEGTTFFGYEDSALIVADVRAPEGYTPGQEVELRAQVEWLACGDSCLPGNVDLKLTLPYEEKEPSLYPDTHAEFTKTLHAQPRVLENDHSVQVAQGKGNEIILNISKKINATKAWFVSEKADKLFAYAETSYSGGTGTAWRLKVKNLSGVQKNEKLHGILLLADHTGRPVESLTIHSEVLGQTGSAVAGLSQYITILIMAFLGGVLLNIMPCVLPLVTLKVYGLIKSAGEHRSSVIANGLWFTLGVVGCFWGLAGVAFILKVLGHNIGWGFQLQEPMFVATLIIVFFLFALSSLGLFEMGTMFANLGGKLQSSEMKSSNNKAVGAFFNGILATLVTTPCTGPFLGSVLGLVMSLSFLQQLLIFTAIGLGMASPYLVFSVFPKMLSVLPKPGGWMSTFKQLTGFMLLVTVTWLVWIFGSETSTTSVVVLLGGLWLAGLGAWILGRWGTPVSPKKQRVCASLLFFAFLGGAISVSGLASHYFAEPQQTVSVNEDSLWQPFSLEKLAQLRAQGRPVFVNFTAKWCLTCQMNKPVLYGDAVQKMFETHGIVTLEADWTRKDPGITEELARLGRASVPSYVYYPGDNSAPVVLPXKITQNLLEDVVSRFVR

SEQ ID NO: 837 - protein, 261 aa, Chlamydia pneumoniae
VDLADAHVHLSDDAFEEDINSVLQRAQDSGVSLVVNVTTTEKELNRSFAYAERFPKIRFCHVGGTPPQDVDQDIEEDYRNFHAAAHSKKLAAIGEVGLDYCFATEEGIARQKEVLQRYLALSLECELPLVVHCRGAFNDFFRMLDQYYHNDPRSRPGMLHCFTGTLEEAQELISRGWFISISGIVTFKNAQDLRDLVVELPLEHLLIETDAPFLAPVPYRGKKNEPAHVLHTINAVANVKGMFPQELAALAYKNVLRFLHG

SEQ ID NO: 838 - protein, 297 aa, Chlamydia pneumoniae
MSRHEICPEVSHKKGKYYSTFIFRCIHSLAGIAFTFFLCEHLFTNMLASSYFSQGKGFVAMVNGFHKIPGLKIIEVAGLVLPFLCHAIIGIVYLFQGKSNCYSGDGSRPHLRYAKNYSYTWQRWTAWILLFGIAFHVVHLRFIRYPVHVDIHGTTYYAVDIQPSRYDVIVRGTKGFLTLNLPNTEASSIEVSRHDLGGADAALLSERNSYLLTPSAGTAFLYVVRDALGSLFIALLYTILVIAAAFHGFNGLWTFCCRWGVVVSLRMQGVLRIVCYLAMIVVTFMGVSAVWNLYSVA

SEQ ID NO: 839 - protein, 626 aa, Chlamydia pneumoniae
MDENRKVIVVGGGLAGLSAAMQLANLGIIVELVSLTKVKRSHSVCAQGGINAALNLKPEEEDSPYVHAYDTIKGGDFLADQPPVLEMCLAAPRIIKMLDNFGCPFNRGPSGNLDVRRFGGTLYHRTVFCGASTGQQLMYTLDEQVRRREHAGRVIKRENHEFVRLVTDHSGRACGIILMNLFNNRLEILRGDAVIIATGGPGVIFKMSTNSTFCTGAANGRLFLQGMAYANPEFIQIHPTAIPGRDKLRLISESVRGEGGRVWVPGDSSKRIVFPDGSERPCGETGAPWYFLEDMYPAYGNLVSRDVGARAILRVCEAGLGIDGRMEAYLDVTHLPEKTRHKLEVVLDIYKKFTGEDPNTVPMRIFPAVHYSMGGAWVDWPAADDPDRDSRFRQMTNIPGCFNCGESDFQYHGANRLGANSLLSCLFAGLVSGDEASRFIEAFGASQATSSDFDRALQQEKEENARLLSASGKENIFVLHEEIAKIMVRNVTVKRNNRDLQETMDKLKEFRERLKNVSVLDSSPFANKSFHFVRQMGPMLELALAITKGALLRNEFRGSHYKPEFPERDDEHWLKTTVAVYAPEEPEISYLPVDTRHVAPTLRDYTKSSTGKIELTNIPDNIRLPI

SEQ ID NO: 840 - protein, 270 aa, Chlamydia pneumoniae
LIISVYPYRKREMMENLETFILKIYRGVPGKQYWESFELPLHPGENVISALMEIEKRPVNILGEKVNPVVWEQGCLEEVCGSCSILVNGVPRQACTALIQEYIDATQSREIVLAPLTKFPLIRDLIVDRSIMFDNLERIQGWVAADIEGETFGPQVTQEQQELLYALSQCMTCGCCTEACPQIDNKSDFIGPAAISQARYFNTYPGDKQSKKRWRALMGKGGIEGCGQAHNCVRVCPKKLPLTESISAVGREISKFSLRSLFSALFKKKK

SEQ ID NO: 841 - protein, 998 aa, Chlamydia pneumoniae
TCLRSSRKIVVEDISDRNMYSCYSKGISHNYLLHPMSRLDIFVFDSLIANQDQNLLEEIFCSEDTVLFKAYRTTALQSPLAAKNLNIARKVANYILADNGEIDTVKLVEAIHHLSQCTYPLGPHRHNEAQDREHLLKMLKALKENPKLKESIKTLFVPSYSTIQNLIRHTLALNPQTILSTIHVRQAALTALFTYLRQDVGSCFATAPAILIHQEYPERFLKDLNDLISSGKLSRIVNQREIAVPINLSGCIGELFKPLRILDLYPDPLVKLSSSPGLKKAFSAANLIETLGDSEAQIQQLLSHQYLMQKLQNVHETLTANDIIKSTLLHYYQLQESTVRAIFFKEGLFSKEQVAFSTQHPRELSEIQRVYHYLHAYEEAKSAFIHDTQNPLLKAWEYTLATLADASQPTISNHIRLALGWKSEDPHSLVSLVTHFVEEEVENIRILVQQCEQTYHEARSQLEYIEGRMRNPLNNQDSQILTMDHMRFRQELNKALYEWDSAQEKAKKFLHLPEFLLSFYTKQIPLYFRSSYDAFIQEFAHLYANAPAGFRILFTHGRTHPNTWSPIYSINEFIRFLSEFFTSTESELLGKHAVINLEKETSRLVHNITAMLHTDVFQEALLTRILEAYQLPVPPSILNHLDQLSQTPWVYVSGGTVDTLLLDYFESSEPLTLTEKHPENPHELAAFYADALKDLPTGIKSYLEEGSHSLLSSSPTHVFSIIAGSPLFREAWDNDWYSYTWLRDVWVKQHQDFLQDTILPQLSIYAFIENFCNKYALQHVVHDFHDFCSDHSLTLPELYDKGSRFLSSLFTKDKTVALIYIRRLLYLMVREVPYVSEQQLPEVLDNVSSYLGISSRITYEKFRSLIEETIPKMTLLSSADLRHIYKGLLMQSYQKIYTEEDTYLRLTTAMRHHNLAYPAPLLFADSNWPSIYFGFILNPGTTEIDLWKFNYAGLQGQPLDNIQELFATSRPWTLYANPIDYGMPPPPGYRSRLPKEFF

SEQ ID NO: 842 - protein, 616 aa, Chlamydia pneumoniae
RHHLINIKGISIMKHTFTKRVLFFFFLVIPIPLLLNLMVVGFFSFSAAKANLVQVLHTRATNLSIEFEKKLTIHKLFLDRLANTLALKSYASPSAEPYAQAYNEMMALSNTDFSLCLIDPFDGSVRTKNPGDPFIRYLKQHPEMKKKLSAAVGKAFLLTIPGKPLLHYLILVEDVASWDSTTTSGLLVSFYPMSFLQKDLFQSLHITKGNICLVNKYGEVLFCAQDSESSFVFSLDLPNLPQFQARSPSAIEIEKASGILGGENLITVSINKKRYLGLVLNKIPIQGTYTLSLVPVSDLIQSALKVPLNICFFYVLAFLLMWWIFSKINTKLNKPLQELTFCMEAAWRGNHNVRFEPQPYGYEFNELGNIFNCTLLLLLNSIEKADIDYHSGEKLQKELGILSSLQSALLSPDFPTFPKVTFSSQHLRRRQLSGHFNGWTVQDGGDTLLGIIGLAGDIGLPSYLYALSARSLFLAYASSDVSLQKISKDTADSFSKTTEGNEAVVAMTFIKYVEKDRSLELLSLSEGAPTMFLQRGESFVRLPLETHQALQPGDRLICLTGGEDILKYFSQLPIEELLKDPLNPLNTENLIDSLTMMLNNETEHSADGTLTILSFS

SEQ ID NO: 843 - protein, 629 aa, Chlamydia pneumoniae
NNRVPFVVCCAVAIIAPLGINIVWLNLDQYRTIVSAISTALKENAAFKANTLTQIVPLNVDVLSLFSDVLDLDAGIPETPNVLLSNEMQKVFQGIYNEISLIKVFPNGDKIVVASSIPEHLGENYNHKIDIPKNTPFLAALKQSPKNQEVFSVMQANVFDAKTQELQGILYTTFSAESLLKDLLINKQSYLTVKTAILSKYGVILKASDPALHLHTVYPDMTKEKFCQVFLNDDPCPIDSELGPLTLSPLDIGENFYSFKIKDTEIWGCIENVPSIDIAVLSYAKKEESFAPLWRRARMYTAYFFCILLGSLIAFIVARRLSLPIRKLATAMIESRKNKNCLYTDDSLGFEINRLGHIFNAMVENLHKQQHLAKTNFEMKENAQNALHLGEQAQQRLLPNTLPSYPHIELAKAYIPAITVGGDFFDVFVVGEGSKARLFLIVADASGKGVNACGYSLFLKNMLRTFLSRSSSLQQAIQETSRLFYNNTKNSGMFVTLCVYCYHQTSNTMEYYSCGHPPACYLDPDGETSWLFHPGMALGFLPEVANITSKLFHPKPGSLFVLYSDGITEAHNNNNDMFGEERLQAAIQGLTGKSAADAVHRLMLSVKTFVGNSHQHDDITLLILKVLAS

SEQ ID NO: 844 - protein, 195 aa, Chlamydia pneumoniae
KSSKHRSFLLKKSGGNQVSLYQKWWNSQLKKSLCYSTVAALIFMIPSQESFADSLIDLNLGLDPSVECLSGDGAFSVGYFTKAGSTPVEYQPFKYDVSKKTFTILSVETANQSGYAYGISYDGTITVGTCSLGAGKYNGAKWSADGTLTPLTGITGGTSHTEARAISKDTQVIEGFSYDASGQPKAVQWASGGLQ

SEQ ID NO: 845 - protein, 115 aa, Chlamydia pneumoniae
  SITE 1...115: Xaa=unknown or other
CFRATQGCAVGKRRXTVTQLADISGGSRSSYAYAISDDGTIIVGSMESTITRKTTAVKWVNNVPTYLGTLGGDASTGLYISGDGTVIVGAANTATVTNGNQESHAYMYKDNQMKD

SEQ ID NO: 846 - protein, 182 aa, Chlamydia pneumoniae
  SITE 1...182: Xaa=unknown or other
GTLGGANSSATGVSSDGSVIVGQAQTADKSVHAFQYYNGEMKDLGTLGGTSSTAKTVSPDGKVIMGRSQIADGSWHAFMCHTDFSSNNVLFDLDNTYKTLRENGRQLNSIFNLQNMMLQRASDHEFTEFGRSNIALGAGLYVNALQNLPSXLAAQYFGIAYKIRPKYRLGVFLDHNFSSHVS

SEQ ID NO: 847 - protein, 244 aa, Chlamydia pneumoniae
QHNILESHTKYVLNIVWGCFWTIISAPTFPNNFNVSHNRLWMGAFIGWQDSDALGSSVKVSFGYGKQKATITREQLENTEAGSGESHFEGVAAQIEGRYGKSLGGHVRVQPFLGLQFVHITRKEYTENAVQFPVHYDPIDYSTGVVYLGIGSHIALVDSLHVGTRMGMEQNFAAHTDRFSGSIASIGNFVFEKLDVTHTRAFAEMRVNYELPYLQSLNLILRVNQQPLQGVMGFSSDLRYALGF

SEQ ID NO: 848 - protein, 687 aa, Chlamydia pneumoniae
SELYSSYLQPCLNMSIVRNSALPLPCLSRSETFKKVRSHMKFMKVLTPWIYRKDLWVTAFLLTAIPGSFAHTLVDIAGEPRHAAQATGVSGDGKIVIGMKVPDDPFAITVGFQYIDGHLQPLEAVRPQCSVYPNGITPDGTVIVGTNYAIGMGSVAVKWVNGKVSELPMLPDTLDSVASAVSADGRVIGGNRNINLGASVAVKWEDDVITQLPSLPDAMNACVNGISSDGSIIVGTMVDVSWRNTAVQWIGDQLSVIGTLGGTTSVASAISTDGTVIVGGSENADSQTHAYAYKNGVMSDIGTLGGFYSLAHAVSSDGSVIVGVSTNSEHRYHAFQYADGQMVDLGTLGGPESYAQGVSGDGKVIVGRAQVPSGDWHAFLCPFQAPSPAPVHGGSTVVTSQNPRGMVDINATYSSLKNSQQQLQRLLIQHSAKVESVSSGAPSFTSVKGAISKQSPAVQNDVQKGTFLSYRSQVHGNVQNQQLLTGAFMDWKLASAPKCGFKVALHYGSQDALVERAALPYTEQGLGSSVLSGFGGQVQGRYDFNLGETVVLQPFMGIQVLHLSREGYSEKNVRFPVSYDSVAYSAATSFMGAHVFASLSPKMSTAATLGVERDLNSHIDEFKGSVSAMGNFVLENSTVSVLRPFASLAMYYDVRQQQLVTLSVVMNQQPLTGTLSLVSQSSYNLSF

SEQ ID NO: 849 - protein, 228 aa, Chlamydia pneumoniae
VLILTWINVLTKLGLNMSKKIKVLGHLTLCTLFRGVLCAAALSNIGYASTSQESPYQKSIEDWKGYTFTDLELLSKEGWSEAHAISGNGSRIVGASGAGQGSVTAVIWESHLIKHLGTLGGEASSAEGISNDGEVVVGWSDTREGYTHAFVFDGRDMKDLGTLGATYSVARGVSGDGSIIVGVSATARGEDYGMASWCQVGKRENQTIEVVASRSLGLRRMQSLRMVR

SEQ ID NO: 850 - protein, 173 aa, Chlamydia pneumoniae
SCCLKVSGSEANAISEDGTVIVGRGEISRNHIVAVKWNKNAVYSLGTLGGSVASAEAISANGKVIVGWSTTNNGETHAFMHKDETMHDLGTLGGGFSVATGVSADGRAIVGFSAVKTGEIHAFYYAEGEMEDLTTLGGEEARVFDISSEGNDIIGSIKTDAGAERAYLFHIHK

SEQ ID NO: 851 - protein, 349 aa, Chlamydia pneumoniae
VVFEIIFVVRVPMKKTCCQNYRSIGVVFSVVLFVLTTQTLFAGHFIDIGTSGLYSWARGVSGDGRVVVGYEGGNAFKYVDGEKFLLEGLVPRSEALVFKASYDGSVIIGISDQDPSCRAVKWVNGALVDLGIFSEGMQSFAEGVSSDGKTIVGCLYSDDTETNFAVKWDETGMVVLPNLPEDRHSCAWDASEDGSVIVGDAMGSEEIAKAVYWKDGEQHLLSNIPGAKRSSAHAVSKDGSFIVGEFISEENEVHAFVYHNGVIKDIGTLGGDYSVATGVSRDGKVIVGHSTRTDGEYRAFKYVDGRMIDLGTLGGSASFAFGVSDDGKTIVGKFETELGECHAFIYLDD

SEQ ID NO: 852 - protein, 354 aa, Chlamydia pneumoniae
KREENMAAIKQILRSMLSQSSLWMVLFSLYSLSGYCYVITDKPEDDFHSSSAVKWDHWGKTTLSRLSNKKASAKAVSGTGATTVGFIKDTWSRTYAVRWNYWGTKELPTSSWVKKSKATGISSDGSIIAGIVENELSQSFAVTWKNNEMYLLPSTWAVQSKAYGISSDGSVIVGSAKDAWSRTFAVKWTGHEAQVLPVGWAVKSVANSVSANGSIIVGSVQDASGILYAVKWEGNTITHLGTLGGYSAIAKAVSNNGKVIVGRSETYYGEVHAFCHKNGVMSDLGTLGGSYSAAKGVSATGKVIVGMSTTANGKLHAFKYVGGRMIDLGEYSWKEACANAVSIDGEIIVGVQSE

SEQ ID NO: 853 - protein, 452 aa, Chlamydia pneumoniae
MFEAVIADIQAREILDSRGYPTLHVKVTTSTGSVGEARVPSGASTGKKEALEFRDTDSPRYQGKGVLQAVKNVKEILFPLVKGCSVYEQSLIDSLMMDSDGSPNKETLGANAILGVSLATAHAAAATLRRPLYRYLGGCFACSLPCPMMNLINGGMHADNGLGFQEFMIRPIGASSIKEAVNMGADVFHTLKKLLHERGLSTGVGDEGGFAPNLASNEEALELLLLAIEKAGFTPGKDISLALDCAASSFYNVKTGTYDGRHYEEQIAILSNLCDRYPIDSIEDGLAEEDYDGWALLTEVLGEKVQIVGDDLFVTNPELILEGISNGLANSVLIKPNQIGTLTETVYAIKLRKWLAILQLFLIAQEKLRTLRLQILLLPSTLVKSKQALYHVLSVLQNTIDSWKLKKSLDPKQFSQILMYFLTRILRNRGIFSISILSPNQEYIADLWALSF

SEQ ID NO: 854 - protein, 84 aa, Chlamydia pneumoniae
NSVCYQVAQMAGYTTIISHRSGETTDTTIADLAVAFNAGQIKTGSLSRSERVAKYNRLMEIEEELGSEAIFTDSNVFSYEDSEE

SEQ ID NO: 855 - protein, 285 aa, Chlamydia pneumoniae
PFEEAQKYFRKVIYVSATPGDTEVQESSGHIVQQIIRPTGIPDPMPEIRPATGQVDDLLEEIRLRLSQKHEKILVISITKKLAEDMAGFLSELEIPAAYLHSGIETAERTQILTDLRSGVIDVLIGVNLLREGLDLPEVSLVAILDADKEGFLRSTSSLIQFCGRAARNINGKVIFYADQKTRSIEETLRETERRRQIQLDYNKEHNIVPKPIIKAIFANPILQTSKDSESPKESQRPLSKEDLEEQIKKYEALMQRAAKEFRFNEAAKYRDAMQACKEQLLYLF

SEQ ID NO: 856 - protein, 372 aa, Chlamydia pneumoniae
IIFTMTFQLHAPFAPCGDQPEAIARLSAGVRNQVKSQVLLGTTGSGKTFTIANVVANVNLPTLVLAHNKTLAAQLYQEFREFFPNNAVEYFISYYDYYQPEAYIARSDTYIEKSLLINDEIDKLRLSATRSILERRDTLIVSSVSCIYGIGSPENYTSMALVLEVGKEYPRNILTAQLVKMHYQASPIPQRSAFRERGSVIDIFPAYESELALRLEFLNDTLTSIEYSDPLTMIPKESVPSATLYPGSHYVIPEAIREQAIRTIQEELEERMAFFDDRPIEKDRIFHRTTHDIEMIKEIGFCKGIENYSRHFTGAPPGAPPTCLLDYFPEDFLLIIDESHQTLPQIRAMYRGDQSRKQSLVEYGFRFPSGLR

SEQ ID NO: 857 - protein, 344 aa, Chlamydia pneumoniae
MNKKKRVLTGDRPTGKLHLGHWVGSIKNRLELQNSPEYDCFFIIADLHTLTTKIRKEEVLDVDNHIYEVLADWLSVGIDPTKSIIYLQSAIPEIYELHLLFSMLISINRVMGIPSLKDMARNASIEEGSLSYGLIGYPILQSADILLAKAQFVPVGKDNEAHVELTRDIARNFNRLYGQVFPEPEVLQGELTSLVGIDGQGKMSKSANNAIYLSDSDATITEKVRKMYTDPNRIRATTPGRVEGNPLFIYHDIFNPHKDEVEEFKARYRQGCIKDIEVKARLAEELIHFLKPIKERRSEFLSKPLALQNVLEDGTHKMREVAKVTMEEVHDKFGFSHKWRSLLK

SEQ ID NO: 858 - protein, 185 aa, Chlamydia pneumoniae
FMAAKTKTLELEDNVFLLLEGNLKRIFATPIGYTTFREFQNVVFNCANGQQEIANFFFEMLINGKLTQELAPQQKQAAHSLIAEFMMPIRVAKDIHERGEFINFITSDMLTQQERCIFLNRLARVDGQEFLLMTDVQNTCHLIRHLLARLLEAQKNPVGEKNLQEIQEEITSLKNHFDELTKALQ

SEQ ID NO: 859 - protein, 250 aa, Chlamydia pneumoniae
MGNLKTLLESRFKKNTPTKMEALARKRMEGDPSPLAVRLSNPTLSSKEKEQLRHLLQHYNFREQIEEPDLTQLCTLSAEVKQIHHQSVLLHGERITKVRDLLKSYREGAFSSWLLLTYGNRQTPYNFLVYYELFTLLPEPLKIEMEKMPRQAVYTLASRQGPQEKKEEIIRNYRGERKSELLDRIRKEFPLVETDCRKTSPVKQALAMLTKGSQILTKCTSLSSDEQIILEKLIKKLEKVKSNLFPDTKV

SEQ ID NO: 860 - protein, 255 aa, Chlamydia pneumoniae
MKTIAVNSFKGGTAKTSTTLHLGAALAQYHQARVLLIDFDAQANLTSGLGLDPDCYDSLAVVLQGEKEIQEVIRPIQDTQLDLIPADTWLERIEVSGNLAADRYSHERLKYVLGSVQDKYDYVIIDTPPSLCWLTESALIAADYALICATPEFYSVKGLERLAGFIQGISARHPLTILGVALSFWNCRGKNNSAFAELIHKTFPGKLLNTKIRRDITVSEAAIHGKPVFATSPSARASEDYFNLTKELLILLRDI

SEQ ID NO: 861 - protein, 593 aa, Chlamydia pneumoniae
RSFHPPKRRRHLSISDFRRSRRREIFLHTSAHLLAQAVLRLWPDAIPTIGPVIDHGFYYDFANLSISESDFPLIEDTVKQIVDEKLAISRFTYGDKQQALAQFPQNPFKTELIRELPENEEISAYSQGEFFDLCRGPHLPSTAHVKAFKVLRTSAAYWRGDPSRESLVRIYGTSFPTSKELRAHLEQIEEAKKRDHRVLGAKLDLFSQQESSPGMPFFHPRGMIVWDALIRYWKQLHTAAGYKEILTPQLMNRQLWEVSGHWDNYKANMYTLQIDDEDYAIKPMNCPGCMLYYKTRLHSYKEFPLRVAEVGHVHRQEASGALSGLMRVRAFHQDDAHVFLTPEQVEEETLNILQLVSTLYGTFGLEYHLELSTRPEKDTIGDDSLWELATDALNRALVQSGTPFIVRPGEGAFYGPKIDIHVKDAIQRTWQCGTIQLDMFLPERFELEYTTAQGTKSVPVMLHRALFGSIERFLGILIENFKGRFPLWLSPEQVRIITVADRHIPRAKELEEAWKRLGLVVTLDDSSESVSKKIRNAQNMQVNYMITLGDHEINENVLAVRTRDNRVINDVSVERFLNTILEEKNSLSLTALL

SEQ ID NO: 862 - protein, 90 aa, Chlamydia pneumoniae
LTCMFWALRIFLLTDSLESSKVTTKPKRFHASSSSFALGIWRSATVMIRTCSGLNHKGNLPLKFSIRIPKKRSIEPKRARCNITGTLLVP

SEQ ID NO: 863 - protein, 90 aa, Chlamydia pneumoniae
NANNESPPNMEAWNKMIQVTCDQKNYEVLEGTTAAELAKQLKNSHQFIGVLINERPRDLSTHLNEGDTLVFLTSEDPEDEKFFFILLPIF

SEQ ID NO: 864 - protein, 310 aa, Chlamydia pneumoniae
TLQTGLHMSLFLVFLTAFIWSSSFALSKLVMNASAPIFATGARMVIAGAILALAAWFRGGFVGISKKIFLYIVLLALTGFYLTNIFEFIGLQSLSSSKTCFIYGLSPLMSALFSYIQLKEKVTLKKVLGLSLGLVSYICYLTFGGGGDDSQPWTWQIGLPELLILGAASLASFGWTLLRQIEKQSTLSVTAINAYAMLIAGMLSIMHSAVVEPWRPLPVQDISQFLYATLALVVISNLICYNLYAKLLRKYSSTFLSFCNLVMPLYSGFYGWILLGEKGVSLGLVLAVAFMVAGCRLIYHEEFRQGYIVS

SEQ ID NO: 865 - protein, 118 aa, Chlamydia pneumoniae
KSLQRYERSETQGARVASFAGNALSSSMQMSQLMHGLTAAVEGLSAGQTGIEVAHHQRLAGQAEAQAEVLKQMSSVYGQQAGQAGQLQEQAMQSFNTALQTLQNIADSQTQTTSAIFN

SEQ ID NO: 866 - protein, 392 aa, Chlamydia pneumoniae
LKKLPSWALKSLKRMPQSAEPSWRSIKPIIFKGACIAMTSGVSGSSSQDPTLAAQLAQSSQKAGNAQSGHDTKNVTKQGAQAEVAAGGFEDLIQDASAQSTGKKEATSSTTKSSKGEKSEKSGKSKSSTSVASASKTATAQAVQGPKGLRQNNYDSPSLPTPEAQTINGIVLKKGMGTLALLGLVMTLMANAAGESWKASFQSQNQAIRSQVESAPAIGEAIKRQANHQASATEAQAKQSLISGIVNIVGFTVSVGAGIFSAAKGATSALKSASFAKETGASAAGGAASKALTSASSSVQQTMASTAKAATTAASSAGSAATKAAANLTDDMAAAASKMASDGASKASGGLFGEVLNKPNWSEKVSRGMNVVKLRERVLHHLQEMLFLPLCK

SEQ ID NO: 867 - protein, 496 aa, Chlamydia pneumoniae
DTNMSISSSSGPDNQKNIMSQVLTSTPQGVPQQDKLSGNETKQIQQTRQGKNTEMESDATIAGASGKDKTSSTTKTETAPQQGVAAGKESSESQKAGADTGVSGAAATTASNTATKIAMQTSIEEASKSMESTLESLQSLSAAQMKEVEAVVVAALSGKSSGSAKLETPELPKPGVTPRSEVIEIGLALAKAIQTLGEATKSALSNYASTQAQADQTNKLGLEKQAIKIDKEREEYQEMKAAEQKSKDLEGTMDTVNTVMIAVSVAITVISIVAAIFTCGAGLAGLAAGAAVGAAAAGGAAGAAAATTVATQITVQAVVQAVKQAVITAVRQAITAAIKAAVKSGIKAFIKTLVKAIAKAISKGISKVFAKGTQMIAKNFPKLSKVISSLTSKWVTVGVGVVVAAPALGKGIMQMQLSEMQQNVAQFQKEVGKLQAAADMISMFTQFWQQASKIASKQTGESNEMTQKATKLGAQILKAYAAISGAIVAQHKTNNF

SEQ ID NO: 868 - protein, 123 aa, Chlamydia pneumoniae
GEIMNKKPKKTKKAVQSKAAPVKRVPEESQEAAIQQLELAVSDLYKELPLAQTFASLTDKNQINSIIAALSGTLESLHLEELTQGLFPSAQEDANFAKELSSVVHGLKNLTTVVNKQMVKGAE

SEQ ID NO: 869 - protein, 210 aa, Chlamydia pneumoniae
KNANRLAELAAQKKAKADDLEQVHPVPTEEEIKKALGNIFEGLSNGLDLQQILGLSDYLLEEIYTVAYTFYSQGKYNEAVGLFQLLAAAQPQNYKYMLGLSSCYHQLHLYNEAAFGFFLAFDAQPDNPIPPYYIADSLLKLQQPEESNNFLDVTMDICGNNPEFKILKERCQIMKQSIEKQMAGETKKAPTKKPAGKSKTTTNKKSGKKR

SEQ ID NO: 870 - protein, 580 aa, Chlamydia pneumoniae
MSTRRPIQLLDPLTINQIAAGEVIENSVSVVKELIENSLDAGADEIEIETLGGGQGAIIIRDNGCGFRAEDIPIALQRHATSKIREFSDIFSLNSFGFRGEALPSIASISKMEIQSSIEGDEGVRTVIHGGDIVSCEPCARQLGTTVIVNSLFYNVPVRRGFQKSMQSDRLGIRKLIENRILSTANIGWSWISEGHHEIQIAKQQGFQERVAYVMGDHFMQDALTIDKEANGVRIVGVLGSPSFHRPTRQGQKIFINDRPIESLFISKKVGDAYALLLPLHRYPVFVLKLYLPSSWCDFNVHPQKIEARILKEELVGDCIKEAIVETLACPPGILCRTHQEIEESDSVPLPMFRMLETSDVQEEESVEFDQNLFAYSSEDVSLEKQEYTSRGPKSQMDWIYSSDVRFLTSLGRVVLAEDLEGVHIIFTAAARKHLFFLSLMQENSRMYQSQALLIPLRLQVTPEEAFFFSHHGRTLCDLGIEISQVGPCVFSIESTPTVIGEEELKEWLLLLAARGSTDINSEALTALMKETLTQATFSKHQHVFDVSWLKLLWSVGKPEKGFDGARIRRLILDSDFMEG

SEQ ID NO: 871 - protein, 355 aa, Chlamydia pneumoniae
MSHDRILRAQRALSEHNLDAILVEKSEDLAYFLHDEAIAGILLIGQQEVMFFVYRMDKDLYSHIQRVPLTFLTQDVVADLSLYVQKQRYQKIGFDSASTVYHKFAQRQVLPCLWEPLECFTEKIRSIKSEEEIRRMQEAAALGSAGYDYVLTLLREGITEKEVVRQLRAFWAEAGAEGPSFPPIIAFGEHSAFPHSIPTDRPLKKGDIVLIDIGVLLNGYCSDMTRMTALGTPHPKLLESYPVVVEAQKRAMALCKEGVLWGDIDAEAVRVLREHHLDTYFIHGIGHGVGRHIHEYPCSPRGSQVKLESGMTITVEPGVYFPGIGGIRIEDTLCIDKNKNFSLTARPVISELVCL

SEQ ID NO: 872 - protein, 465 aa, Chlamydia pneumoniae
FFLFFKLSYNFIFNLPLTMYQLLSIGYSFVSFIALLWMLCYSPNYVTDLYRISLSAEESLGGIRAFPQAESLLGGACALNFPDLEERLPDLRKELLFLGSNDRPDACGGKFSLQLASSKECYIAALKERVYLNVTNSSRGPVYSFSPKGVPTELWIECFSVSVDGRVEVKVRLQGLHKELISKPRDCETLFLNPPANKLDCWEIAGFRVDASFPVKQKIRRIGVDKFLLMHGGAEYADKATKERVDFVSSDEENYSRYLAVGDVLLWDGNCWQTCGEFQGASSRAPLFEVKRIDDKVMIADLWNVGGTQRQTISLVKGVPSPIEINEVIREIEFTGMRSWSKPIVLVGGQRLILSPDDWILRTAKGWEKLSRADQIQDYVTGKVTGPLLVFEKLEKDLRGFVLRGHMFNAQRTLVETISLPLKQGFEPAVASQEVSSNTRSAQHIQGRPIVGDHRWFFSVILYCI

SEQ ID NO: 873 - protein, 123 aa, Chlamydia pneumoniae
FSSSEETKSTRSFVALSAYSAPPCIKRNLSTPIRRIFCFTGKLASTLNPAISQQSSLLAGGFKNKVSQSRGFEINSLCKPWRRTLTSTLPSTLTEKHSIHNSVGTPLGLNEYTGPREELVTFK

SEQ ID NO: 874 - protein, 754 aa, Chlamydia pneumoniae
MVFFRNSLLHLVALSGMLCCSSGVALTIAEKMASLEHSGRGADDYEGMASFNANMREYSLQLSKLYEEARKLRASGTEDEALWKDLIRRIGEVRGYLREIEELWAAEIREKGGNLEDYALWNHPETTIYNLVTDYGTEDSIYLIPQEIGAIKIATLSKFVVPKESFEDCLTQILSRLGIGVRQVNSWIKELYMMRKEGCSVAGVFSSRKDLEALPETAYIGFVLNSNVDAHTNQHVLKKFINPETTHVDVIAGRVWIFGSAGEVGELLKIYNFVQSESIRQEYRVIPLTKIDPGEMISILNAAFREDLTKDVSEESLGLRVVPLQYQGRSLFLSGTAALVQQALTLIRELEEGIENPTDKTVFWYNVKHSDPQELAALLSQVHDVFSGENKASVGAADGCGSQLNASIQIDTTVSSSAKDGSVKYGNFIADSKTGTLIMVVEKEVLPRIQMLLKKLDVPKKMVRIEVLLFERKLAHEQKSGLNLLRLGEEVCKKGCSPSVSWAGGTGILEFLFKGSTGSSIVPGYDLAYQFLMAQEDVRINASPSVVTMNQTPARIAVVDEMSIAVSSDKDKAQYNRAQYGIMIKMLPVINVGEEDGKSYITLETDITFDTTGKNHDDRPDVTRRNITNKVRIADGETVIIGGLRCKQMSDSHDGIPFLGDIPGIGKLFGMSSTSDSLTEMFVFITPKILENPVEQQERKEEALLSSRPGEREEYYQALAASEAAARAAHKKLEMFPASGVSLSQVERQEYDGC

SEQ ID NO: 875 - protein, 453 aa, Chlamydia pneumoniae
RGKNTMAASILSQELLDILPYTFLKKHCLLPIEESSEAITIAHATATSVIAQDEVKLLIKKPVRFVLKEESEILQRLQQLYSNREGNVSDMLLTMKEEDGTTISEEEDLLETTDTIPVVRLLNWILKEAIEERASDIHFEPCEDSMRIRYRIDGVLHDRHSPPSHLRSALTTRLKVLAKMDIAEHRLPQDGRIKIHIGGQEVDMRVSTVPVIYGERVVLRILDKRNVILDIAGLHMPKGTEILFKDTITAPEGILLVTGPTGSGKTTTLYSVLQELKGPLTNIMTIEDPPEYKLPGIAQIAVKPKIGLTFARGLRHLLRQDPDILMVGEIRDQETAEIAIQAALTGHLVVSTLHTNDAISAIPRLLDMGIESYLLSATLVGVVAQRLVRTICPYCKVAYTPENQEKSFLASLGKDTEMPLYRGQGCVHCFVPDIKEDREFTNFYARIHYFVQK

SEQ ID NO: 876 - protein, 394 aa, Chlamydia pneumoniae
GGRMPRYRYTYLDPKERRKRGYLEALHIQEAREKLAQENIQVLDIREVALRRMSIKSTELIVFTKQLLLLLRSGLPLYESLVSLRDQYHEQKMGLLLTSFMETLRSGGSLSQAMAAHPNIFDHFYCSGVAAGESVGNLEGCLQNIIVVLEERAQITKKMVGALSYPCVLLVFSFAVMLFFLLGVIPSLKETFENMEVKGLTKIVFGVSDCLSAYRYLFLGFASALITVGILMRHRIPWKKILEKLLFALPGTKKFVVKVAVNRFCSVASAILKGGGTLIEGLDLGCDAIPYDRLKTDMRDIVQAVIGGGSLSQELAQRSWVPKLAIGMIALGEESGDLADVLGYVAHIYNEDTQKTLASITSWCQPVILIFLGGLIGVIMLAILIPLTSNIQTL

SEQ ID NO: 877 - protein, 175 aa, Chlamydia pneumoniae
GYTKNVGFDNVVVSTRDSDFSWWPDRCDHVGNIDPTHKQYPNIIKCVLRGVGMKRQKRKQSITLIEMMVVITLIGIIGGALAFNMRGSIHKGKVFQSEQNCAKVYDILMMEYATGGSSLKEIIAHKETVVEEASWCKEGRKLLKDAWGEDLIVQLNDKGDDLVIFSKRVQSSNKK

SEQ ID NO: 878 - protein, 149 aa, Chlamydia pneumoniae
LLSNIMGSRRKLKRSFLLIEVLMALSLVCAVLLPCIRFYYAIHRSFEEDIFNLQLPALIDHCFLSVEEKMRQQMAEGTVLTSGKGQTVSLAYTSQGIGYRIPYGYNVDIRQEVRGDNLKMKVCLADVVVELFPDQKQAVSVQRCLCVTL

SEQ ID NO: 879 - protein, 206 aa, Chlamydia pneumoniae
DESLPCRCCCGTFPRSETSSIRTEMPMCNSIAMKKQKRGFVLMELLMSFTLIALLLGTLGFWYRKIYTVQKQKERIYNFYIEESRAYKQLRTLFSMSLSSSYEEPGSLFSLIFDRGVYRDPKLAGAVRASLHHDTKDQRLELRICNIKDQSYFETQRLLSHVTHVVLSFQRNPDPEKLPETIALTITREPKAYPPRTLTYQFAVGK

SEQ ID NO: 880 - protein, 344 aa, Chlamydia pneumoniae
HTNLRLGNKPMQPFIFTLLCLTSLVSLVAFDAANARKRCACAQTIERGENFFSIKRSACAEIEYQEKSRHASAIERISKDKGKVTPKQIAKVATKKKQRYRLLQVPFSRPPNNSRYNLYALLSEPPECYSDTASWYAIFIRLLRRAYVDTGNVPPGSEYAIANALISNKQEILERGAQLGPDVIETLTLPEEQAEIFYKMLKGSSNSQSLLNFLHYEEKSLGHCKLNLIFMDPLLLEAVLDHPDAYRETSLLRDGIWEAVKRQEHAIQEHGQAAALELFKTRTDFRLELRDKMQLLLSRYDLLPLLNKKMFDYTLGSAGDYLFLVDPDTKAISRCRCPSKSIKL

SEQ ID NO: 881 - protein, 95 aa, Chlamydia pneumoniae
  SITE 1...95: Xaa=unknown or other
FFLIIVLISTIKNISIGRTMADETPKENSSKESSSQFDSLKRKVKDLHSNPKVGKWKKFLSHRACEXSVVAWCWLVSSLILFHGLEDCLLLVVWS

SEQ ID NO: 882 - protein, 125 aa, Chlamydia pneumoniae
  SITE 1...125: Xaa=unknown or other
SREMEEVSFSSSLRXIGGCLVLVGIIADFISWAGGLFIACGVVLGFHVEIRKMLSNLQSYSIANGPIKNAILCGLILFFVLNIPSFAVSFIVLCVILSFITTAPSCSTCSKDHCDKHQDTSNKPS

SEQ ID NO: 883 - protein, 305 aa, Chlamydia pneumoniae
LQVRFSKTSINGNKELMGISLPELFSNLGSAYLDYIFQHPPAYVWSVFLLLLARLLPIFAVAPFLGAKLFPSPIKIGISLSWLAIIFPKVLADTQITNYMDNNLFYVLLVKEMIIGIVIGFVLAFPFYAAQSAGSFITNQQGIQGLEGATSLISIEQTSPHGILYHYFVTIIFWLVGGHRIVISLLLQTLEVIPIHSFFPAEMMSLSAPIWITMIKMCQLCLVMTIQLSAPAALAMLMSDLFLGIINRMAPQVQVIYLLSALKAFMGLLFLTLAWWFIIKQIDYFTLAWFKEVPIMLLGSNPQVL

SEQ ID NO: 884 - protein, 95 aa, Chlamydia pneumoniae
VLAFFATSFKSVLFEYSYQSLLLILIVSAPPIILASIVGIMVAIFQAATQIQEQTFAFAVKLVVIFGTLMISGGWLSNMILRFAGQIFQNFYKWK

SEQ ID NO: 885 - protein, 117 aa, Chlamydia pneumoniae
RTFALFLNSQHSKSTNSKLLQDLTENLPSEIRAHLTASDFVIIIPAFIMGQIKNAFEIGVLIYLPFFVIDLVTANVLVAMQMMMLSPLSISLPLKLLLIVMVDGWTLLLQGLMISFK

SEQ ID NO: 886 - protein, 257 aa, Chlamydia pneumoniae
TSHLRLHHPRILLLYLMIRIRKNKGIHYYAIHFSIFPLFFYAERLMLFSDASLYENSCPSRCQPTPPPSNSNPLNVVQQPVAASSVPSYMPPLNADDVLPRDHLSDGSFSDTYPDITTQAIILIFLALSPFLVMLLTSYLKIIITLVLLRNALGVQQTPPSQVLNGIALILSIYVMFPTGVAMYKDARKEIEANTIPQSLFTAEGAETVFVALNKSKEPLRSFLIRNTPKAQIQSFYKISQKTFLRKFERTSLPPTL

SEQ ID NO: 887 - protein, 108 aa, Chlamydia pneumoniae
KSSHKINISLLSVNPKDLPLVEKSRPELKNIVEYADSLILTAKPDVTPGGCIIETEAGIINAQLDVQLDALEKAFSTILKAKNPVDEPSETSSSTDSSSLSNDQDKKE

SEQ ID NO: 888 - protein, 140 aa, Chlamydia pneumoniae
FLKMMMSPQIRRFYLLKLSSAFLDAKELLEKTKADSEAYVAETEQKCAQIRQEAKDQGFKEGSESWSKQIAFLEEETKNLRIRVREALVPLAIASVRKIIGKELELHPETIVSIISQALKELTQNKHIITLCQSQRFTSC

SEQ ID NO: 889 - protein, 280 aa, Chlamydia pneumoniae
GCLVTANTFGTLDILMKHSKEDDLSRFLPKNLLVESPHPEEIPLKSLSFTMSWLPTIHPSWITIAMKEFPPEIQGQLLAWLPEPLVQEILPLLPGISIAPHRCAPFGAFYLLDMLSKKIRPCGITEEIFLPASSANAILYYTGPVKIALINCLGLYSIAKELKHILDKVVIERVKNALSPTEKLFLTYCQSHPMKHLETTNFLSSWTTDAELRQFVHKQGLEFLGKALTKENASFLWYFLRRLDVGRAYIVEQTLKTWYDHPYVDYFKSRLEQCMKVLVK

SEQ ID NO: 890 - protein, 155 aa, Chlamydia pneumoniae
  SITE 1...155: Xaa=unknown or other
APYCKCCSRTCARERLCSERSRXYSDITINGPWGLTEEIDYVSVWGIILAKSSLTKFRLIFYVLILILFVISCGLLWVIWKTHTLIMTMGGTKGFFNPTPYTKNALEAKKAEGAAADKEKKEDADSQGESKNAETSDKDSSDKDAPEGSNEIEGA

SEQ ID NO: 891 - protein, 214 aa, Chlamydia pneumoniae
  SITE 1...214: Xaa=unknown or other
MVRRSISFCLFFLMTLLCCTSCNSRSLIVHGLPGREANEIVVLLVSKGVAAQKLPQAAAATAGAATEQMWDIAVPSAQITEALAILNQAGLPRMKGTSLLDLFAKQGLVPSELQEKIRYQEGLSEQMASTIRKMDGVVDASVQISFTTENEDNLPLTASVYIKHRGVLDNPNSIMVSKIKRLIASAVPGLVPENVSVVSDRAXIVILQLMVLGD

SEQ ID NO: 892 - protein, 224 aa, Chlamydia pneumoniae
VLFLAYKMAGLQIIATRILDSFLLPCFEVEAQTFPQVFSKVVVYKYKSSRILLIALLYNITLVLGLIFIHKKYLGQKGRVILKIYQNEEEFFRATERFPSIGAGYLRVRNKNSVLFPFEDLMLVCPSVPKDFPLSAFKVTTKLIYWSVLESIPVVGAFFFSIGRLFAMWCIEDFPGSIFSRIYHTTVGVLGILGLGIIMFILRIIFTLLTLPFWLISCLKSSAA

SEQ ID NO: 893 - protein, 319 aa, Chlamydia pneumoniae
VMKCRPTLNTDQPRVRKKLPERFPKWLQRPLPQGSAFHATDATIKRSGMPTVCEEALCPNRAECWSRKTATYLALGDVCTRSCGFCNIGHSKTPPALDPTEPERIALSAKELGLKHVVITMVARDDLEDGGAQGLVDIIQKLREELPQATTEVLASDFQGNVSALHTLLDSGITIYNHNVETVARLSPLVRHKATYARSMFMLEQAANYLPDLKIKSGIMVGLGEMEGEVKQTLQDLASIGVRIVTIGQYLRPSRKHLQVKSYVTPETFDYYRRVGEAMGLFVYAGPFVRSSFNADMILASVQDKASVNKHSTIHLIES

SEQ ID NO: 894 - protein, 397 aa, Chlamydia pneumoniae
ACGEFGIHVDGYTIDYPAMAKRKNTVVQGIRQGLEGLIRSNKITVLKGTGSLVSSTEVKVIGQDTTIIKANHIILATGSEPRPFPGVPFSSRILSSTGILELEVLPKKLAIIGGGVIGCEFASLFHTLGVEITVIEALDHILAVNNKEVSQTVTNKFTKQGIRILTKASISAIEESQNQVRITVNDQVEEFDYVLVAIGRQFNTASIGLDNAGVIRDDRGVIPVDETMRTNVPNIYAIGDITGKWLLAHVASHQGVIAAKNISGHHEVMDYSAIPSVIFTHPEIAMVGLSLQEAEQQNLPAKLTKFPFKAIGKAVALGASDGFAAIVSHEITQQILGAYVIGPHASSLIGEMTLAIRNELTLPCIYETVHAHPTLSEVWAEGALLATNHPLHFPPKS

SEQ ID NO: 895 - protein, 97 aa, Chlamydia pneumoniae
MTQEFDCVVIGAGPSGYVAAITAAQSKLRTALIEEDQAGGTCLNRGCIPSKALIAGANVVSHIKHAESSASMLMVIQSITLRWQKEKIQSSRGSVKD

SEQ ID NO: 896 - protein, 157 aa, Chlamydia pneumoniae
KIPMPFAKETEMQRTCWKCEGSVSMHVPQCPYCSAFLQDPPVASGGFSSCHISFPEGASKEEAEDLFAVSSEDWEAVLGDQNPTQETNKQVIPEWTWLQSWPLAALFLGIGLLAFAFLILLFSTDSGLVLTWPKNRAYFYGIIGAAVAYRGYRKLPL

SEQ ID NO: 897 - protein, 170 aa, Chlamydia pneumoniae
FGSLLSILRKLGSSMLRFQGKSLNRKEEIETFTTDPNCQVFVGSLLAAGTGINLTAGNVVIMYDRWWNPAKENQALDRVHRIGQKNTVFIYKLITEDTLEERIHYLIEKKIRLLDKVIASQDSNILHMLNREDLLTILSYKDEHGTSDSEESPVDAPVEDDTGVLPPEDS

SEQ ID NO: 898 - protein, 301 aa, Chlamydia pneumoniae
LYVQQSVLPHWEHILSNHLPGVSIFSFHGPNKPSELPPADILLTSYGTLRQNYDKFYKIAFTIVVFDEIHMAKNKSSQIHKILCRIDAQMKLGLTGTPIENNLLEFKGLLDIILPNYLPSDALFKKLFTKRCSSEELEEIIPSQDLLLKLTRPFILRRTKKLVLPELPDKVESIIACSLSPDQEKLYMATLQREKSHIQKLETPEEPATNFLHIFALLNHLKQICDHPAVFFKDPDQYKNYESGKWNAFVKLLKESLNAGYKVVVFSQYIHMIRIITLYLEEIGIKYASISRKISESEGRN

SEQ ID NO: 899 - protein, 610 aa, Chlamydia pneumoniae
  SITE 1...610: Xaa=unknown or other
XPLSIALLKKFFFLNEEGAELTIGENSQGFPSHFSLQWQGLVFKAEILDFPTLEDIFPKLELAHTSLENVSHDISITNVTVCAEEAKVNFTLSPVIHKKDRENHPKTRIGSVEYVAKTHEMITGPKAIALPIYAIPLLADKFKDQLLSLLCYDSLEYRLRYDIRLLRDASFSFSAYLVTPGDLDNGSLIYPNYCYSPTKGLMQVVGMLSPKQAFIVKSEQVEDFLNERGHLIQEPGFQTFINERPEGHLTYNVTEQGVLLFHYDVGDPSSTEIRFGTWTYYTNQGFFLEKKNDLPIQDGLIVEPQDIPAFIVKNDAALRRLPNFFSSPPNLKDLLIEVHRQSRGKGLDLKPILVGLGESRCWLFGVFLYREDIGFSLIPTPLQGLCFLPRVIPPENVPQFLTQYAQHERILFPNPQTRPPESYELVIQSIHRPHPASPLHLQLELKTNLGSVPIGIALQGLKSKHTFLFTQAGFLDLKQNLFQFLKQFLSTQKCVIAENTVIANITDVFKLDALAPLSVTDDTIANPEDLQFFSQLKAACLPPIPQNLFSSDHQLRPYQNSGLLWMWFLYNHRLSGLLCDEMGLGKTHQATALTRYCISVFTALSAPEIP

SEQ ID NO: 900 - protein, 181 aa, Chlamydia pneumoniae
  SITE 1...181: Xaa=unknown or other
HNIMVLEALAIFRQDAMQHLLKHRKEIVVDFCEDSYTIRIPDEEAPEGYWLSTLKLQDIDRLTFASCSCPDGECCLHLMTAYFAVYDALGLHPLHDKFRHSFWYAVFSHFFLDSIPLQAQGEMVYTLESPHITLTIECLSEEVFQDWLRTIHASEEPTVFTNKTFLXSALYRTAKKILFLK

SEQ ID NO: 901 - protein, 412 aa, Chlamydia pneumoniae
MKKNASHKTNDKKSLSIWSIGGSIFAMFFGAGNIVFPLALGYHYNAHPWSAYFGMMLTAVCVPLLGLVSMLFYSGDYQKFFFSIGRIPGMIFITAIILLIGPFGGIPRAIAVSHATLISLSEHKSAFIPSLPIFSAICCVLIYIFSCKLSRLIQWLGSVFFPIMLVTLLWVIIRSFMIPTHPMVQEFIPNARQAWLAGFIEGFNTMDLLAAFFFCSIVLISLRQLVAEEKHPTEEEIPLSFQGISKKNKRSLALGFFLAAILLGMTYLGFVLSAARHAGLLVNVSKGHILGRISAIALGPNSILAGVSVFIACLTTEIALVGIVADFLARVVSFKKLNYASAVICTLIPTYLISILNFETISHLLLPLLQLSYPALIVLACGNIAYKLWNFRYSPVLFYLTLSLTIVLKLVN

SEQ ID NO: 902 - protein, 211 aa, Chlamydia pneumoniae
LTMKQFILRTLNALFPNPKPSLEGWSSPFQLLIAILLSGNSTDKAVNSVTPQLFAKAPDAQSILDLPPGKLYQLIAPCGLGERKSAYIYQLSQILVRDFHGEPPNDMALLTQLPGVGRKTASVFLGIAYGKPTFPVDTHILRLAQRWKISEKKSPSAAEKDLARFFGHENTPKLHLQLIYYARQYCPALHHKIDNCPICSYLAKEANSTRT

SEQ ID NO: 903 - protein, 442 aa, Chlamydia pneumoniae
MLKHDTIAAIATPPGEGSIAVVRLSGPQAIVIADRIFSGSVASFASHTIHLGQVIFEETLIDQALLLLMRSPRSFTGEDVVEFQCHGGFFACSQILDALIALGARPALPGEFSQRAFLNGKIDLVQAEAIQNLIVAENIDAFRIAQTHFQGNFSKKIQEIHTLIIEALAFLEVLADFPEEEQPDLLVPQEKIQNALHIVEDFISSFDEGQRLAQGTSLILAGKPNVGKSSLLNALLQKNRAIVTHIPGTTRDILEEQWLLQGKRIRLLDTAGQRTTDNDIEKEGIERALSAMEEADGILWVIDATQPLEDLPKILFTKPSFLLWNKADLTPPPFLDTSLPQFAISAKTGEGLTQVKQALIQWMQKQEAGKTSKVFLVSSRHHMILQEVARCLKEAQKNLYLQPPEIIALELREALHSIGMLSGKEVTESILGEIFSKFCIGK

SEQ ID NO: 904 - protein, 303 aa, Chlamydia pneumoniae
GLVQKPQYIDRITKKKVIEPIFYEKTMLFLYNSKLGKKLSVFLSTHPIFSRIYGWLQRCSWTRRQIRPFMNRYKISEKELTKPVADFTSFNDFFTRKLKPEARPIVGGKEVFITPVDGRYLVYPNVSEFDKFIVKSKAFSLPKLLGDHELTKLYAHGSIVFARLAPFDYHRFHFPCDCLPQKTRCVNGALFSVHPLAVKDNFILFCENKRTVTVLETEQFGNVLYLEVGAMNVGSIVQTFSPNQTYAKGDEKGFFAFGGSTVILLFLPNAIRFDNDLLKNSRMGFETRCLMGQSLGRSQREEI

SEQ ID NO: 905 - protein, 468 aa, Chlamydia pneumoniae
ISERRNLKTLKTFFGIAKRDKSQKWRIMWLVILWALAASLAIALVAKGYYRFVYFRRYAVQVIREVRLSMELKEWALAEQQLLPILKKRSYRRQCLFEYMRILRKMQRFEESEKLLAEAKKLGLRGPYFFLEIAYKAYRFGAFKECAQAFASVPQDLFEEEDAAKYASALVRLGDLDAACSLIEPWISPLSHQETFVTMGHIYFTSKRYKDAIDFYNRANALGVCPVEVTYNLAQAYRITSSYAKAGKLFRKLLSNPVYKEEALFNIGLCEQKLGRPGKALLIYQSSDLWSRGDALLMKYAAMAAMDQRDYVLAEPCWELALRCSTFAKDYKCGLGYGFSLCRLRKYGDAERVYCNLIQNFPECLTACKALAWLCGVGYATLLGSEEGLMYAKKAVELDHSCETLELLSACEARCGNFDAAYEIQSFLSSRDTSLQEKQRRSQILRILRKKLPLNDHHIVEVDALLAA

SEQ ID NO: 906 - protein, 970 aa, Chlamydia pneumoniae
MLGFLKRFFGSSQERILKKFQKLVDKVNIYDEMLTPLSDDELRNKTAELKQRYQNGESLDSMLPEAYGVVKNVCRRLAGTPVEVSGYHQRWDMVPYDVQILGAIAMHKGFITEMQTGEGKTLTAVMPLYLNALTGKPVHLVTVNDYLAQRDCEWVGSVLRWLGLTTGVLVSGTLLEKRKKIYQCDVVYGTASEFGFDYLRDNSIATRLEEQVGRGYYFAIIDEVDSILIDEARTPLIISGPGEKHNPVYFELKEKVASLVYLQKELCSRIALEARRGLDSFLDVDILPKDKKVLEGISEFCRSLWLVSKGMPLNRVLRRVREHPDLRAMIDKWDVYYHAEQNKEESLERLSELYIIVDEHNNDFELTDKGMQQWVEYAGGSTEEFVMMDMGHEYALIENDETLSPADKINKKIAISEEDTLRKARAHGLRQLLRAQLLMERDVDYIVRDDQIVIIDEHTGRPQPGRRFSEGLHQAIEAKEHVTIRKESQTLATVTLQNFFRLYEKLAGMTGTAITESREFKEIYNLYVLQVPTFKPCLRIDHNDEFYMTEREKYHAIVNEIATIHGKGNPILVGTESVEVSEKLSRILRQNRIEHTVLNAKNHAQEAEIIAGAGKLGAVTVATNMAGRGTDIKLDNEAVIVGGLHVIGTTRHQSRRIDRQLRGRCARLGDPGAAKFFLSFEDRLMRLFASPKLNTLIRHFRPPEGEAMSDPMFNRLIETAQKRVEGRNYTIRKHTLEYDDVMNKQRQAIYAFRHDVLHAESVFDLAKEILCHVSLMVASLVMSDRQFKGWTLPNLEEWITSSFPIALNIEELRQLKDTDSIAEKIAAELIQEFQVRFDHMVEGLSKAGGEELDASAICRDVVRSVMVMHIDEQWRIHLVDMDLLRSEVGLRTVGQKDPLLEFKHESFLLFESLIRDIRITIARHLFRLELTVEPNPRVNNVIPTVATSFHNNVNYGPLELTVVTDSEDQD

SEQ ID NO: 907 - protein, 487 aa, Chlamydia pneumoniae
MLKIAILGRPNVGKSSLFNRLCKRSLAIVNSQEGTTRDRLYGELHAFGVPAQVIDTGGVDHNSEDYFQKHIYNQALTGAKEADVLLLVIDIRCGITEEDAHLAKLLLPLKKPLILVANKADSRQEELQIHETYKLGIRDIVVTSTAHDKHIDTLLQRIKLVANLPEPREEEEEGLEELSVDEHEESEAALPSNTFPDFSEVFTEGFSPEEPCTIPESPQQAPKTLKIALIGRPNVGKSSIINGLLNEERCIIDNTPGTTRDNIDILYSHKDRQYLFIDTAGLRKMKSVKNSIEWISSSRTEKAISRADICLLVIDATQKLSSYEKRILSLISKRKKPHIILINKWDLLEEVRMEHYCKDLRATDPYLGQAKMLCISATTKRNLKKIFSAIDELHHVVSNKVPTPIVNKTLASALHRNHPQVIQGRRLRIYYAIQKTTTPLQFLLFINAKSLLTKHYEYYLKNTLKSSFNLYGIPFDLEFKEKPKRHN

SEQ ID NO: 908 - protein, 410 aa, Chlamydia pneumoniae
MTTIAIEAAKKVLIKLRNAGYQAYFVGGCVRDMLMNRPLEDIDIATNASPTIVSTIFPDVISIGVAFGIIVVKQDGRLFEVATFRSDGEYKDGRHPDRIIFSSMREDALRRDFTVNGMYYDPFEDKVFDFVEGTRDIEKKVIRAIGHPRLRFSEDKLRILRAIRFSSSLGFTLDPTTERAIIKEAPALVNSVSPERIWQELKKMLKRQPYGALSLLLKLKVLIFIFPELRDIPYSLLRTTIEFARKFNPTHFPEILFLLPLFQGVSEEAATVAFGRLRISNKELKLIESWYEALPHFQNQSGNRVFWAHFLASPTAPLFLELFSALQKDPSRQQHFISRVQELESRLEQFILRIKTSSPVVSAPDLIAKGISPGRLLGDLLREAEILSIENECLDKEKILLLLQEKGFWK

SEQ ID NO: 909 - protein, 185 aa, Chlamydia pneumoniae
RVYPSQYGKYLIYRRRTFVNLDKIIAKRLGKTTIGFSDDQADLSQKTRDHLLAKVETEDLIAFGMIPEFVGRFNCIVNCEELSLDELVAILTEPTNAIVKQYMELFAEENVKLVFKKEALYAIAKKAKQAKTGARALGMILENLLRDLMFEIPSDPTVEAIHIQEDTIAENKAPIIIRRTPEAIA

SEQ ID NO: 910 - protein, 256 aa, Chlamydia pneumoniae
MNKKNLTICSFCGRSEKDVEKLIAGPSVYICDYCIKLCSGILDKKPSSTISSAPVSETPSQPSDLRVLTPKEIKKHIDEYVIGQERAKKTIAVAVYNHYKRIRALLHNKQVSYGKSNVLLLGPTGSGKTLIAKTLAKILDVPFTIADATTLTEAGYVGEDVENIVLRLLQAADYDVARAERGIIYIDEIDKIGRTTANVSITRDVSGEGVQQALLKIVEGTTANVPPKGGRKHPNQEYIRVNTENILFIVGGLSST

SEQ ID NO: 911 - protein, 116 aa, Chlamydia pneumoniae
CKYLLHRSSCIHGSPLIIRRTKGKRHALPHSRMMIHQPSGGIIGTSADIQLQAAEILTLKKHLANILSECTGQPVEKIIEDSERDFFMGAEEAISYGLIDKVVTSAKETNKDTSST

SEQ ID NO: 912 - protein, 119 aa, Chlamydia pneumoniae
MTLVPYVVEDTGRGERAMDIYSRLLKDRIVMIGQEITEPLANTVIAQLLFLMSEDPKKDIQIFINSPGGYITAGLAIYDTIRFLGCDVNTYCIGQAASMGALLLSAELKESVTLFPIAV

SEQ ID NO: 913 - protein, 98 aa, Chlamydia pneumoniae
KKKSELIKEAEEDATKALKLLFLTHKIFSDEKLTISREELQYMMDVCSRERFGQQPPKDISNDTLQELVMSARDRLTYSKAIEHVLRKAELLASTPSA

SEQ ID NO: 914 - protein, 240 aa, Chlamydia pneumoniae
KAFPAISDLPWENLSLPQEEAASEISDSDIEKGLTNIGMFFATKTPVERPSQEGDFISISLHVSKSNDENASSAAIFENKYFKLSEEEMTDAFKEKFLGISTGHRVVETITSPEIQSFLRGDTLTFTVNAVIEVSIPEIDDEKARQLQAESLDDLKAKLRIQLEKQAKDKQLQKRFSEAEDALAMLVDFELPTSLLEERISLITREKLLNARLIQYCSDEELEKRNQNLSRKQKKMLQKH

SEQ ID NO: 915 - protein, 186 aa, Chlamydia pneumoniae
VQASSPAFPFKSNKKGCLVPRSLSNEQFSVDLEESPGCIVSALVKVSPEVLNKLNKQALKKIKKEITLPGFRKGKAPDDVIASRYPTNVRKELGELVTQDAYHALSTVGDRRPLSPKAVRSNSITQFDLQEGAKVEFSYEKLSLQFLIFLGKTFLYLRKKLLVRFQIVISRRDSQTLVCSLQQKLL

SEQ ID NO: 916 - protein, 1075 aa, Chlamydia pneumoniae
ADYIIHSYSRGEMLNFRKLRRDFSANILQDGKKLFEQGAVIDAKILSMNGETVCISAQVRGLYDNIYECEIEVDRSESDTVDSNCDCSYNYDCQHIVALLFYLEQYFNEMVVAYARSADLETDHEINEEVKKELKETFVAAATKEEERKDREHQKEILREYVHAANALSANPFFLPLEYLEKDSAELAVLFVSVNEDTFAPANQPIEFQLVLRLPCRSKPFYISNIRTFLEGVLYQEPIVLNGRRFFFTMQSFNASDRKLIDLLIRYVRYPNHTTEEKLLKSAYLMPPALGVILAKMFEHQLADRGGGSLGEKESFSGLFCGNLEEPLCWSLTPAKMKFNLDFFDMPYKALLMTPVILVDDDEVQPEQTMLLESDAPGIIHHFVYHRFSPQIKRAHLRSFSRLRDIAIPEALFGSFRENALPVFQEYAEIANVHLLNSFVTLPYVDEVRAICDMSYLDGELEAKLHFLYGSLRVPAASLALQYQDVRAFISDEGILARNLVEERKMLEEVFSGFIYDERDGAFRVKSEKKIVEFMTETIPANQHRITFNCPENLSGQFIYDETIFELSFREGSDINYYEADLKVHGLLKGVPLDLLWDCISAKKRFLELPKAGQQSKGTRRGKVNSGKLPCILVLDLEKIAPVVQIFNEIGFKVLDDLVQKCPLWSLTGISLDQFEALPVNFSMSERLIEIQKQIRGEIEFDFQDVPQQIQATLRSYQTEGVHWLERLRKMHLNGILADDMGLGKTLQAIIAVTQSKLEKGSGCSLIVCPTSLVYNWKEEFRKFNPEFRTLVIDGVPSQRRKQLTALADRDVAITSYNLLQKDVELYKSFRFDYVVLDEAHHIKNRTTRNAKSVKMIQSDHRLILTGTPIENSLEELWSLFDFLMPGLLSSYDRFVGKYIRTGNYMGNKADNMVALKKKVSPFILPRMKEDVLKDLPPVSEILYHCHLTESQKELYQSYAASAKKELSRLVKQEGFERIHIHVLATLTRLKQICCHPAIFAKDAPEPGDSAKYDMLMDLLSSLVDSGHKTVVFSQYTKMLGIIKKDLESRGIPFVYLDGSTKNRLDLVNQFNEDT

SEQ ID NO: 917 - protein, 366 aa, Chlamydia pneumoniae
MSPHRNLFKLKNFSNRLYNRALGRFDKVFNFFSGNVGIDLGTANTLVYVRGRGIVLSEPSVVAVDAQTHAVLAVGHKAKAMLGKTPRKIMAVRPMKDGVIADFEIAEGMLKALIKRVTPSRSVFRPRILIAVPSGITGVEKRAVEDSALHAGAQEVILIEEPMAAAIGVDLPVHEPAASMIIDIGGGTTEIAIISLGGIVESRSLRIAGDEFDECIINYMRRTYNLMIGPRTAEEIKITIGSAYPLGDQELEMEVRGRDQVAGLPITKRINSVEIRECLAEPIQQIIECVRLTLEKCPPELSADLVERGMVLAGGGALIKGLDKALSKNTGLSVITAPHPLLAVCLGTGKALEHLDQFKKRKGNLV

SEQ ID NO: 918 - protein, 579 aa, Chlamydia pneumoniae
INDSEDIRLCDGSDTEYDELCTLMESTGTMIRLNPEFHPNCFLVRSSADDVARVEQFTFICTSTEAEAGPTNNWRDPQEMRRELHQLFRGCMQGRTLYIVPFCMGPLDSPFSIVGVELTDSPYVVCSMKIMTRMGDDVLRSLGTSGKFLKCLHSVGKPLSPGEADVSWPCNPKSMRIVHFQDDSSVMSFGSGYGGNALLGKKCVALRLASYMAKSQGWLAEHMLIIGITNPEGKKKYFSASFPSACGKTNLAMLMPKLPGWKIECIGDDIAWIRPGRDGRLYAVNPEYGFFGVAPGTSERTNPNALATCRSNSIFTNVALTADGDVWWEGLTEQPPEPLTDWLGKPWKPGGSPAAHPNSRFTAPLRQCPSLDPEWNSPQGVPLDAIIFGGRRSETIPLVYEALSWEHGVTIGAGMSSTTTAAIVGQLGKLRHDPFAMLPFCGYNMAYYFQHWLSFAENRSLKLPKIFGVNWFRKNNQGEFLWPGFSENLRVLEWIFQRTDGLEDIAERTPIGYLPNIQKFNLNGLNLDLQTVQELFSVDAEGWLAEVENIGEYLKIFGSDCPQQITDELLRIKSELKEK

SEQ ID NO: 919 - protein, 150 aa, Chlamydia pneumoniae
RKGAVNREFGWAAGLPPGFQGFPSQSVKGSGGCSVNPSHQTSPSAVKATFVKIEFDLQVAKALGFVRSEVPGATPKNPYSGFTAYNLPSRPGRIQAISSPIHSIFQPGSLGINIAKFVLPQALGNEAEKYFFFPSGLVIPIINMCSASQP

SEQ ID NO: 920 - protein, 780 aa, Chlamydia pneumoniae
IKLRIIDYYYLINTVTLQPSYINFTPNVTTALSGGKIDTSAIELSCSALFFQELQDKAQGLKHALGLVQELSAEALRPAQVQTSISYLPTEESSRPGISAGIIDRTMPTFTDDEVKAILQNPNFETSKIFVEGLDKVFKSYLDSVTPPEGIDPSNPESAIILNYITLLNNLKPKFAAGSTPTDADYNALYALPGDFVKEIEALKAADAPPKSKVHAFWQEIMTIYNNMQVLSYPVTDYLNVQIADLSLNITAAQEVQQYLKNFYSILKDILNPGWTDPQATHYPADAEYNARDAGVIQSLLNLSGNYRQLTENMLPNTDTSLPQEIIAQIRSFQNGVNGTIIASNTLLPTTMRLDTLLGVIYTYQCCATIFGMSYGTSTPAKQNYIDAINQEKSYWQARANGFDVTSDQVFDQFATNIQSGTSYRGIDLFKNNKVNEINPIFLSQAASFLRYPYNLMSRSMYQTIEDAANRSITALDGLISGWSTQIATFQTQKNSLDPSLLKYFDTMKANKESFVTTAPLQMVYSSLMLDKYLPTQQNVIASLGIQMTYSNKAAKYLNELIKEITTFQSADIYYSLSIYLKQMNLQAVADPIGKAVGVLNDEKTRAMADITRCNKIKAAIDKMLVEIKADAELSKSQIRELVDTLTNFKSQSDDLIRNLSCLLGFLSGLTLKAVNDPNATYEAFTAEIFTEPFNNWKRQLATFESFVIQGGQNGITPGGQQQLLQAMESSQQDFSTFNQNQQLALQLESSAMQQEWTLVSAALALLNQMVSKIARRIKS

SEQ ID NO: 921 - protein, 391 aa, Chlamydia pneumoniae
NIMHPKIEKRNSLPLTAVAPVFEESYHPSVATTVDYVDATTLSRHLTVLKDVIKEARNLDLGKAFLTSMKQGFINTGTELAIIQASLADQSSRESRKKEEKIFHQHLGKAAPQAATATSGVQPTADPVADKMPLQSAFAYVLLDKYIPAQEEALYALGRELNLSGYAQNLFSPLLDMIKSFNSAPINYNLGSYISQTSGTANFAYGYEMILSRYNNEVSQCRLDIASTVKAKAALANMSASVKANVSLTDAQKKQIEDIIASYTKSLDVIHTQLTDVMTNLASITFVPGLNKYDPSYRIVGGDLSIIALQNDEKVLVDGKVDITTAVNEGGLLNFFTTVLTDVQNYGDLAQTQQLMLDLELKAMQQQWSLVSASLKLLNGMYTTVISGFKN

SEQ ID NO: 922 - protein, 348 aa, Chlamydia pneumoniae
GPFDMNSKMLKHLRLATLSFSMFFGIVSSPAVYALGAGNPAAPVLPGVNPEQTGWCAFQLCNSYDLFAALAGSLKFGFYGDYVFSESAHITNVPVITSVTTSGTGTTPTITSTTKNVDFDLNNSSISSSCVFATIALQETSPAAIPLLDIAFTARVGGLKQYYRLPLNAYRDFTSNPLNAESEVTDGLIEVQSDYGIVWGLSLQKVLWKDGVSFVGVSADYRHGSSPINYIIVYNKANPEIYFDATDGNLSYKEWSASIGISTYLNDYVLPYASVSIGNTSRKAPSDSFTELEKQFTNFKFKIRKITNFDRVNFCFGTTCCISNNFYYSVEGRWGYQRAINITSGLQF

SEQ ID NO: 923 - protein, 334 aa, Chlamydia pneumoniae
MKQHIGYLGMGIWGFCLASLLANKGYPVVAWSRNPDLIKQLQEERRHPLAPNVVISPNLSFTTDMKEAIHNAFMIVEGVTSAGIRPVAEQLKQITDLSVPFVITSKGIEQNTGLLLSEIMLEVLGDSVTPYLGYLSGPSIAKEVLNGSPCSVVVSAYDSQTLKQIHEAFSLPTFRVYPNTDIKGAALGGALKNVIAIACGIAEGLSFGNNAKAGLVTRGLHEMRKLAAIMDCKPETLNGLAGLGDLCVTCFSESSRNLRFGHLLAQGLTFEQAKAKIGMVVEGAYTALSAYQVAKHHKIDMPITTGIYRVLYENLDLKEGIALLLQRNTKEEFL

SEQ ID NO: 924 - protein, 461 aa, Chlamydia pneumoniae
MTESVYSPSAMHVNSLADKLKAINQEHILDIWPSLSPKQQQRLFQQLTSVDIDFFRKQQQLLSSPTAILKDFHPITSFASSGEDPERAHAGTTLLKEKKVACVVLAGGQGSRLKCDGPKGLFPVSPIKKKPLFQLVAEKVRAASKLAGQPLPLAFMTSPLNTRQTRSFFESNDYFHLDPNQVDFFCQPLWPLLTLSGDLFLEDMDTLALGPNGNGCIATLLYTSGVWEKWKNAGIEMVSVIPIDNPLALPFDVELCGFHAMSNNEVTIKAALRQTAIEDVGILVKSHDSGKTSVIEYSEIPQNERFALNEDGKLKYCLANIGLYCLSMDFIRHAAYQQLPLYKVHKHAKQLGHTSLNEKNAWKFEEFIFDLFCYSDHCQTLVYPRQECFAPLKNLEGNHSPDTVRQALSDRERQLFHKVTGKKLSPNTTFELEADFYYPSTSTSLHWENKAFFEEPFFEAS

SEQ ID NO: 925 - protein, 433 aa, Chlamydia pneumoniae
MNHLNKEKLHIHNWQPYRACGLLSKVSGNLIEVDGLSACLGELCKISSTKDPNLLAEVIGFHNHTTLLMSLSPLHSVALGTEVLPLRRPPSLHLSDHLLGRVLDAFGNPIDKKEDLPKTHRKPLLSLPPSPMMRQPIDQIFPTGIKAIDAFLTLGKGQRIGVFSEPGSGKSSLLSAIALGSKSTINVIALIGERGREVREHIEKHSNALKQQRTIIIAAPAHETAPTKVIAGRAAMTIAEYFREQGHEVLFIMDSLSRWIAALQEVALARGETLSAHQYAASVFHHVSEFTERAGNNDKGSITALYAILYYPKHPDIFTDYLKSLLDGHFFLTSQGKALASPPIDILSSLSRSAQALALPHHYAAAERLRSLLKVYNEALDIIHLGAYTPGQDEELDKAVKLLPSIKAFLAQPLSSYCYLDNTLKQLEALADS

SEQ ID NO: 926 - protein, 91 aa, Chlamydia pneumoniae
MIHAVKTESRWSSSSLISCLRIPLGVSILNPDRLQEVSGKNSACLIMGSSWVEIQSVSVLRSSGWRNTLMGVRDLNVVCLWSAVERSRASS

SEQ ID NO: 927 - protein, 266 aa, Chlamydia pneumoniae
MTLPLEPMIFWSSLSAKVMKKFLTPHCAGTFSEEDAEAKEAHLVTGKQGHRLMGNCVTFYWLVDKKNGVILDAKFQYFGHPYLIPLAEAVCNLVCGKSYSEAYKMTLDDIDKSLRVHAHQPALPEDSISLYHFVIDALDTAVEQCLEIPLEDGSLPLQNSPMNLDFEDANPYSQSDWEALTHEQKLYALRATIAEKIGPYIAMDGGEVTVESLENFIVTIAYSGNCSGCPSSLGSTLNSIGQLLRAYIYPELQVKVDESSLNLSHP

SEQ ID NO: 928 - protein, 401 aa, Chlamydia pneumoniae
GRGTIFRITDGKTSCISMEKPQNRKAPRIFWLNNQVAIPPSERVKESYALHSDIFSLPPGSALKLAEKTEESIRQLVGLKDSHIFRFVPHFPHVVHIVLAALVENLSMFQGRNHIILPAHDQQLLINSLCRHQGLGTTYDWVTVNHEGRIVEEQLIETLSPRSLLFSLSAAHGLTGVIQPLDPLLSLCKDRRILLHLDISDILGRAPLTPEILNADIITFSSAALGGMGSIGGIFIRKSLERVFSSWFPPHTSASLCFSAVAAMQTACEERISALPLFTFHTSNLCKKLIQELQSVLPSIQLAFSEVQNRLPNIVVAAIPDIPAESLAFHLHQQGIYPSLGYERFQPLAQVLQNCGISPFLCHSALHFSLTERSKDLEFSKLARAMHDAIKHLTPLLGSSS

SEQ ID NO: 929 - protein, 228 aa, Chlamydia pneumoniae
MALLILLRHGQSVWNEKNLFSGWVDIPLSQQGIEEAFSAGRAIQNLPIDCIFTSTLVRSLMTALLAMTNHHSKKIPYIVHEDPKAKEMSRIYSAEEENNMIPLYQSSALNERMYGELQGKNKKQTAEQFGEERVKLWRRSYKTAPPQGESLYDTKQRTLPYFEKNILPQLQNGKNVFVSAHGNSLRSLIMDLEKLSEEEVLSLELPTGKPVVYQWKNHKIEKHPEFFG

SEQ ID NO: 930 - protein, 235 aa, Chlamydia pneumoniae
VTKVRLNKFLASAGVASRRKCDEIIFSGSVTVNGRVAEGPFVLVDPEDKVQVGGTSVHLTKKVYFMVHKAIGYLCSSEKKFPGTKLVIDLFAHLPYRVFTVGRLDKETSGLILVTNDGEFANKIIHPSSGITKEYLLKVSRDVSAKDLGKLMEGTFIDGKHVRPVSVTKIRRGTVKIVVSEGKKHEIRLFADAAGLPILELKRIRIGSLVLGGLRYGEYRELTDAELGTYMKLSD

SEQ ID NO: 931 - protein, 193 aa, Chlamydia pneumoniae
NMKVIYYEIEEIPSTNTMAKSYMHLWDPYALTVISTKCQTAGTGKFGKSWKSSKGDLLNTFCFFITDLHIDVSRLFRLGTEAVVALCKDLGITEAKIKWPNDVLVHGEKLCGVLPETLPVEGLLGVVLGIGLNGNTTKQALKDVGQPATSLQEILGHPIDLETTRELLIHHLLGVLQENLPDSLATKSNRGNI

SEQ ID NO: 932 - protein, 421 aa, Chlamydia pneumoniae
CIRIPQMHIGFCHCVRGGNFFYFVINNFHILEIYSLLNSNTIMRYHKYFRYVNSWVFLVVLTLMLLSVVVISSMDPTAMLVTSSKGLLTNKSIMQLRHFALGWVVFFICAYFDYHLFKRWAWVLYFFMICALVGLFFVPSVQNVHRWYRIPFIHMSVQPSEYGKLVIVIMLSYILESRKADITSKTTAFLACLVVALPFFLILKEPDLGTALVLCPVTLTIFYLSNVHSLLVKFCTVVATIGIIGSLLIFSGIVSHQKVKPYALKVIKEYQYERLSPSNHHQRASLISIGLGGIRGRGWKTGEFAGRGWLPYGYTDSVFSALGEEFGLLGLLFTLGLFYCLICFGCRTVAVATDDFGKLLAAGITVYLAMHVLINISMMCGLLPITGVPLILISYGGSSVISTMASLGVLQSIYSHRFAKY

SEQ ID NO: 933 - protein, 392 aa, Chlamydia pneumoniae
  SITE 1...392: Xaa=unknown or other
IFFSICSLYFCNCLWNCPFGSFIYFHSIVRTSECILPCPSVSYCSVSVCFDHCDSYCLFKCYQCLCETWGSXERRCVLDRLVSCNSVVMDKTGTLTTGELTCIGCDYFGSKNETFFPSVLALEQSSSHPIAEAIVSYLMEQKVSSLPADRYLTVPGEGVRGYFNEQEAFVGRVETGLGKVPSEYLEDIEQKIYQAKQHGEICSLAYVGNSFALFYFRDIPRPQAKEIIQDLKDLGYPVSMLTGDHKVSAENTAEILGISEVFFDLTPEDKLAKIRELATQRQIMMVGDGINDAPALAQATVGIAMGEAGSATAIEAADIVLLHDSLSSLPWIIQKAKQTKKVVSQNLALALAIILLVSWPASLGIIPLWLAVILHEGSTVIVGLNALRLLKS

SEQ ID NO: 934 - protein, 373 aa, Chlamydia pneumoniae
  SITE 1...373: Xaa=unknown or other
NFRNGLGVRDLHHFREYYLIINEIIITGRYVFSRLFFTSFSAEVVNTFFESGMSEDTSPLLSKQNRKLSHNLPLKSAYLSLGTYLIALLSFWLHAKNLSNLFVVFTFFLAGTPALIKSLVNICQKVVNIDILMTSAPFGSIFIGGALEGALLLVLFAISEALGQMVSGKAKSTLVSLKQLAPTTGWLVLEDGNLQKVAINKIEVGNILRIKSGEVVPLDGEILHGSSSINLMHLTGEKVPKSCHPGSIVPAGAHNMEGSFDLRVLRTGSDSTIAHIINLVIQAQNSKPRLQQRLDKYSSVYALSIFAIACGIALLVPLFTSIPLLGPQSAFYRALAFLIAASPCALIIAIPIAYLSAINACAKHGVLXKGGVF

SEQ ID NO: 935 - protein, 274 aa, Chlamydia pneumoniae
EGWRFFFPKTSENTSDCRQHQILRKIMTQDPHDHFKSRTPEDHIKHVRDKHRVCKGEPHTTFKGFFYHLANNALSTGVFIFFIRTLFFLIPTNRALQVKSLISLGVGWTFYHGCLKARKAWAYMELSHRSMLEEKNEIEENFEQEKIELRILFENQGFKDPLLQEMVEYVCSDSTLLLDTMIREELYIRKEDLPHPLIQGGSRILGGLCGLAIFLPLVLCISYTLAGVFSALMVLVLSFLKAKILKNDKISEMVWVLGIFITSASIISSLMKLL

SEQ ID NO: 936 - protein, 466 aa, Chlamydia pneumoniae
  SITE 1...466: Xaa=unknown or other
VILPFSPISIARRIKKSCCSEKSSIYSHFCTLLLNNETSMLDIKIIRKTPEECETRLRKKDPKISLEPVLSLDKEVRQLKTDSETLQAQRRLLSQDIHKAKTQGVDATNLIQEVETLAADLEKIEQHLDQKNAQLHELLSHLPNYPADDIPVSEDKAGNQVIKSVGDLPIFSFPPKHHLELNQELDILDFQAAAKTTGSGWPAYKNRGVLLEWALLTYMLQKQAAHGFQLWLPPLLVKKEILFGSGQIPKFDGQYYRVEDGEQYLYLIPTAEVVLNGFRSQDILTEKELPLYYAACTPCFRREAGAAGAQERGLVRVHQFHKVEMFAFTTPNQDDIAYEKMLSIVEEMLTELKLPYRLSLLSTGDMSFTXSKTIDAEVWLPGQKAFYEVSSISQCTDFQSRRSGTRYKDSQGKLQFVHTLNGSGLATPRLLVAILENNQQADGSVVIPEVLRPYLGGLEILLPKDQ

SEQ ID NO: 937 - protein, 376 aa, Chlamydia pneumoniae
MEDFSEQQLFFMRRAIEIGEKGRITAPPNPWVGCVVVQENRIIGEGFHAYAGGPHAEELAIQNASMPISGSDVYVSLEPCSHFGSCPPCANLLIKHKVSRVFVALVDPDPKVAGQGIAMLRQAGIQVYVGIGESEAQASLQPYLYQRTHNFPWTILKSAASVDGQVADSQGKSQWITCPEARHDVGKLRAESQAILVGSRTVLSDDPWLTARQPQGMLYPKQPLRVVLDSRGSVPPTSKVFDKTSPTLYVTTERCPENYIKVLDSLDVPVLLTESTPSGVDLHKVYEYLAQKKILQVLVEGGTTLHTSLLKERFVNSLVLYSGPMILGDQKRPLVGVLGNLLESASPLTLKSSQILGNSLKVVWEISPQVFEPIRN

SEQ ID NO: 938 - protein, 418 aa, Chlamydia pneumoniae
  SITE 1...418: Xaa=unknown or other
MIETREEVGSANFVSLERAIEDLRAGKFVIVVDEASREDEGDLIIAGEKITVEKMTFLLQHTTGVVCAALSQERLLSLDLPPMVKDNRCRFKTPFTVSVDAAHGVTTGVSAADRTKVVQLLADPKSKPEDFISPGHFFPLASSPGGVLKRAGHTESTVDLMELAGLQPCGVLAELVNEDYSMMRLPQILEFARKHNIAVIPVTSIIAHRMLSDRLVSKISSARLPTIYGDFTIHVYESLLEGMQHLALVKGNVAGKSNVLVRVHSECVTGDILGSKRCDCGEQLSSAMSYIAEKGTGVLVYLRGQEGRGIGLGHKVRAYALQDNGYDTVDANLAMGFPVDSREYGIGAQIXIDLXLTTIKLITHNPQKYFGLQGFGLSITERVPLPVRISEDNEQYLRTKQERMGHWLDLPCCNNRVQ

SEQ ID NO: 939 - protein, 154 aa, Chlamydia pneumoniae
MKTLKGHLSAKNLRIAIVGSCFNQAMADALVSGTQETFLKFGGSEDGLMTIRVPGAFEIPCTIKKLLSSERKFDAIVACGVLIQGETDHYNQIVNQVAAGIGALSLEFCLPITLSIVAAPSAEIAWQRSGIKGRHLGVSGMTTAIEMATLFTQI

SEQ ID NO: 940 - protein, 472 aa, Chlamydia pneumoniae
LISLNLKILTKQRDREEASMLKILKIKVLVFPLALLMGCNSIGYAGPQGSLQTNSQTKVKIGSEVWIEQKLRQYPELLWLTESGGAPLLTSTPIDMAYSEKLFNKKVPALDIAIRSMIHLHLLIQGSRQSYMQLSQILPSEEGGMTFKQFQTAHKQLLFFLNSPKSFDNTLRILETAIVLRHVGCSAKAVTTFKPYFTDSCPQSFYAKALHVLRTFPELCPSYARLSPEQQEVLLSLRRLGNYDSLLNLTEVPSAQLLSAWRTRRSLAILDLYLYCLDTCGDKNCSQEFYINFAPLLSMLQQHATIEEAFSRYFTYRANRLGFEGTSRTDMTLVRLATLMNLSPSEASTLAWSFKNLPSDEAENLVNSFYTVQGEHIPLTFRGLPSLVAGLSVATHGSTVSPENRLRQLYSTMLSLLVKSLRSHREMLNKQLLPQGTVLDFSETTLSSGGLDVFAESIAVRIHLNGAVSINL

SEQ ID NO: 941 - protein, 220 aa, Chlamydia pneumoniae
LKIMKRVIYKTIFCGLTLLTSLSSCSLDPKGYNLETKNSRDLNQESVILKENRETPSLVKRLSRRSRRLFARRDQTQKDTLQVQANFKTYAEKISEQDERDLSFVVSSAAEKSSISLALSQGEIKDALYRIREVHPLALIEALAENPALIEGMKKMQGRDWIWNLFLTQLSEVFSQAWSQGVISEEDIAAFASTLGLDSGTVASIVQGERWPELVDIVIT

SEQ ID NO: 942 - protein, 385 aa, Chlamydia pneumoniae
QEILAREISPECCRLSLWRSRRPGLGLLAALLGAIVQYAGSYLGSKYRKPEGNTGEFIGGPIACLAFGMRKKILAGFFALFTIMTAFCAGNCVQVSCIVPLCAEGTPGKLLVGILLALVVIPVLAGGNNRILRFSARVIPFIAGFYCISCGIILFQHASAILPAIKLICSSAFGIKAGLAGIGGYTLSQVISTGINRAVMATDCGSGMVSILQANTKSKNPVVDGLVTLVPPVIVMVVCSITMLVLIVSGAYSSGAQGTLMVMSAFKNSLGSLGSVIVILAMALFGYTTILTWFACAEKSLQYMIPGRRANLWLKAIYVLIIPLGGVIDMRMIWALSDTGFSGMVILNCIALIALLKDVLSTNRDVALLKERECSVADPVRNLDA

SEQ ID NO: 943 - protein, 110 aa, Chlamydia pneumoniae
RRRIMQLLSPAFAYGAPIPKKYTCQGAGISPPLTFVDVPGAAQSLALIVEDPDVPKEIRSDGLWIHWIVYNLSTTITNLAEGAEIFAVQGLNTSGKPVYEGPCPPDKQHR

SEQ ID NO: 944 - protein, 223 aa, Chlamydia pneumoniae
GCMSTVTTEPCSSIHISLNNDWRDSQPYSLDRASELLHFRFLPSLVFSNWKVEQQIETLCHKSEKRRLISPLAKWLGKLHKQDLLCPPAPPVSVCWINAHVGYGVFARDEIAPWTYIGEYTGILRHRQAIWMDENDYCFRYPMPLFTLRYFTIDSGKQGNVTRFINHSEQPNAEAIGVFSEGLFHVIIRTIAPIYAGQEICYHYGPLYWKHRKKREEFIPEEE

SEQ ID NO: 945 - protein, 265 aa, Chlamydia pneumoniae
MQGFFPLASGSKGNSAYLGTDSCKILIDLGVSKQVVTRELLSMNIDPEDIQAIFVTHEHSDHISGIKSFVKAYNTPIVCNLETARALCHLLDSHPEFKIFSTGSSFCFQDLEVQTFNVPHDAVDPVAFIFHYREEKLGFCTDLGWVTSWITHELYDCDYLLIESNHSPELVRQSQRPDVYKKRVLSKLGHISNQECGQLLQKIITPKLKKLYLAHLSTECNTAELALSTVSESIASITSIAPEIALAQGITSPIYFSRLEVACPR

SEQ ID NO: 946 - protein, 553 aa, Chlamydia pneumoniae
DGSISPLPQEEIPGSKKESFFLTPHPCKRFLTKFVEPQENKAKEGKTIALSSTPTVVRESKGKERAALPKLKSLAVPENDLPQYHLLSKNREARPESLQAELERKALILKQTLTSFGIDADLGNICSGPTLAAFEVLPHSGVKVQKIKSLENDIALKLQASSIRIIAPIPGKAAVGIEIPTPFPQAVNFRDLLEDYQKTNRKLQIPLLLGKKANGDNLWADLATMPHLIIAGTTGSGKSVCINTIVMSMIMTTLPSEIKLVIIDPKKVELTGYSQLPHMLSPVITESREVYNALVWLVKEMESRYEILRYLGLRNIQAFNSRTRNKTIEASYDREIRETMPFMVGIIDELSDLLLSSSQDIETPIIRLAQMARAVGIHLILATQRPSREVITGLIKANFPSRISFKVSNKVNSQIIIDEPGAENLMGNGDMLVLLPSVFGTIRAQGAYICDEDINKVIQDLCSRFPTQYVIPSFHAFDDSDSDNSGEKDPLFAQAKTLILQTGNASTTFLQRKLKIGYARAASLIDQLEEARIIGPSEGAKPRQILIQNPLEG

SEQ ID NO: 947 - protein, 218 aa, Chlamydia pneumoniae
  SITE 1...218: Xaa=unknown or other
PMIRERKKSRHPRLPTLPLAAKASLYLFFACFSGLSLWSFHRDQPCTQNWIGLLGWSFSSFLLYFFGAAAFFIPXYFLWLSFLYFRRTPRPLFFYKAAAFLSLPFCSAILLSMLSPVGTLPALLDTRLPKFILGNIPPVSYVGGIPFYLFYEGQSFCLKHLIGSVGTALIFGFVMLFSVLYLCGRHCFIKKKXLSRRGQKGFLLFFPNLFQKFKKINK

SEQ ID NO: 948 - protein, 162 aa, Chlamydia pneumoniae
KTSNNTQKNLLLIKSAESSSLQLSLASSAISSRVEQLSSLVLGMENSDFSSLRDVPIFSAIYESSTHTPVPTPLVGVGYINGSQSGYYDTQRESLHLSQLLGSRRVEVVYNQGNFMEASLLNLCPRRPRRDPSPISLALLELWEAFFLEHPPGSTFNPIFFW

SEQ ID NO: 949 - protein, 127 aa, Chlamydia pneumoniae
TRSKKSQSCLKSMAGFRLQSLQILYRRIGSLYLQKHDNKRSEDVLDIEKDRYQRALYSVHAELGGELREHRKLRYQKNIGLKVLPGGCSKKNASQSSNRAKEIGEGSLRGLLGHRFSKEASMKFPWL

SEQ ID NO: 950 - protein, 412 aa, Chlamydia pneumoniae
NTPQVALLIQYFFGNGAFYVREALRLTPHAQNIVLVGICPSLYPEHPRSFYYRVSGDIGSRFDDRGFVNSGVETLPYSSGSFGIFWISFTDPTFNFAIVNTFMRTAGINEVSRPMTQDTETSLIEMRDLSEQQEANNTDSLEQEESLMGIVGHTVGGVSMTVTSSPNIFYRIQTLLGLPETLAEAEENPTFPNSTIDSLAEIMMNLVRISDAVSIFWIFPIVDTTYNGVLLAVCIGFFGINGICSTFLMLTNPRSRRDRWRNLRIMVLCYRSLGSGMNLFDLSNNVRMAARRHVTSCTVALYAMVTLFGWTVAIQDALQYGFPSVRDAFYRYCLRHRYCLTQRNEDSLQTTGTRFQVTRTHLEDQQMVASILNLSVFGLFFGFVGLMTTFGGLEISPSCRWDAANNRTVGIF

SEQ ID NO: 951 - protein, 117 aa, Chlamydia pneumoniae
KIFGLEVTVMETPPTVCPTIPIKLSSCSKESVLFASCCSLRSLISINEVSVSCVMGLETSLIPAVRIKVFTIAKLNVGSVNEIQKIPKLPEEYGRVSTPEFTNPLSSNREPISPETR

SEQ ID NO: 952 - protein, 431 aa, Chlamydia pneumoniae
MTWLSGLYFICIASLIFCAIGVILAGVILLSRKLFIKVHPCKLKINDNEELTKTVESGQTLLVSLLSSGIPIPSPCGGKATCKQCKVRVVKNADEPLETDRSTFSKRQLEEGWRLSCQCKVQHDMSLEIEERYLNASSWEGTVISNDNVATFIKELVVAVDPNKPIPFKPGGYLQITVPSYKTNSSDWKQTMAPEYYSDWEHFHLFDQVIDNSQLPADSANKAYSLASYPAELPTIKFNIRIATPPFINGKPNSEIPWGVCSSYVFSLKPGDKITVSGPYGESFMKDDDRPLIFLIGGAGSSFGRSHILDLLLNKHSKREIDLWYGARSLKENIYQEEYENLERQFPNFHYHLVLSEPLPEDIAAGWDKDDPTKTNFLFRAFNLGQLSRLDNPEDYLYYVCGPPLHNSSILKLLGDYGVERSSIILDDFGS

SEQ ID NO: 953 - protein, 106 aa, Chlamydia pneumoniae
LLSSLPLFAEEEAAQSKNTFVQPAVMLAIAILFFYFILWRPEQKRRKAMEKRKNDLAKGDKVTAMGIIGTVDDIREHTVILNIASGKVEVLKGAISEILKPNDNKS

SEQ ID NO: 954 - protein, 401 aa, Chlamydia pneumoniae
MSTMQNCPHFGVCGGCSFPQSNYSDSLKKKEELLHQLFAPLVPSDMIAPIIPCSPSLRGRNKMEFSFFQTYEGEKSLGFISSTKPKKGIPVTTCLLIHEQTMDILKLTREWWDKHPELMAYFPPKNKGSLCTLTVRTGSPQQNFMVILTTSGTPEYRVNEACIDEWKEILLSSSLNIASIYWEEKVAARGISTYYETKLLYGAPSIQQKLSLPSDGNSASFSLRPRSFFQPQITQAAKIIETAKEFINPEGSETLLDLYCGAGTIGIMLSPYVKNVIGVEIIPDAVASAQENIKANNKEDCVEVYLEDAKAFCKRNENCKAPDVIIIDPPRCGMQSKVLKYILRIGSPKIVYISCNPKTQFQECADLISGGYRIKKMQPIDQFPYSTHLENIILLEREIDL

SEQ ID NO: 955 - protein, 123 aa, Chlamydia pneumoniae
MALKDTAKKMKDLLDSIQHDLAKAEKGNKAAAQRVRTDSIKLEKVAKLYRKESIKAEKSGLLKRKPSTKAPAKVKKTAEKKAPKKSSAAAAKTSKAVKASKPASKKTAAKKVKKPSKARGFRK

SEQ ID NO: 956 - protein, 822 aa, Chlamydia pneumoniae
MKKLYHPTLFLRPLIRLSLIFALSLTLISGNFPQQKSFGHCCADMHSALISGKNCEELFADFIERVLADRETLTARDWGTVVVLVREYLLKCIRKGDCDYGVKILQKLLALRLPKDARKDLQILWHRLNPEQAPLRDVVDQLFTIGCHESLQDHLLFELYTVTLHSGYENRKQDMLLAKEQGDYKKAIELAKELVAALEKGSCSPHPEIVQIEKTFLQKTLLALQIKVAQEAQESCDALLTPYCLSEIAYTEAMDALVLRIARGEVSRTNEVDSVLLSHALQHLPFAREKAIPELEVLIDHGAYLESTLLYYAYFSLLELYHQNKDFASLERLLEKGDAVFVPEHPYFPEYGFFLGAYFYAKGKYESAEKVFLQIIDPAVKLGATFARAYEYLGCIAYVQNHYEKAEEYFLRAYKSWGREESGIGLFLAYAVQKKKTACEDMLYHPKFSFTYRHLLDSLCSLSYPHGENKGSSAIQRVHRAVPELSEIYSRCIYDMIKYRNVTYTHPIIELAYNQVRNLEKRNLEEICRDAQDPEYDKALAFWGALQSGASVPRSLIESSDVDEAGITIRCYEALYFHNPDAIAMLPQAFSEECNSWQTALRLVWTLVRPKGAPNHAKYWDHLVLRPHGDSLYFFGYDLQEYLIGKEDALKHLSVFAELFPKSSLLSLVYYLQGYSESSALRKVGWFVKALEEFTEISWSGEHMKTWAYIYYMVKLDLADTYISLGNFSQAVHILEEVKEDWQVASHPKLHFLKGEDCYLAMELRWVEGLAYAYFQLHETAHLSNHLLEHVEKNLISPRSYRDYYGESLQRTLGLCQRFLGV

SEQ ID NO: 957 - protein, 150 aa, Chlamydia pneumoniae
HQLRLASRQLFASQRLWHAICRRASPLGNRLEFSNLPASTPGKTVLSLLIEGKWRESEAHAFAIAALSEYLNINQKPDAFALFSSQDGMPQHAVGFLERKERILPHLPGNLKIVGQNIAGPGLNRCIASAYHAICDLHTEETLAQPQSSL

SEQ ID NO: 958 - protein, 354 aa, Chlamydia pneumoniae
AERRFCVKRAIIIGAGISGLAAGWWLHKKFPQAEILVLDKEAYAGGFVRTESPQGFSFDLGPKGFLTRGDGEYTLKLIHELGLQNSLIFSDRAAKNRFVYYRGKARKISTWTLLRKGLLPSLIKDFRAPCYTQDSSVQDFLKRHSSQNFTSYILDPLITAIRAGHSSILSTHMAFPELAKREASSGSLLRSYLKNRSPKKSKTDRYLASLSPSMGTLITTIQEKLPATWKFSTSVTHIDCSPKEACVTTPSETFFADMVIYTGPLQQLPVLLPNYGIENLSKRVLPWNLSSISLGWHHANFSLPKGYGMLFADELPLLGIVWNSQIFPQVRQGKQCSPFSLKANGGNQKLMPLR

SEQ ID NO: 959 - protein, 460 aa, Chlamydia pneumoniae
  SITE 1...460: Xaa=unknown or other
FLMFNVNFKFLEGLHQPAPRYTSYPTALEWEPSDAAPALLAFQRXRXNXQPLSLYFHIPFCQSMCLYCGCSVVLNRREDIVEAYINTLIQEMKLVVETIGFRPQVSRIHFGGGTPSRLSRELFTLLFDHIHKLFDLSHAEEIAIEVDPRSLRNDMEKADFFQNVGFNRVSLGVQDTQADVQEAVRRRQSHEESLKAYEKFKELAFQSINIDLIYGLPKQTKESFSKTIQDILAMYPDRLALFSFASVPWIKPHQKAMKASDMPSMEEKFAIYSQSRHLLTKAGYQAIGMDHFSLPHDPLTLAFKNKTLIRNFQGYSLPPEEDLLGLGMTSTSFIRGIYLQNAKTLEEYHNTVLRGTFATVKSKILTEDDRIRKWAIHKLMCTFTINKEEFFNLFGYEFDTYFIESRDRLISMETTGLIHNSPGSLKVTPLGELFVRVIATAFDHYFLNKVSKKECFSASI

SEQ ID NO: 960 - protein, 281 aa, Chlamydia pneumoniae
SYCRATLLGPSLLHVDAAILFADILSILDGFAVTYDFAPGPRIQFSPEQPFTFTSDPQTIFSYLLDAIRTLKQKLPVPLIVFAASPFTLACYLIDGGASKDFSKTMSFLYVYPEKFDQLISTIIEGTAIYLKTQMDAGAAAVQLFESSSLRLPSALFTRYVTEPNRRLIAKLKEQAIPVSLFCRCFEENFYTLQATQADTLHPDYHVDLHRIQKNLMLSLQGNLDPAIFLLPQEKLLHYVEAFLVPLRTYPNFIFNSGHGILPETPLENVQLVVSYVQRQL

SEQ ID NO: 961 - protein, 1085 aa, Chlamydia pneumoniae
MAMDFNPVNLDFSISKEFKEETLPLLLENIHPGATAFLAAKMFHDCRASVIMITTPARLDDLFENLRTFLDQAPVEFPSSEIDLSPKLVNIDAVGKRDHLLYSLNQHRAPIFCVTTLKALLEKTRSPQATSQQHLDLAVGDVLDPEATTELCKSLGYSQVMLTSEKGEFSCRGGIVDIFPLSSPEPFRIEFWGEKIISIRSYNPSDQLSTGKVSKISISPAYTEEASGGNYSHSLLDYFSTPPLYLFDNLEILEDDFADISGTLSSLPDRFFSIGTLYDRISTSNQVYFSETPFPNVKNLKENRVIIEAFHRNMEASRQAIPILYPEQIIQNDENPLLAFLQHLQEYMPPHGKPLKLAIYSTKTKSLKEARALAETVARGDVEIYEKTGNLTSSFALVNEAFAAISLSEFASTKVLRRQKQRTHFSVTTEEVFVPIPGETVVHIHNGIGKFLGIEKKPNHLNIETDYLVLEYADKARLYVPSNQAYLISRYVGTSDKAADLHHLNSSKWKRSRDLTEKSLIVYAEKLLQLEAQRSTTPAFVYPPHGESVIKFAETFPYEETPDQLKTIDQIYNDMMSPKLMDRLICGDAGFGKTEVIMRAAVKAVCDGHRQVIVMVPTTILATQHYETFKERMAGLPIEIAVLSRFSQAKVQKLICEQVASGQIDIIIGTHKLINKSLEFKNPGLLIIDEEQRFGVKVKDNLKERYPMIDCLTVSATPIPRTLHMSLSGARDLSVIAMPPLDRLPVSTFVMEHNTETLTAALRHELLRGGQAYVIHNRIESIYTLAETIRNLIPEARIGVAHGQMGAEDLSNIFTKFKNQKTDILVATALIENGIDIPNANTILIDHADKFGMADLYQMKGRVGRWNKKAYCYFLVPHLDRLSGPAAKRLAALNKQEYGGGMKIALHDLEIRGAGNILGTDQSGHIGTIGFNLYCKLLKKAVSALKKHTSPLLFNDDVKIEFPYNSRIPDTYIETGSMRIEFYQKIGNAESSEELTAIQEEMRDRFGPLPQEICWLFALAEIRLFALQHGISSIKGTANALYVQKCLSKSEQTKKTLPYALSPTPELLVKEVIESIERGFLINAS

SEQ ID NO: 962 - protein, 182 aa, Chlamydia pneumoniae
GGHWRKSRSYSTPTKRSIRRDCTLLQVPRDQIVSRLTATLDERKQQDKRLNELENSLIQTKLDKLIHNCHQRQGITCLVHHLAEHENHRLQQYAQCLHQRIPEKLISLWTTEKNGKYIVLSRVSDDLITQGVHAQDLLKAVLTPCGGRWGGKDQSAQGSAPALPATEVLNETLWQWISTQLI

SEQ ID NO: 963 - protein, 482 aa, Chlamydia pneumoniae
SGCVARLIAKTEQLSGKVYHPDDSGAAFRVIADHVRSLSFAIADGLLPGNTERGYVLRKILRRSVNYGRRLGFRNPFLAEIVPSLADAMGEAYPELKNSLSQIQKVLTLEEESFFKTLDRGGNLLQQVLKSSSSSSCISGEDAFKLKDTYGMPIDEISLLAKDYDYSVDMDTFHKLEQEAKERSRKNVVQSQGTSESIYNELHLTSEFIGYDHLSCDTFIEAIISKDHIVSSLQEKQEGAIVLKVSPFYAEKGGQVGDSGEIFCSEGTFIVTHTTSPKAGLIVHHGRISQGSLTVEAAVTAQVNRYRRKRIANNHTACHLLHKALEITLGDHIRQAGSYVDDTKIRLDFTHPQAISPEDLLCIETLVNESIRENEPVDIREALYSDVMNSSEIKQFFGDKYSDVVRVVSAGHSHELCGGTHAEATGDIGFFRITKEHAVAMGIRRIEAVTGEKAEATVHQQSEVLEEIVRYYKSLGIRLSPG

SEQ ID NO: 964 - protein, 129 aa, Chlamydia pneumoniae
SRRIYATVHEKDDEAFALWEAYLPTDRIFRLTDKDNFWSMANTGPCGYCSELLFDRGPSFGNASSPLDDTDGERFLEYWNLVFMEFNRTSEGSLLALPNKHVDTGAGLERLVSLIAGTHTVFEADVLRD

SEQ ID NO: 965 - protein, 195 aa, Chlamydia pneumoniae
MLSNTIRSNFLKFYANRHHTILPSSPVFPHNDPSILFTNAGMNQFKDIFLNKEKVSYSRATTSQKCIRAGGKHNDLDNVGHTSRHLTFFEMLGNFSFGDYFKAEAIAFAWEVSLSVFNFNPEGFTLPYMKKTMKHLLFGKHIFLQIVFSVLQTKTTSGAWQTQAPVAIVPSSSLIVAPVLETPLLPLTILMESVS

SEQ ID NO: 966 - protein, 692 aa, Chlamydia pneumoniae
LGISYSCCFYIEGLQGLLMINKELDIGILGKIAGAIKQISIESIQKASSGHPGLPLGCAELAAYLYGYVLRQNPRDPHWINRDRFVLSAGHGSALLYSCLHLAGFDVSLEDLQEFRQLHSRTPGHPEYGETVGVEATTGPLGQGLGNAVGMALSMKMLESRFNRPGHEIFNGKIYCLAGDGCFMEGVSHEVCSFAGSLNLNNLVVIYDYNNVVLDGYLNEISVEDTKKRFEAYGWEYYEIDGYDFTHIHETFSSIKRGQERPVLVIAHTIIGHGSPKEGTNKAHGSPLGVEGTHETKQFWHLPEEKFFVPPAVKNFFAHKIQEDRKAQEQWLDEVRVWSKQFPELHEEFVALTSHKLPKNLESLVQSVEMPDSIAGRAASNKLIQVLVQHIPYLIGGSADLSSSDGTWIANEKVIHTYDFSGRNIKYGVREFGMATIMNGLAYSQVFRPFGGTFLVFSDYMRNAIRLAALSKLPVIYQFTHDSIFVGEDGPTHQPVEQLMSLRAIPGLYVIRPADANEVRGAWIAGLKHTGPTVIVLSRQALPTLPAAHRPFKDGVGRGAYIVLKESGEKPDYTLFATGSEVSLALSVAKELEHLDKQVRVVSFPCWELFEAQDVDYKQSIVGGDLGIRVSIEAGSALGWYKYIGSEGLLSLWIDSDTQELLMMYQKNVALLQSKSFRGFSLNSHCRKFQSR

SEQ ID NO: 967 - protein, 312 aa, Chlamydia pneumoniae
PRNDKNAKNLRRKHYKGERVSKHTSESRIAQDMLERYSGSSVKQFCPYLLLTNFSYYIQTFAKLHGVPVFEGSMFSAAHAPHLKTSILDFKLGSPGAALTIDLCSFLPDLKAALMLGMCGGLRSHYQVGDYFVPVASIRGEGTSDAYFPPEVPALANFVVQKATTEVLEDKKANYHIGITHTTNIRFWEFNKKFRKKLYETKAQSAEMECATLFAAGYRRNLPIGALLLISDLPLRKEGIKTKSSGNFIFNTYTEDHILTGQEVIENLEKVMLKRAASDHKKDQQYRGLPHMEVGEADDTMASGSETSDSDY

SEQ ID NO: 968 - protein, 190 aa, Chlamydia pneumoniae
MVRVSTSEFRVGLRIEIDGQPYLILQNDFVKPGKGQAFNRIKVKNFLTGRVIERTYKSGESVETADIVERSMRLLYTDQEGATFMDDETFEQEVVFWEKLENIRQWLLEDTIYTLVLYNGDVVAVEPPIFMELSIAETAPGVRGDTASGRVLKPAVTNTGAKIMVPIFIDEGELVKVDTRTGSYESRVSK

SEQ ID NO: 969 - protein, 83 aa, Chlamydia pneumoniae
EKYFFFTVRNMEAKKIKELSKEAQLLKKLREKSRVLDEKNKRKAWVAKLVAMPESIREIEKEERVETPQLFQAIAEKILEEGV

SEQ ID NO: 970 - protein, 314 aa, Chlamydia pneumoniae
NFSLDSNTVDQKNKSNPRPMQEKPRHVHRIIHISDVHFHVLPVNPVHCFNKRLKGLLRKVFGLVHFQATTIGQRFPKVVRSLGADSVCITGDFSLTAMDGEFLLAKHFVETLAKHSSVYLLPGNHDVYTLKSLAQQTFYTHFPNDQLQQNKVSFHKITDHWWLILLDCSCLNGWFSANGVVHLAQISAIETFLLSLSPEENVIIANHYPLLSSQNPSHDLINNTHLQNVLKKYPKVRLYLHGHEHQAAVYNCADTSPSYILNSGSISLPTNSRFHVIDLYPEKYQVHTMILKNLLDFDAPLEIANEATWDCQKL

SEQ ID NO: 971 - protein, 519 aa, Chlamydia pneumoniae
MSEQEKLSNYNADKKLFSGIDKLFQIVKGSYGPKQSLSPTSFFKERGFYAISQTELSNSYENLGVDFAKAMVNKIHKEHSDGATTGLILLHAILQESYAALEKGISTHKLIASLKLQGEKLQEALQQQSWPIKDALKVRNIIFSSLHMPTIADHFYNAFSVVGPEGLISITKERENDKTSMDVFQGFKIPAGYASTYFVSDTASRLTRIAHPLILITDRKISMIHSLLPLLQEISEQNQHLIIFCEDIDPDVLATLVVNKLQGLLQVTVVTIPQLSTTNQELAEDIALFTGTHICPCQEASHVLAPEMVTLGSCLSIEISESQTTLIGGLHIPEVLTLKTRQLAEEIRTTSCLETKKRLIKSTNRLQSSVAILPTDEDNEPLYTLALKIMESALSRGYVPGGGVALFYASLTLGTPKDDADENSIAISLLQKACCAPLKLLATNADLDGDAVIAKLSSLGTTSLGISVFSREIEDLIAGGILDSLATTSTILAQALDTAILVLSSKILILENQYEISTL

SEQ ID NO: 972 - protein, 447 aa, Chlamydia pneumoniae
MRAMLLEDWVSLMLSDVSCPKCDKKITGFAIDSQKVQPGDLFFALPGNATDGHQFLKHAATAGAVAAVVSHDYQGDSFGLELIRVDDTKSALQEAGSNQCNLFQGTLVGITGSVGKTTTKEFSKTILSSIYKTHASPKSYNSQLTVPLSLLMAEGDEDVMILEMGVSEPGNMQDLLRIVQPEIAVITHINDQHAMHFPQGIQEILKEKSYILQKSKLQLLPKDSPYYLDLRSCSPTAEKFSFSFNDPLADFCYKAISGDSVVIQTPEENYCLPIAFSYKPAYTNLLIAVALSWILEVPEEGVIRSLPELKLPPMRFEHSMRNGMQVINDAYNACPEAMIAALDALPLPSDGGKIILILGHMAELGRYSEEGHALVAEKAASRGDMIFFIGEKWIPVQSVLKSYSCEVSFFSSAQDVKDILKQVARYGDVILLKGSRALALESLLACF

SEQ ID NO: 973 - protein, 349 aa, Chlamydia pneumoniae
MIPLIPMFLKQSLFFSLALTGMTTLVLTVSLGVPVMKWLKRKNYRDYIHKEYCEKLEMLHKDKAEVPTGGGVLLFISLIASLLVWLPWGKFSTWFFIILLTCYAGLGWYDDRIKIKRKQGHGLKAKHKFMVQIAIAAFTLIALPYIYGSTEPLWTLKIPFMEGMLSLPFWLGKVFCLGLALVAIIGTSNAVNLTDGLDGLAAGTMSFAALGFIFVALRSSTIPIAQDVAYVLAALVGACIGFLWYNGFPAQLFMGDTGSLLLGGLLGSCAVMLRAECILVVIGGVFVAEAGSVILQVLSCRLRKKRLFLCSPLHHHYEYQGLPETKIVMRFWIFSFVCAGLGIAAVLWR

SEQ ID NO: 974 - protein, 419 aa, Chlamydia pneumoniae
  SITE 1...419: Xaa=unknown or other
MRRSRYSGCLMEIDMCQRILILGTGITGKSVARFLYQQGHYLIGADNSLESLISVDHLHDRLLMGASEFPENIDLVIRSPGIKPYHPWVEQAVSLKIPVVTDIQVALKTPEFQRYPSFGITGSNGKTTTTLFLTHLLNTLGIPAIAMGNIGLPILDHMGQPGVRVVEISSFQLATQEEHIPALSGSVFLNFSRNHLDYHRNLDAYFDAKLRIQKCLRQDKTFWVWEECSLGNSYQIYSEEIEEILDKGDALKPIYLHDRDNYCAAYALANEVGWVSPEGFLKAIRTFEKPAHRLEYLGKKDGVHYINDSKATTVTAVEKALMAVGKDVIVILGGKDKGGDFPALASVLSQTTKHVIAMGECRQTIADALSEKIPLTLSKDLQEAVSIAQTIAQEGDTVLLSPGCAXLISFKVLKNAXLL

SEQ ID NO: 975 - protein, 252 aa, Chlamydia pneumoniae
  SITE 1...252: Xaa=unknown or other
RTRXYFKLLIRRNAGSEVNMNRRDMVITAVVVNAILLVALFVTSKRIGVKDYDEGFRNFASSKVTQAVVSEEKVIEKPVVAEVPSRPIAKETLAAQFIESKPVIVTTPPVPVVSETPEVPTVAVPPQPVRETVKEEQAPYATVVVKKGDFLERIARANHTTVAKLMQINDLTTTQLKIGQVIKVPTSQDVSNEKTPQTQTANPENYYIVQEGDSPWTIALRNHIRLDDLLKMNDLDEYKARRLKPGDQLRIR

SEQ ID NO: 976 - protein, 385 aa, Chlamydia pneumoniae
MKWFVISCLLGIFSLGLIMVFETSSAEVLDRSLECSTHKALIRQVTYLILGLGVASLLYMMEWRDFLKISPVLLSGAALALICVFIPGLGICRNGARRWLGFGQLTIQPSEFVKYLVPIVALYFLTFSSLYQKQLKMFLKLTAILFIPILLIAIEPDNGSAAVISASLIPVFIMTSVRLRYWLLPLLCVLIAGGALAYRMPYVRYRLNVYLHPELDIKGRGHQPYQAKIAAGSGKLLGKGPGASLQKLTYLPEAQNDYIAAIYAEEFGFLGMLVLILLYMCFVYGGYAIAIKASSLEGAALAMVITLIISMQAFMNLGVVSGLLPSKGVNLPFFSQGGSSLIANMCGVTLLLKVYDEENSKSSLGCRRFRRPHCPSSLGKGSFFS

SEQ ID NO: 977 - protein, 357 aa, Chlamydia pneumoniae
MMKKIRKVALAVGGSGGHIVPALSVKEAFSREGIDVLLLGKGLKNHPSLQQGISYREIPSGLPTVLNPIKIMSRTLSLCSGYLKARKELKIFDPDLVIGFGSYHSLPVLLAGLSHKIPLFLHEQNLVPGKVNQLFSRYARGIGVNFSPVTKHFRCPAEEVFLPKRSFSLGSPMMKRCTNHTPTICVVGGSQGAQILNTCVPQALVKLVNKYPNMYVHHIVGPKSDVMKVQHVYNRGEVLCCVKPFEEQLLDVLLAADLVISRAGATILEEILWAKVPGILIPYPGAYGHQEVNAKFFVDVLEGGTMILEKELTEKLLVEKVTFALDSHNREKQRNSLAAYSQQRSTKTFHAFICECL

SEQ ID NO: 978 - protein, 812 aa, Chlamydia pneumoniae
VHYMKGTPQYHFIGIGGIGMSALAHILLDRGYEVSGSDLYESYTIESLKAKGARCFSGHDSSHVPHDAVVVYSSSIAPDNVEYLTAIQRSSRLLHRAELLSQLMEGYESILVSGSHGKTGTSSLIRAIFQEAQKDPSYAIGGLAANCLNGYSGSSKIFVAEADESDGSLKHYTPRAVVITNIDNEHLNNYAGNLDNLVQVIQDFSRKVTDLNKVFYNGDCPILKGNVQGISYGYSPECQLHIVSYNQKAWQSHFSFTFLGQEYQDIELNLPGQHNAANAAAACGVALTFGIDINIIRKALKKFSGVHRRLERKNISESFLFLEDYAHHPVEVAHTLRSVRDAVGLRRVIAIFQPHRFSRLEECLQTFPKAFQEADEVILTDVYSAGESPRESIILSDLAEQIRKSSYVHCCYVPHGDIVDYLRNYIRIHDVCVSLGAGNIYTIGEALKDFNPKKLSIGLVCGGKSCEHDISLLSAQHVSKYISPEFYDVSYFIINRQGLWRTGKDFPHLIEETQGDSPLSSEIASALAKVDCLFPVLHGPFGEDGTIQGFFEILGKPYAGPSLSLAATAMDKLLTKRIASAVGVPVVPYQPLNLCFWKRNPELCIQNLIETFSFPMIVKTAHLGSSIGIFLVRDKEELQEKISEAFLYDTDVFVEESRLGSREIEVSCIGHSSSWYCMAGPNERCGASGFIDYQEKYGFDGIDCAKISFDLQLSQESLDCVRELAERVYRAMQGKGSARIDFFLDEEGNYWLSEVNPIPGMTAASPFLQAFVHAGWTQEQIVDHFIIDALHKFDKQQTIEQAFTKEQDLVKR

SEQ ID NO: 979 - protein, 192 aa, Chlamydia pneumoniae
LVNDSQLSREASAFRLDIDFFILNIYPFFRNFKNIELCFFLSISQFNLDFMEEFVAYIVKNLVTNPEAVEIRSIEDEDNESIKLEIRVAAEDIGKIIGRRGNTIHALRTILRRVCSRLKKKVQIDLVQPENGTDVIADQDYICDNDSSNSTEDTFGESDTCCSGHCHYDEDLNQEEQEEGNMHHSCECSNHH

SEQ ID NO: 980 - protein, 120 aa, Chlamydia pneumoniae
KFLIIKSSMTAVLILTSFPSEESARSLARHLITERLASCVHVFPKGTSTYLWEGKLCESEEHHIQIKSIDIRFSEICLAIQEFSGYEVPEVLLFPIENGDPRYLNWLTILSYPEKPPLSD

SEQ ID NO: 981 - protein, 213 aa, Chlamydia pneumoniae
ILAILFMIIIKNNELMIRRFFKTLFPPGPQYSLCYASILIVLSSLVCVPTFCWLFLPELSLSKFNPSPIRNLFLVSSTLSKVPPTAIAEHLRLSADAPTYLHEFSIKEAESSLHALGIFSSLVIEKSPDNKGITIFYTLQTPIAYVGNRSNTLCNLEGSCFLGQPYFPSLNLPQIFFSQEDLKMQKLPKEKMLFTKILLKELAMESPKIIDLS

SEQ ID NO: 982 - protein, 107 aa, Chlamydia pneumoniae
LERLLMNLSAKEYGDIIVIYLQGSLDAVSVPSVQEYLEQFIQKKHLKIALNFTDVSYISSAGIRLLLSNFKLVQSLGGKMCLCCVKESVTEVMRIARFRQMILLCQV

SEQ ID NO: 983 - protein, 342 aa, Chlamydia pneumoniae
MLPFEFEFNTTSSPECDVCLDPQKLFVKLFKRTIVLLSGPTGSGKTDVSLALAPMIDGEIVSVDSMQVYQGMDIGTAKVSLKARQEIPHHLIDIRHVQEPFNVVDFYYEAIQACQNILSRNKVPILVGGSGFYFHAFLSGPPKGPAADPQIREQLEAIAEEHGVSALYEDLLLKDPEYAQTITKNDKNKIIRGLEIIQLTGKKVSDHEWDIVPKASREYCCRAWFLSPETEFLKNNIQMRCEAMLQEGLLEEVRGLLNQGIRENPSAFKAIGYREWIEFLDNGEKLEEYEETKRKFVSNSWHYTKKQKTWFKRYSIFRELPTLGLSSDAIAQKIAKDYLLYS

SEQ ID NO: 984 - protein, 365 aa, Chlamydia pneumoniae
SLLLAIFNVNYFMNLCKRISFEEGLELFVSSPIERLQERADAIRKERYPSNEVTYVLDANPNYTNICKIDCTFCAFYRKPKSPDAYLLSFDEVRSLLQRYVSSGVKTVLLQGGVHPGLGIDYLEELVRITVQEFPSIHPHFFSAVEIEHACRVSGISIEQGLQRLWDAGQRTIPGGGAEILSERVRKIISPKKMQPGGWINLHKLAHLMGFRTTATMMFGHVENPEDILIHLQTLRDAQDSCPGFYSFIPWSYKPGNTALRRNVPQQASIETYYRILALGRIFLDNFDHVAASWFGEGKSLGAKALHYGADDFGGVILDESVHKATGWSIQSSEEEICNIIRSEGFIPVERNTFYQHISCTVSSL

SEQ ID NO: 985 - protein, 438 aa, Chlamydia pneumoniae
VVIMDNSDNSFHTLETEQGSFLNDELAVEEVASTESTEISDATLCFADEIQELPSPEKKVAFILNKMREALTGSSQGSDLRLFWDLRKQCLPLFNEIEDTAKRADHWRCYIELTKEGRHLKGLQDEEGSFVVGQIDLAITCLEKDILKFQEGTEDKIFKDREDNFLESQALDKHQAFYKQHHTSLLWLSSFSSKIIDLRKELINVGMRMRLKSKFFQRLSNLGNQVFPKRKELIEKVSQTFAEDVDAFVAKYFIGSDKETLKKTVFFLRKEIKNLQHAAKRLFVSSHVFAETRLKLSKCWDQLKGMEKEIRQEQGRLRVVSAENSKEVRQMLAEVSSLLIEGNDLSKVRKDLEGISKKIRALDLTHDDVISLKKEMQQLFDQLREKQDAAEHSYQEQLAKDKQVKKEAARSLAERITTFSKTCSEGTLLPNLEKNGRH

SEQ ID NO: 986 - protein, 142 aa, Chlamydia pneumoniae
AHHNILKNLLRRNITSESREEWQTLKELLGKMSFLPPPEKISLDNQLNLALQTIVNFFEEQLLSSPDSREKLVNMRQVLKQRRERRQELKDKLEQDKKLLGSSGLDFDRAMQYSALVEEDKRALEELDASILELKQQIQQLL

SEQ ID NO: 987 - protein, 119 aa, Chlamydia pneumoniae
MDSFCFDLLKVAAKAIDDKKGNNLVVLDVRTISEFTDYFVFVEGSVNVHVKALANTIVEELKKQKVSPLHVEGITDGNWVVIDYGFIVVHVFVSEIRGKYRLEELWKDGFIVTSKLLAS

SEQ ID NO: 988 - protein, 424 aa, Chlamydia pneumoniae
LLNGVRVYMSKKRVVVTGFGVVSCLGNEVDTFYDNLLAGVSGVRPITSFPCEDYATRFAGWIPEFNPEPYVDKKQARRVDPFITYAMVAAKKAIAMSRWDKDHLPSDPVRCGVIVGSGMGGLSTLDQGMERLLVIHKKLSPFFIPYIITNMAPALIAMDFGLMGPNYSISTACATGNYCIDAAYQHLVSGRADMIICGGTEAAVNRIGLEGFIANRALSERNDAPDQASRPWDRDRDGFVLGEGAGILVLETLESALRRDAPIFAEMLGSYVTCDAFHITAPRDDGEGITACVLGALNSAGIPKERVNYVNAHGTSTPLGDLSEVLAVKKAFGSHVRNLRMNSTKSLIGHCLGAAGGVEAVVAIQAILTGKLHPTINLDNPIAEIEDFDVVANKAQDWDIDVAMSNSFGFGGHNSTILFSRYVP

SEQ ID NO: 989 - protein, 150 aa, Chlamydia pneumoniae
MMKTKYEYSFGVIPIKFFGTPDKNTLKACFICHTRGKHWGFPKGHSEDKEGPQEAAERELVEETGLSVVNFFPKVLIEQYSFNNEEQVFVRKEVTYFLAEVRGDIHADPMEICDSQWLSLQEGLRLLSFPELRDLTVEADKFINNYLFSS

SEQ ID NO: 990 - protein, 215 aa, Chlamydia pneumoniae
MSKKPLYVAHPWHSPTLTQDNYESLCCYIEITPYDSVKFELDKATGLLKVDRPQKFSNFCPCLYGLLPQTYCGTASGNYSGEQTRREGIQGDKDPLDVCVLTEKNIHHGNILLQARPIGGLRIIDSGEADDKIIAVLEDDLVFAEIEDISDCPGTVLDMIQHYFLTYKATPNHLIKGSPAKIEIVGIYGKKEAQKVIQLAHEDYLSYIGDTAEVN

SEQ ID NO: 991 - protein, 351 aa, Chlamydia pneumoniae
MKYSLNFKEIKIDDYERVIEVTCSKVRLHAIIAIHQTAVGPALGGVRASLYSSFEDACTDALRLARGMTYKAIISNTGTGGGKSVIILPQDAPSLTEDMLRAFGQAVNALEGTYICAEDLGVSINDISIVAEETPYVCGIADVSGDPSIYTAHGGFLCIKETAKYLWGSSSLRGKKIAIQGIGSVGRRLLQSLFFEGAELYVADVLERAVQDAARLYGATIVPTEEIHALECDIFSPCARGNVIRKDNLADLNCKAIVGVANNQLEDSSAGMMLHERGILYGPDYLVNAGGLLNVAAAIEGRVYAPKEVLLKVEELPIVLSKLYNQSKTTGKDLVALSDSFVEDKLLAYTS

SEQ ID NO: 992 - protein, 325 aa, Chlamydia pneumoniae
MHSELPNYQNIVESVVTEITTQLLNYRSEHRLVPFWEKSDGSFITAADYGSQYYLKQQLAKAFPNIPFIGEETLYPDQDNEKIPEILKFTRLLTSSVSRDDLISTLVPPPSPTSLFWLVDPIDGTAGFIRHRAFAVAISLIYEYRPILSVMACPAYNQTFKLYSAAKGHGLSIVHSQNLDRRFVYADRKQTKQFCEASLAALNQQHHATRKLSLGLPNTPSPRRVESQYKYALVAEGAVDFFIRYPFIDSPARAWDHVPGAFLVEEAGGRVTDALGAPLEYRKESLVLNNHAVILASGDQETHETTLAALQNQLNVVPTDKLIAL

SEQ ID NO: 993 - protein, 246 aa, Chlamydia pneumoniae
GELMLIKLWRATYEGMYTFLVGALLKLRYRMQVEGWDTLNINPKQGCLFLANHVAEVDPIILEYLFWSRFHVRPMAVEYLFHSRVVQWFLNSVRSIPIPQLVPGKESKRSLERMNVCYEEASRALNRGESLLLYPSGRLSRTGKEEIVNQYSAYVLLHRVMECNVVLVRVSGLWGSAFSRYKQNSTPKLGPAFKEAFRALLRRGIFFMPKRFVKITLCQVDHLFLKQFPTKQDLNTFLASWFKSRR

SEQ ID NO: 994 - protein, 567 aa, Chlamydia pneumoniae
ILFWLLGLNQGDDNLPIEVPLRITRKLRRMHDQRNRGHNNHNLRLRPGSTLLEAFLILCSEHEEGIACFDEHLGSLSYRELRNAIIAVAIKVSKFSEDRVGVMMPASIGAFIAYFGILLAGKTPVMMNWSQGLRELRACTKTVEVRRVLTSQQFIKHLTEVQGFVEYPFDLMYMEDVRKRLSWWEKCRIGLYSKCSVPWLLRIFGVSGVESDDTAVILFTSGTEKLPKAVPLTHKNLMENQEACLKFFDPNTQDVMLAFLPPFHAYGFNSCGLFPLLMGVHVVFASNPLNPKKLVEFIDDKKVTFFGSTPVFFDYILKTAKKQNSCLESLRLVVIGGDALKDTLYEETKKLQPQIALYQGYGATECSPVISITTKESPRKSECVGMPIEGMDVLIISKETHIPVSSGEQGLIVVRGNSVFSGYLGNHEHQSFVSLGGDQWYLTGDLGHIGPSGDLFLEGRLSRFVKIGGEMVSLEALESILHEHFTENQNEDAGSLVVCGIPGDKVRLCLFTTLATTIHEVNDILKSAETSSIVKISYVHQVESIPILGIGKPDYVSLNALAVSLFG

SEQ ID NO: 995 - protein, 376 aa, Chlamydia pneumoniae
VCKESFLTTSDVIDFVTNDFLGFARSPTIYCEVSKRFQIHCQQFPHEKLGIRGSRLMVGPSSVIDDLESKIASYHGAPNAFIVNSGYMANLGLCHHVSRSTDVLLWDEEVHMSVVHSLSAISGQHHTFHHNNLEHLESLLQCYRISSKGRIFIFVSSVYSFRGTLAPLEQIIALSKKYHAHLIVDEAHAMGIFGDDGKGLCHALGYENFYAVLVTYGKALGTMGASLLTSSEVKYDLMQNSPPLRYSTSLSPHTLISIGTAYDFLASEGEIARKQVFKLKEHFHECFDSHAPGCVQPIFLPHTCLEEAISVLETTGIHVGVVAFAKHPFLRVNLHAYNTVDEVNLLAQVMKPYLEKSSHRVHINHEFHLWRELCQH

SEQ ID NO: 996 - protein, 758 aa, Chlamydia pneumoniae
KRFTAKTKSMGYIESSTFRLYAEVIVGSNINKVLDYGVPENLEHITKGTAVTISLRGGKKVGVIYQIKTTTQCKKILPILGLSDSEIVLPQDLLDLLFWISQYYFAPLGKTLKLFLPAISSNVIQPKQHYRVVLKQSKAKTKEILAKLEVLHPSQGAVLKILLQHASPPGLSSLMETAKVSQSPIHSLEKLGILDIVDAAQLELQEDLLTFFPPAPKDLHPEQQSAIDKIFSSLKTSQFHTHLLFGITGSGKTEIYLRATSEALKQGKSTILLVPEIALTVQTVSLFKARFGKDVGVLHHKLSDSDQKSHVAPSFRRSLRILIGPRSALFCPMKNLGLIIVDEEHDPAYKQTESPPCYHARDVAVMRGKLAHATVVLGSATPSLESYTNALSGKYVLSRLSSRAAAAHPAKISLINMNLEREKSKTKILFSQPVLKKIAERLEVGEQVLIFFNRRGYHTNVSCTVCKHTLKCPHCDMVLTFHKYANVLLCHLCNSSPKDLPQSCPKCLGTMTLQYRGSGTEKIEKILQQIFPQIRTIRIDSDTTKFKGSHETLLRQFATGKADVLIGTQMIAKGMNFSAVTLAVILNGDSGLYIPDFRASEQVFQLITQVAGRSGRSHLPGEILIQSFLPDHPTIHSAMRQDYSAFYSQEITGRELCEYPPFIRLIRCIFMGKCPKQTWEEAHRVHNILKEQLESTNPLMPVTPCGHFKIKDTFRYQFLIKSAYVIPVNKKLHHALMLAKLSPKVKFMIDVDPMTTFF

SEQ ID NO: 997 - protein, 230 aa, Chlamydia pneumoniae
KHWLFMENSQNFHDTLCQLLDRYSEELYPTLASLLNVTLPNTAISASVSSIPEKAVEVPNAEPQPITPPPPTNLSQEKTKPSDWKCVPLHPDLSQNAILKEKYPALKDCSLPAPKIPCSIFVYEENNEEVLFFNRLAKILTQQLFPTKLTLIHAKTNIFVNNPNFFLALAPLNVIRYKIPTTDYHQSLTQNGCIFLPLYSSLEYEKDSQLKRNLWAILNRLPFAYTPKSS

SEQ ID NO: 998 - protein, 166 aa, Chlamydia pneumoniae
HEILVARMCFCRLSAIDFTLLCCTKTCFWRNLQQTRPIAAANLQWESYAEALEHSKQDHKPICLFFTGSDWCMWCIKMQDQILQSSEFKHFAGVHLHMVEVDFPQKNHQPEEQRQKNQELKAQYKVTGFPELVFIDAEGKQLARMGFEPGGGAAYVSKVKSALKLR

SEQ ID NO: 999 - protein, 380 aa, Chlamydia pneumoniae
  SITE 1...380: Xaa=unknown or other
MIPSPTPINFRDDTILETDPKPSLIMFSSKKTEIASERRKAHPTLFKVLGTIWNIVKFIISIILFLPLALLWVLKKTCQFFILPSSIISQSMSKTAVAIRRMTFLSHIKQLLSLKEISAADRVVIQYDDLVVDSLAIKIPHALPHRWILYSQGNSGLMENLFDRGDSSLHQLAKATGSNLLVFNYPGIMSSKGEAKRENLVKSYQACVRYLRDEETGPKANQIIAFGYSLGTSVQAAALDREVTDGSDGTSWIVVKDRGPRSLADVANQICKPIASAIIKLVGWNIDSVKPSERLRCPEIFIYNSNHDQELISDGLFERENCVXTPFLELPEVKTSGTKIPIPERDLLHLNPLSPNVVDRLAAVISNYLDSENRKSQQPD

SEQ ID NO: 1000 - protein, 377 aa, Chlamydia pneumoniae
FTLLNLSNRSDILSGIFSNPHPVSYFSSTHAKQLSDFSKKHPILTKIVTIIVKIFKLLIGLIIPPLGIYWLCQLVCSLALFPRSSMLYSVLKTCFKKYRLEQEIQDYFVKNLDPSFKDPAVSESKRITIQQDHLTIDTLAIHFSTARPKRWLLISLGSGDFLEDMIGLKDSLFLSWKELAKLLGANILIYNYPGVKSSTGKLNLENLATVIIYVQSTYKIKFRALGLTKSSPRIFLRRGSPVCSFAKNPFTNSETSWVAVKDRAPHSLPAAANSFFGPIGKLIAVLARWKMDAEKNSRELPCPEILVYSADRFRPSEVGDDTALLPEFTLAHAIKRTPFARSKKFIGEVNLLHSSPLKHPTIQKLAEAILESLSRKN

SEQ ID NO: 1001 - protein, 369 aa, Chlamydia pneumoniae
MAPIHGSNAFVEDILHSHPSPQATYFSSTRAQKLHEFKDRHPVLTRIASVIIKIFKVLIGLIILPLGIYWLCQTLCTNSILPSKNLLKIFKKQPNTKTLKTNYLRALQDYSSKNRVASMRRVPILQDNVLIDTLEICLSQAPTNRWMLISLGSDCSLEEIACKEIFDSWQRFAKLIGANILVYNYPGVMSSTGSSSLKDLASAHNICTRYLKDKEQGPGAKEIITYGYSLGGLIQAEALRDQKIVANDDTTWIAVKDRCPLFISPEGFHSCRRIGKLVARLFGWGTKAVERSQDLPCLEIFLYPTDSLRRSTVRQNKLLAPELTLAHAIKNSPYVQNKEFIEVRLSSDIDPIDSKTRVALATPILKKLS

SEQ ID NO: 1002 - protein, 160 aa, Chlamydia pneumoniae
NKMSELAPCSTGLQMVPHTQVHHALDTRRVILTIAACLSLIAGIVLVGLGAAAILPSLFGVIGGMILILFSSIALIYLYKKTREVDQIALEPLPEMISKDQSIIDFVKTRDYASLEKKATFAYTHTHYYDGSMVFYREIPRFMLGSYLALRKDMDRQALF

SEQ ID NO: 1003 - protein, 542 aa, Chlamydia pneumoniae
LGWKSDIYTNILEERMTARAEYLDHEDFLYRSHKLQELSELGVVLYPYEFPGVFSCEDIKKTFASQELGNSEAAMSRSTPRVRFAGRLVLFRAMGKNAFGQILDHNQTIQVMFNREFTSVHGLSEDAEITPIKFIEKKLDLGDILGIDGYLFFTHSGELTVLVETVTLLCKSLLSLPDKHAGLSDKEVRYRKRWLDLISSREVSDTFVKRSYIIKLIRNYMDAHGFLEVETPILQNIYGGAEAKPFTTTMEALHSEMFLRISLEIALKKILVGGAPRIYELGKVFRNEGIDRTHNPEFTMIEAYAAYMDYKEVMVFVENLVEHLVRAVNHDNTSLVYSYWKHGPQEVDFKAPWIRMTMKESIATYAGIDVDVHSDQKLKEILKKKTTFPETAFATASRGMLIAALFDELVSDNLIAPHHITDHPVETTPLCKTLRSGDTAFVERFESFCLGKELCNAYSELNDPIRQRELLEQQHTKKELLPDSECHPIDEEFLEALCQGMPPAGGFGIGVDRLVMILTNAASIRDVLYFPVMRRFDAEKTN

SEQ ID NO: 1004 - protein, 308 aa, Chlamydia pneumoniae
VAYAAAPEFLLMSMTKKTQVILYCGKHTIQNVMASFIGKVLSGIGRPGWHLECSIMAMELLGDSLDIHAGGVDNIFPHHENEIAQSEALSGKPFARYWLHSEHLLIDGKKMSKSLGNFLTLRDLLHQEFTGQEVRYMLLQSHYRTQLNFTEEALLACRHALRRLKDFVSRLEGVDLPGESPLPRTLDSSSQFIEAFSRALANDLNVSTGFASLFDFVHEINTLIDQGHFSKADSLYILDTLKKVDTVLGVLPLTTSVCIPETVMQLVAEREEARKTKNWAMADTLRDEILAAGFLVEDSKSGPKVKPL

SEQ ID NO: 1005 - protein, 232 aa, Chlamydia pneumoniae
GLYFYNTASQKKELFFPNHTPVRLYTCGPTVYDYAHIGNFRTYVFEDILKRTLVFFGYSVTHVMNITDVEDKTIAGASKKNIPLQEYTQPYTEAFFEDLDTLNIARADFYPHATHYIPQMIQAITKLLEQGIAYIGQDASVYFSLNRFPNYGKLSHLDLSSLRCCSRISADEYDKENPSDFVLWKAYNPERDGVIYWESPFGNRKTWMAFRMFDYGDGTSWRFFGYPCGRCR

SEQ ID NO: 1006 - protein, 242 aa, Chlamydia pneumoniae
TAVENIRQQNLALKSKFKINELPCMILLSHEEREIYRIGSFGNETGSNLGDSLCHIVESDSLLRRAFPMMTSLSLSELQRYYRLAEELSHKEFLKHALELGVRSDDYFFLSEKFRLLVEVGKMDSEECQRIKKRLLNKDPKNEKQTHFTVALIEFQELAKRSRAGVRQDASQVIAPLESYISQFGQQDKDNLWRVEMMIAQFYLDSDQWHHALQHAEVAFEAAPNEVRSHISRSLEYIRHQS

SEQ ID NO: 1007 - protein, 139 aa, Chlamydia pneumoniae
  SITE 1...139: Xaa=unknown or other
VHPLTLPKQSRVLKRKQFLYITRSGFCCRGSQATFYVVPSRHPGTCRMGITVSKKFGKAHERXSFKRVVREVFRHVRHQLPNCQIVVFPKGHKQRPVFSKLLQDFINQIPEGLHRLGKTKATTGGECTPKSEKCVTAPR

SEQ ID NO: 1008 - protein, 101 aa, Chlamydia pneumoniae
MAKKSSVAREAKRRRLVEANFKKRSDLRKIVKSLSVSEEEKENARISLNKMKRDTSPTRLHNRCLLTGRPRGYLRKFAISRICFRQMASMGEIPGVIKASW

SEQ ID NO: 1009 - protein, 169 aa, Chlamydia pneumoniae
QTINLSGTLRTMLPISILLFYVILGCLSAYIADKKKRNVIGWFFAGAFFGFIGLVVLLLLPSRRNALEKPQNDPFDNSDLFDDLKKSLAGNDEIPSSGDLQEIVIDTEKWFYLNKDRENVGPISFEELVVLLKGKTYPEEIWVWKKGMKDWQRVKDVPSLQQALKEASK

SEQ ID NO: 1010 - protein, 189 aa, Chlamydia pneumoniae
HINRWTIRLSLTLIISTVLYFFSEEIELIGGGKMEKQNLKLDVKEIEFPETVFSRDIETRVIQVIILHCLAKINGVSLLGGNLIDALFGRDIERMKGIYVEQDSKNHLVKVRVEVNVDYGVSIPEKTEEIQGCIVSEISEYTGLHVAAVHVIIKGLTQPKDRIDEEIEEEVSVQDLPSPEDFLLENSEG

SEQ ID NO: 1011 - protein, 603 aa, Chlamydia pneumoniae
MRIEDFSLKLIPSSPGVYLMKDVHDQVLYIGKAKNLKNRLASYFHEKGDSRERIPFLMKKTASIETIVVSNETEALLLENNLIKQHHPKYNVLLKDDKTFFCLAISLSHSWPKVEAIRTKAITSSQRQLIFGPYVSAEACHTLLEVISQWFPLRTCSDREFALRKRPCILYDMKRCLAPCVGYCTPEEYQGTLDKAILFLKGKIEEVVKDLEKVIQKASDNLEFEQAANYYRTLSLIKQAMAKQQVEKFHFQNIDALGLYRHKQRTILTLLTVRSGKLLGARHFSFFENAQEDQDLLSSFILQYYVSQPYIPKEILTPLPLEFPTLSYVLNAESPPRLRSPKTGYGKELLDLAYRNAKAYAATTLPSSSSPTKTLRIILRMSQYPYRIECYDNAHMQGAHATGVYIVFENNGFDPKQYRTFSIDSEKTQNDLALLEEVLLRRFHSLTTALPDMIVVDGGKTHYNKTKKIIQTLNLTGIQVVTIAKEKSNHSRGLNKEKIFCETFPEGFSLPPTSNLLQFFQILRDEAHRFAISKHRKKRGKALFEQEKIPGIGEVKRKRLLQKFKSWKQVMLSSQEELEAIPGLTKKDIAVLLARQKDFNKSD

SEQ ID NO: 1012 - protein, 481 aa, Chlamydia pneumoniae
GDPCTSRCCRIFLRQVTLRKNIKTYLCQVRDIERLMTKVTTGLAGPRDIGTLRDSFSAGAQIYEQLASATLPEFFIDKCSLDTKLASLIALLSKSLNGDLPLRVSDGNIFVDEFHNDLKRLRHNQEHSQEWIWEYQERIRKETGIKKLKICFAQALGYYIEVSSEFAPQLPKDFIRRQSRLHAERFTTIELQQFQDDMSNISEKLQTLETQFFKDLCSHILQLRTEILALSQSLADLDYIISLADLAHAQGYCRPRVDMSDTLCIYRGCHPVAKTLVDTGKFIPNDTEMRGSQTRMILLTGPNMAGKSTYIRQIALLVIMAQMGSYIPAKSAHIGVIDKIFTRIGAGDNLSKGMSTFMVEMAETANILHNATDRSLVILDEVGRGTSTYDGLAIAQAVVEYLLFTDKKKAKTLFATHYKELTTLEDHCPHVENFHAGVKDKAGQPVFLYEILKDIHKKVSAFMSPGLLAFPFVWYRELSRS

SEQ ID NO: 1013 - protein, 339 aa, Chlamydia pneumoniae
  SITE 1...339: Xaa=unknown or other
VMTEKKPTPMMEQWHQCKEKAGDSVLLFRMGDFYEAFYDDAVLLSQHLELTLTQRQGIPMSGIPVSTVDTYVDRLIGKGFKVAVAEQFGEPAKEKESKKIGPMARDIQRFVTPGTLLSSTLLQEKFNNXIVAITRIGSLFGFACLDLSTGSFFIEECENTKELVDEICRLAPSEVLSCNKFYNKETAIVMQLQQHLKLTLSTYADWAFEHKFASQKLTTHFQVASLDGFGLKGLVPAINAAGGLLSYIQDKLLLPTKHIAIPQTRGKQQKLLIDTASQVNLELLAPLNDPQGKNSLLRIMDHTSTPMGGRLLRQILISPFYNPKEILVRQDAVEFFFGK

SEQ ID NO: 1014 - protein, 207 aa, Chlamydia pneumoniae
LRTAMYTEESLDNLRHSIDIVDVLSEHIHLKRSGATYKACCPFHTEKTPSFIVNPAGAHYHCFGCGAHGDAIGFLMQHLGYSFTEAILVLSKKFQVDLVLQPKDSGYTPPQGLKEELRHINSEAETFFRYCLYHLPEARHALQYLYHRGFSPDTIDRFHLGYGPEQSLFLQAMEERKISQEQLHTAGFFGNKWFLFARRISFLSTMR

SEQ ID NO: 1015 - protein, 402 aa, Chlamydia pneumoniae
  SITE 1...402: Xaa=unknown or other
MVFVCTKNLFPVHDALGHTIGFSARKFLENSQGGKYVNTPETPIFKKSRILFGLNFSRRRIAKEXKVILVEGQADCLQMIDSGFNCTVAAQGTAFTEEHVKELSKLGVLKVFLLFDSDEAGNKAALRVGDLCQTAQMSVFVCKLPQGHDPDSFLMQRGSSGLIALLEQSQDYLTFLISEKMSSYPKFGPREKALLVEEAIRQIKHWGSPILVYEHLKQLASLMMVPEDMVLSLANPQVTAEPQNIPIKQKVPKIHPHIVMETDILRCMLFCGSNTKILYTAQFYFVPEDFKHPECRKLFAFMISYYEKYRKNVPFDEACQVLSDSQILQLLTKRRLNTEALDTIFVQSLQKMADRRWREQCKPLSLNQNIQDKKLEILEDYVQLRKDRTIITLLDPESELIP

SEQ ID NO: 1016 - protein, 120 aa, Chlamydia pneumoniae
IKIMMHRYFIPLLALLIFSPSLVRAELQPSENRKGGWPTQLSCAEGSQLFCKFEAAYNNAIEEGKPGILVFFSERPTPEFADLTNGSFSLSTPIAKGFNVVVLCPGLISPLDFFHQNGIL

SEQ ID NO: 1017 - protein, 220 aa, Chlamydia pneumoniae
SIFKNKILPSYFGHNFDQLRRHYMRIALSLLSLLMIFPIFGEESRPGSEDGNSNTQEIVGSQDTQVCLYHSYEQGLQASRIEGKPLVIVVLCNSGDDGQACTIGLSETCEEVLSVLSGSIFSELANFVVLVPSGVNPLIYPPIEDPILAEIVKFKELFKDESFPTGLSIIVVGVTPEGPGDIIEVSPVSLTVEEEETLPSEQTTEVESTSELQSEDPAIA

SEQ ID NO: 1018 - protein, 1014 aa, Chlamydia pneumoniae
  SITE 1...1014: Xaa=unknown or other
LESFVSEHPLTLQSMIATILRFWSEQGCVIHQGYDLEVGAGTFNPATFLRALGPEPYKAAYVEPSRRPQDGRYGVHPNRLQNYHQLQVILKPVPENFLSLYTESLRAIGLDLRDHDIRFIHDDWENPTIGAWGLGWEVWLNGMEITQLTYFQAIGSKPLDTISGEITYGIERIAMYLQKKTSIYDVLWNDTLTYGQITQASEKAWSEYNFDYANTEMWFKHFEDFAEEALRTLKNGLSVPAYDFVIKASHAFNILDARGTISVTERTRYIARIRQLTRLVADSYVEWRASLNYPLLSLSSTSEPKETSESVVPMISSTEDLLLEIGSEELPATFVPIGIQQLESLARQVLTDHNIVYEGLEVLGSPRRLALLVKNVAPEVVQKAFEKKGPMLTSLFSPDGDVSPQGQQFFASQGVDISHYQDLSRHASLAIRTVNGSEYLFLLHPEIRLRTADILMQELPLLIQRMKFPKKMVWDNSGVEYARPIRWLVALYGEHILPITLGTIIASRNSFGHRQLDPRKISISSPQDYVETLRQACVVVSQKERRMIIEQGLRAHSSDTISAIPLPRLIEEATFLSEHPFVSCGQFSEQFCALPKELLIAEMVNHQKYFPTHETSSGAISNFFIVVCDNSPNDTIIEGNEKALTPRLTDGEFLFKQDLQTPLTTFIEKLKSVTYFEALGSLYDKVERLKAHQRVFSTFSSLAASEDLDIAIQYCKADLVSAVVNEFPELQGIMGEYYLKHANLPTASAVAVGEHLRHITMGQKLSTIGTLLSLLDRLDNLLACFILGLKPTSSHDPYALRRQSLEVLTLVSASRLPIDLASLLDRLADHFPSTIEEKVWDKSKTIHEILEFIWGRLKTFMGSLEFRKDEIAAVLIDSATXNPIEILDTAEALQLLKEEHTEKLAVITTTHNRLKKILSSLKLSMTSSPIEVLGDRESNFKQVLDAFPGFPKETSAHAFLEYFLSLADLSNDIQDFLNTVHIANDDGAIRNLRISLLLTAMDKFSLCHWESVAV

SEQ ID NO: 1019 - protein, 97 aa, Chlamydia pneumoniae
NGNDVLKTCSLILLNLCRYFLLVFCTAVFFKRYILILTRTVRHTEIYACGEGVTVALKSMLPSMKQESPALAKENVKRKNVIPWSHLCQNIPSPYSL

SEQ ID NO: 1020 - protein, 207 aa, Chlamydia pneumoniae
RVGLPNYITFSRLFITPIFMILYLKGKWFGITPVVLPYVLLALLAISELTDAIDGYVARKFSQVTDLGKLLDPMADSIYRISIYLTFTQPPVNLPLLLVFIFLARDSVISTLRTVCAFRGRVVAARASGKLKAILQGVSFFLILLVMIPHSLGLLSQNGLEIFASVTVSIIAVYSIASGIEYFWMNKNFLSQRAKTKDSEKNHESKD

SEQ ID NO: 1021 - protein, 476 aa, Chlamydia pneumoniae
MRIVQVAVEFTPIVKVGGLGDAVASLSKELAKQNDVEVLLPHYPLISKFSSSQVLSERSFYYEFLGKQQASAISYSYEGLTLTIITLDSQIELFSTTSVYSENNVVRFSAFAAAAAAYLQEADPADIVHLHDWHVGLLAGLLKNPLNPVHSKIVFTIHNFGYRGYCSTQLLAASQIDDFHLSHYQLFRDPQTSVLMKGALYCSDYITTVSLTYVQEIINDYSDYELHDAILARNSVFSGIINGIDEDVWNPKTDPALAVQYDASLLSEPDVLFTKKEENRAVLYEKLGISSDYFPLICVISRIVEEKGPEFMKEIILHAMEHSYAFILIGTSQNEVLLNEFRNLQDCLASSPNIRLILDFNDPLARLTYAAADMICIPSHREACGLTQLIAMRYGTVPLVRKTGGLADTVIPGVNGFTFFDTNNFNEFRAMLSNAVTTYRQEPDVWLNLIESGMLRASGLDAMAKHYVNLYQSLLS

SEQ ID NO: 1022 - protein, 185 aa, Chlamydia pneumoniae
MELVVTSRETGKKSFLKKIRQQGGIPAVVYSAGKSLANITVDALVFKKFLSNLESGALSSTVFSLSYEGRIIKALVKDIQYQITTYDVIHLDFEELVEDRPVKLNIPIRCINAVDCIGVKLGGSLRQVIRAVRVVCKPKDIVPFLELDVRSVGLSQTRKLSDIKIPAGIETITPLKEVAITVSRR

SEQ ID NO: 1023 - protein, 150 aa, Chlamydia pneumoniae
MAKLIVAIGNPRHGYANTRHNAGFLLADRLVEELQGPPFKPLSKCHALMTLVESSSGPLVFIKPTTFVNLSGKAVVLAKKYFNVALSHILVLADDVNRSFGKLRLCFNGGSGGHNGLKSITASLGSNEYWQLRFGVGRPLEEVLSYLISF

SEQ ID NO: 1024 - protein, 112 aa, Chlamydia pneumoniae
MGKKENQLYEGAYVFSVTLSEEARRKALDKVISGITNYGGEIHKIHDQGRKKLAYTIRGAREGYYYFIYFSVSPGAITELWKEYHLNEDLLRFMTLRADSVKEVLEFASLPE

SEQ ID NO: 1025 - protein, 82 aa, Chlamydia pneumoniae
MNKPVHNNEHRRKRFNKKCPFVSAGWKTIDYKDVETLKKFITERGKVLPRRITGVSSRFQGVLSQAIKRARHLGLLPFVGED

SEQ ID NO: 1026 - protein, 169 aa, Chlamydia pneumoniae
MKQQLLLLEDVDGLGRSGDLITARPGYVRNYLIPKKKAVIAGAGTLRLQAKLKEQRLIQAAADKADSERIAQALKDIVLEFQVRVDPDNNMYGSVTIADIIAEAAKKNIFLVRKNFPHAHYAIKNLGKKNIPLKLKEEVTATLLVEVTSDNEYVTVLAQGKQTEENQEG

SEQ ID NO: 1027 - protein, 81 aa, Chlamydia pneumoniae
VGRECEGLFMSYKITLPKADETTAKKVTKISEASTLIFSVLKEKASLGNVHGFCQAENSLSVEANKIISVAENTLAGCFCK

SEQ ID NO: 1028 - protein, 455 aa, Chlamydia pneumoniae
LVWFSMILPPYSYSLKIGAAVLFFCSILHTFLTPWLYTLCQSYEHKKLVFPECWKRYARLSELFRILSRVEIVFFLWAVPLFFWFLYTEGYRISMAYFNSRNYGFAVFIMVILILLESRPIVYFAELVLSSIAKLGKTSPKSWWWTLMIAPPLLSCLLKETGAMIIGATLLMRHFYVFTPSRRFAYATIGLLFSNISIGGLTSYVSSRALFLIFPALKWEHSFFLSHFAWKAIVAILISTTIYYFIFRKEFKKFPDIPSDKDPSVEKVPWWIICVNIIFVGSIILSRSTPLFMGALLLFYLGFQKFTIFYQDPINLSKVCYVGLFYAGLVVFGDLQEWWVLNLMQGLSDFGYMTVSYTLSIFLDNALVNYLVHNLSVATDCYHYLVVAGCMAAGGLTLVSNIPNIVGYLILRSAFPSSTIHMGWLFLGALGPSIISLGVFWLLKNVPEFLYCFFR

SEQ ID NO: 1029 - protein, 362 aa, Chlamydia pneumoniae
PVNHQLLREYYPATQAGFSFTSALGGDGIDLRVSGYTTTVPALLNSILTSLPNLEIRYETFLVYKKQLLELYQGALLNCPVRSGLDELASQVMKETYSNTTKLSALEKLSFSEFQAFASNLFNSVHLEVMVLGNLSEQQKKDYLEMLQVFTASRSSHATKPFYYELQSQEISEIHHDYPLTANGMLLLLQDKSSPSIQGKVCAEMLFEWLHHITFEELRTQQQLGYMVGARYREFASRPFGFLYIRSDAYSPEELLAKTSLFLNKVSASPEKFGISQEKFANIRKAYINKILEPEHSLDMMNSALFSLAFERPFVEFSTPDLKIAIAETLTYEEFLKYCQCFLSNELGTQTSVYIRGTQKTS

SEQ ID NO: 1030 - protein, 945 aa, Chlamydia pneumoniae
IYRAIYMQFSRYLRYAFDNQYLPEPLYQKFSVFHQNYIDAATKKAAADQAEVLCLQWVKVIIEDLKNPFIFPPYHKKIRAPIDLFRLSIDFFSLVIDDKNSRILNLHRLKEIEEYIARGDNVVLLANHQTECDPQLMYYALGKTHPELMENMIFVAGDRVTSDPLARPFSMGCDLLCIYSKRHIATPPELREEKLLHNQKSMQILKTLLNEGGKFIYVAPAGGRDRKNAEGRLYPSEFSPESIEVFRLLAKASNQTTHFYPFALKTYDILPPPPKIENAIGEQRAIFFAPVFFNFGAELFFDALCSKEELIHCDKHAQRTLRAEKVFSICKKSIRGIVRCFGNFFVPILICTSLSITSCEQQFKVVPNQCPLQVSTPAAADQKIEKIICSNGLPLLIISDPNLPTSGAALLVKTGNNADPEEYPGMAHFTEHCVFLGNEKYPEVSGFPGFLSENNGVHNAFTYPNKTVFVFSVEHSAFSDALDQFVHLFINPKFRQEDLDREKYAVHQEFAAHPLSDGRRVHRIQQLVAPQGHPCARFGCGNASTLTPVTTEKMAEWFKLHYSPENMCAIAYTSAPLSKAKKQFSKIFSQIPRSKNYERQEPFLPSGDTSSLKNLYINQAIQPTSNLEIYWHIYESSHPIPLGCYKALAEVLRNESKNSLVSLLKNEQLITDLDVEFFRSSLNTGEFYISYELTEKGDKHYSQVIDSTFQYLRYIQEHGIPNYTLEEISTINALNYCYSSKSPLFDLLCKQIVSLGNEDLSTYPYHSLVYPKYSSEDESALLNLVSDPEQARFVLSSKNSEHWEEATQLHDPIFDMTYYVKALDGVQDYGKVQSLKPIALPKPNLFIPKEVTLPGVHLLKKQEFPFAPALSYQDDKLTLYHCEDHYYTAPKLSSQIRIRSPQISRSSPQFLVATELYCLACEPSAFEGVLSRNASWFFFYFCFRW

SEQ ID NO: 1031 - protein, 521 aa, Chlamydia pneumoniae
IGTRKVMENEILLNIESKEIRYAHLKNGQLFDLTIERKKVRQLKGNIYRGRVTNILRNIQSAFINIDERENGFIHISDILENSKKFEQMFDMDVDALPEEASEAPLLSSEEAPIEEFLKLDSPVLVQVVKEPIGSKGARLTSNISIPGRYLVLLPNSPHRGVSRKIEDPHMREQLKQLIRSFEMPQDMGLICRTASTTASTEALINEAHDLLLTWKTILEKFYSTEQPCLLYSETDILKKAVITCIDKNYKRLLIDDYATYQKCKHMLKKYSPDASIKIEYYRDSIPMFERFNIEKEIDKATRRKIWLSSGGYLFFDKTEAMHTIDVNSGRSTQLESGVEETLVQINLEAAEEIARQLRLRNVGGLVIIDFIDMKSRKNQRRVLERLKEHMKYDAARCTILSMSEFGLVEMTRQRNRESLMQTLFTLCPYCSGNAIIKTPESVVIEIERDLKKVINHKEHSHLCLVVHPEIASYMKQENDDNEMINLAKQLKAKLQINTSDSVHLNHYQFFSLITGESIDL

SEQ ID NO: 1032 - protein, 176 aa, Chlamydia pneumoniae
SLSLVSYLSNPQKALVLGSKGFSMDCVDNLKLYIFRLKLPGDTERISYSISPEYIREKGEEELLNSPIEVEGSLGRIDSDQWILSLSLKTQLGLCCPVCNNFFSHSVCLPDLQRVISHDEVGSGVFDCRPLIRQELLLESDCFEECSGQGCPERKNILKFLEDRKKHEGNNPFEYL

SEQ ID NO: 1033 - protein, 213 aa, Chlamydia pneumoniae
MEVQIGIDLMGGDHSPLVVWQVLVDVLKSQSSTIPFAFTLFASEEIRKQIQEEFISDLPQEKFPKIISAENFVAMEDSPLAAIRKKSSSMALGLDYLQEDKLDAFISTGNTGALVTLARAKIPLFPAVSRPALLVCVPTMRGHAVILDVGANISVKPEEMVGFARMGLAYRQCLGDSKIPTIGLLNIGSEERKGTEAHRQTFRMLRETFGELS

SEQ ID NO: 1034 - protein, 127 aa, Chlamydia pneumoniae
RYGSPSPDIPYAARDIWRTFLGNIESGAVFDGAADIVVTDGFTGNIFLKTAEGVFEFLQRILGDKLEADIQRRLDYTFYPGSVVCGLSKLVIKCHGKACGSSLFHGILGSINLAQARLCKRILSNLI

SEQ ID NO: 1035 - protein, 1617 aa, Chlamydia pneumoniae
  SITE 1...1617: Xaa=unknown or other
TPLRFKVAMVAKKTVRSYRSSFSHSVIVAILSAGIAFEAHSLHSSELDLGVFNKQFEEHSAHVEEAQTSVLKGSDPVNPSQKESEKVLYTQVPLTQGSSGESLDLADANXLEHFQHLFEETTVFGIDQKLVWSDLDTRNFSQPTQEPDTSNAVSEKISSDTKENRKDLETEDPSKKSGLKEVSSDLPKSPETAVAAISEDLEISENISARDPLQGLAFFYKNTSSQSISEKDSSFQGIIFSGSGANSGLGFENLKAPKSGAAVYSDRDIVFENLVKGLSFISCESLEDGSAAGVNIVVTHCGDVTLTDCATGLDLEALRLVKDFSRGGAVFTARNHEVQNNLAGGILSVVGNKGAIVVEKNSAEKSNGGAFACGSFVYSNNENTALWKENQALSGGAISSASDIDIQGNCSAIEFSGNQSLIALGEHIGLTDFVGGGALAAQGTLTLRNNAVVQCVKNTSKTHGGAILAGTVDLNETISEVAFKQNTAALTGGALSANDKVIIANNFGEILFEQNEVRNHGGAIYCGCRSNPKLEQKXSGENINIIGNSGAITFLKNKASVLEVMTQAEDYAGGGALWGHNVLLDSNSGNIQFIGNIGGRNFWIGEYVGGGAILSTDRVTISNNSGDVVFKGNKGQCLAQKYVAPQETAPVESDASSTNKDEKSLNACSHGDHYPPKTVEEEVPPSLLEEHPVVSSTDIRGGGAILAQHIFITDNTGNLRFSGNLGGGEESSTVGDLAIVGGGALLSTNEVNVCSNQNVVFSDNVTSNGCDSGGAILAKKVDISANHSVEFVSNGSGKFGGAVCALNESVNITDNGSAVSFSKNRTRLGGAGVAAPQGSVTICGNQGNIAFKENFVFGSENQRSGGGAIIANSSVNIQDNAGDILFVSNSTGSYGGAIFVGSLVASEGSNPRTLTITGNSGDILFAKNSTQTAASLSEKDSFGGGAIYTQNLKIVKNAGNVSFYGNRAPSGAGVQIADGGTVCLEAFGGDILFEGNINFDGSFNAIHLCGNDSKIVELSAVQDKNIIFQDAITYEENTIRGLPDKDVSPLSAPSLIFNSKPQDDSAQHHEGTIRFSRGVPKIPQIAAIQEGTLALSQNAELWLAGLKQETGSSIVLSAGSILRIFDSQVDSSAPLPTENKEETLVSAGVQINMSSPTPNKDKAVDTPVLADIISITVDLSSFVPEQDGTLPLPPEIIIPKGTKLHSNAIDLKIIDPTNVGYENHALLSSHKDIPLISLKTAEGMTGTPTADASLSNIKIDVSLPSITPATYGHTGVWSESKMEDGRLVVGWQPTGYKLNPEKQGALVLNNLWSHYTDLRALKQEIFAHHTIAQRMELDFSTNVWGSGLGVVEDCQNIGEFDGFKHHLTGYALGLDTQLVEDFLIGGCFSQFFGKTESQSYKAKNDVKSYMGAAYAGILAGPWLIKGAFVYGNINNDLTTDYGTLGISTGSWIGKGFIAGTSIDYRYIVNPRRFISAIVSTVVPFVEAEYVRIDLPEISEQGKEVRTFQKTRFENVAIPFGFALEHAYSRGSRAEVNSVQLAYVFDVYRKGPVSLITLKDAAYSWKSYGVDIPCKAWKARLSNNTEWNSYLSTYLAFNYEWREDLIAYDFNGGIRIIF

SEQ ID NO: 1036 - protein, 504 aa, Chlamydia pneumoniae
  SITE 1...504: Xaa=unknown or other
QSILESIIKYFYLIHNSKMHMSNPISLFSPAELIAKYNLIPKTSPIYPRRTELIILEENACQTRLTNVAQVLHPSSLFSMSKKILNPCGCSGGPLCWVILNILAFIITSVLFIILLPVNLIVAGLRLFMPLPPKKIVEDLSEPTTEETNEVIQPFIFALQALLFEDNKLRSFKIVEQSVGKAPLPNPFLNRLVAISPQXSQEAMRKIPDLCSQLKKVLKSLGVLTPEWKHMLKYFEGLKNEHDSNPDKKTFPILIKLLIEALTGKSSLPKTPSTKEKMQAALFIASSCKTCKPTWGEVITRSLNRLYSIANEGDNQLLIWVQEFKERELMSIQDGDDAEEYRFAAQQHGERYTEAIEQVLRNESAAKLQWHVINTMKFFHGKNLGLVTEHLQDTLGALTLRQTTVDTHQGREDADLSAALFLNKYLNSGNQLVNSVFKSMQKADPETKALIREFALDILYASLRLPQTSAHTEVFSTLLMDPETYEPNKACIAYLLYVLKIIEL

SEQ ID NO: 1037 - protein, 615 aa, Chlamydia pneumoniae
KGFSFSKVGLNMIPSGLVYLLYPLGFLASLFFGSAFSIQWWLSKKRKEVYAPRSFWILSSIGATLMIVHGTIQSQFPVTVLHVINLIIYLRNLNITSSRPISFRATLVLMALSVVFVTLPFLYVNMEWMASPNIFHLPLPPAQLSWHLIGCLGLAIFSGRFLIQWFYIESNNTKDFPLLFWKIGLLGGLLALVYFIRIGDPINILCYGCGLFPSIANLRLFYKEQRSTPYLDTHCFLSAGEASGDILGGKLIQSIKSLYPNIRFWGVGGPAMRQEGLQPILNMEEFQVSGFAEVLGSLFRLYRNYRKILKTILKHKPATLIFIDFPDFHLLLIKKLRKHGYRGKIIHYVCPSIWAWRPKRKRILEQHLDMLLLILPFEEGLFKNTSLETVYLGHPLVEEISDYKEQASWKEKFLNSDRPIVAAFPGSRRGDISRNLRIQVQAFLNSSLSQTHQFVVSSSSAKYDEIIEDTLKAEGCQHSQIIPMNFRYELMRSCDCALAKCGTIVLETALNQTPTIVMCRLRPFDTFLAKYIFKILLPAYSLPNIIMNSVIFPEFIGGKKDFHPEETATALDLLNQHGSKEKQKEDCRKLCKVMTTGQIASEEFLKRIFDTLPAV

SEQ ID NO: 1038 - protein, 430 aa, Chlamydia pneumoniae
MVCENNILSGRGLELLKKKSNITLTPTIYSVSNHNIKLKDFSPHALSVIKTLRKAGYIAYIVGGCIRDLLLNTTPKDFDISTSAKPEEIKAIFKNCILVGKRFRLAHIRFSKQIIEVSTFRSGSTDEDVLITKDNLWGTPEEDVLRRDFTINGLFYDPEHEEIIDYTGGVNDLRNRYLRTIGDPFTRFKQDPVRMLRLLKILSRSPFTVETQTQEALIACRQELIKSSRARVFEELIKMLNSGAAKNFFQLLIENHLLEILFPYMDKAFRLNRALEEQTATYLKALDDKILKKEAEYDRHQLMAIFLFPLVNFNVRYKHQKHPYLSLTSVFDYIKNFLEQFFADSFTSCSKKNFILTALILQMQYRLTPLIPTKKALFFNKKLLHHTRFLEALSLLEIRSIVYPKLDKVYVAWIRHHQTLKCKKDSHSQK

SEQ ID NO: 1039 - protein, 395 aa, Chlamydia pneumoniae
  SITE 1...395: Xaa=unknown or other
ERIDCWLNSMGIETLVLGPIPTPGVAFITRAYRADAGIMISASHNPYRDNGIKIFSLEGFKISDVLEQRIETMVSEADFGPLPEDHAVGKNKRVIDAMGRYVEFVKATFPKGRTLKGLKIVLDCAHGASYKVAPSVFEELDAEVICYGCEPTGININEHCGALFPQVIQKAVIEHQAHLGIALDGDGDRIIMVDEKGHIVDGDMILSICAGDLKKRSALPHNRVVATIMTNFGVLKYLEGLGLQVFTSPVGDRHVLHAMLEHEVTXGGEQSGHMIFLDYNTTGDGIVSALQVLRIMIESESMLSDLTAPIVKSPQTLINVAVREKIPLETIPLIERTLRDVQDALGPSGRILLRYSGTENICRVMVEGHKKHQVDCLAKALADVIDAELGTGSRE

SEQ ID NO: 1040 - protein, 161 aa, Chlamydia pneumoniae
MCGIFGYLGNQDGVSIVLEGLAKLEYRGYDSAGLAAVVEQELFIRKTVGRVQELSNLFQEREIPTASVIGHTRWATHGVPTEINAHPHVDEGRSCAVVHNGIIENFKELRRELTAQGISFASDTDSEIIVQLFSLYYQESQDLVFSFCQTLAQLRGSVAAL

SEQ ID NO: 1041 - protein, 307 aa, Chlamydia pneumoniae
RSCALIHKDHPHTILCASQESPLILGLGKEETFIASDSRAFFKYTRHSQALASGEFAIVSQGKEPEVYNLELKKIHKDVRQITCSEDASDKSGYGYYMLKEIYDQPEVLEGLIQKHMDEEGHILSEFLSDVPIKSFKEITIVACGSSYHAGYLAKYIIESLVSIPVHIEVASEFRYRRPYIGKDTLGILISQSGETADTLAALKELRRRNIAYLLGICNVPESAIALGVDHCLFLEAGVEIGVATTKAFTSQLLLLVFLGLKLANVHGALTHAEQCSFGQGLQSLPDLCQKLLAQRVSPFLGAALLL

SEQ ID NO: 1042 - protein, 182 aa, Chlamydia pneumoniae
LTQNNVPLARDYKAYQISVKNFLPNESLHSWAQPYSYEDKFLFLGRRLMYPVVMEAALKLKEIAYIEANAYPGGEMKHGPIALISKGTPVIAFCGDDIVYEKMIGNMMEVKARHAHVIAIAPESREDIAAVSDQQIFVPDCHFLAAPVLYTIVGQVMAYAMALAKGMEIDCPRNLAKSVTVE

SEQ ID NO: 1043 - protein, 259 aa, Chlamydia pneumoniae
  SITE 1...259: Xaa=unknown or other
SHDLDXRIKEPSEHAFYGGIYFRSCRQDFYMPCLLVSLLLPTDCYFCEGGNILCRVFNCQNLGISWIRHLGPLGFAILMGPIIMAGTKVIDYCNRFFMFGLTVAFGIFCALGFLKIQPSFLVRSSWLTTINAFPVFFLAFGFQSIIPTLYYYMDKKVGDVKKAILIGTLIPLVLYVLWEVVVLGAVSLPILSQAKIGGYTAVEALKQAHRSWAFYIAGELFGFFALVSSFVGVALGVMDFLADGLKWNKKSHPNFQFSF

SEQ ID NO: 1044 - protein, 241 aa, Chlamydia pneumoniae
EGSMGLYDRDYIQDSRVQGTFASRVYGWMTAGLIVTSCVALGLYFSGLYRSLFSFWWVWCFATLGVSFFINSKIQTLSVSAVGGLFLLYSTLEGMFFGTLLPVYAAQYGGGVIWAAFGSAALVFGLAAVYGAFTKSDLTKISKIMTFALIGLLLVTLVFAVVSMFVSMPLIYLLICYLGLVIFVGLTAADAQAIRRISSTIGDNNTLSYKLSLMFALKMYCNVIMVFWYLLQIFSSSGNRD

SEQ ID NO: 1045 - protein, 316 aa, Chlamydia pneumoniae
RCINNSLLFPSYLVSFLLLQLTLLLAMFKFFRNKLQSLFKKNISLDLIEDAESLFYEADFGTELTEELCARLRRTKKADASTIKDLITVLLRESLEGLPSQASQSSQTRPIVSLLLGTNGSGKTTTAAKLAHYYKERSESVMLVATDTFRAAGMDQARLWANELGCGFVSGQPGGDAAAIAFDGIQSAIARGYSRVIIDTSGRLHVHGNLMKELSKIVSVCGKALEGAPHEIFMTVDSTLGNNAIEQVRVFHDVVPLSGLIFTKVDGSAKGGTLFQIAKRLKIPTKFIGYGESLKDLNEFDLDLFLNKLFPEVEKI

SEQ ID NO: 1046 - protein, 386 aa, Chlamydia pneumoniae
  SITE 1...386: Xaa=unknown or other
MHLHEYQAKDLLASYDVPIPPYWVVSSEEEGELLITKSGLDSAVVKVQVHAGGRGKHGGVIVAKSSAGILQAVAKLLGMHFTSNQTADGFLPVEKVLISPLVAIQREYYVAVIMDRKHRCPVLMLSKAGGMDIEEVAHSSPEQILTLPLTSYGHIYSYQLRQATKFMEWEGEVMHQGVQLIKKLAKCFYENDVSLLEINPLVLTLEGELLVLDSKITIDDNALYRHPNLEVLYDPSQENVRDVLAKQIGLSYIALSGNIGCIVNGAGLAMSTLDILKLHGGNAANFLDVGGGASQKQIQEAVSLVLSDESVKVLFINIFGXIMDCSVVASGLVAVMETRDQVVPTVIRLEGTNVELGKEIVQQSGIPCQFVSSMEEGARRAVELSM

SEQ ID NO: 1047 - protein, 300 aa, Chlamydia pneumoniae
VCRFRRYMFHSLSKNTPIITQGITGKAGSFHTEQCLAYGTNFVGGVTPGKGGTLWLDLPVYDSVLEAKQATGCRATMIFVPPPYAAEAILEAEEAGIELIVCITEGIPVRDMLEVARVMDNSTSQLIGPNCPGIIKPGECKIGIMPGYIHLPGNIGVVSRSGTLTYEAVWQLTQLKIGQSICVGIGGDPLNGTSFIDVLQALEEDPYTELILMIGEIGGSAEEEAAAWIQAHCTKPVVAFIAGVTAPKGKRMGHAGAIISGNSGDAKSKIQVLRESGVTVVESPAHIGKTVDAVLRAKEL

SEQ ID NO: 1048 - protein, 369 aa, Chlamydia pneumoniae
ILMLVYCFDPSVPTSPEHRLMAALDRWFFLGGHRVRILTLEGNHYRAFQENMSISTVEKILKLISYLLIPIVLIALLIRCFLHSRFKCNWKCDSLSDARVPHDVQPFNDFQLFNNQERLNIWKNRRYVSGIDVLMVPVDYLRSQFPGFKEIPEAIRCENYVSDGQFSEESKTSYLRAMLTDIVGYILSLDETYWTNVILKIRAMCITFESFPGKEADPNYSPRVTHHYFDESWKALARHVLGEGNMVNRLDEALIRTEKPGKEGECITKQFLKDYCKKHLEVMSCPDFIESLVDEKIREFRCPSILNSAVCDVIDRKCQEHLLKAIINEANRRLPGMKNSSFTMRGNQVLFYTIFSPPKLPPAASSVYF

SEQ ID NO: 1049 - protein, 358 aa, Chlamydia pneumoniae
LYINQFANILKSSFLMEVYSFSPSVRTSFQHRVMAALDNWFFLGGRRLKVVSLDSCNSGQACEEYVPISTTEKVLKILSYLLIPIVIIALLIRYLLHSNFTAKVSQKPWLKTLQLGIDIKSFILPGSHVNTMDSATLFKAIRLEGKRVDVEYHRLHSSDKVVFYIPAQKLPDDLRLTHWLPEKETRKTEYVRHMLAHVMGYLTSQGKERLQQVVQDSRSSTSLGAEKVLQYRFIDHPQSQGEFQRLLNENITTKGSEDKEVVQSDLFDMAFQCWWPQFISVIQSPTFSEELVHEMSQKLDLDCIYPEDDEFEQKFLNTLLKAVLHHGFEGISVASMGVIFLICPDSLALQIPFLRNQK

SEQ ID NO: 1050 - protein, 338 aa, Chlamydia pneumoniae
FSPAVRTSFQHRVMAALDAWFFLGGHRLKVVSLDSCNSGWAYQELVSISTTEKVLKLLSYLLVPIVIIALLIRCLLHSNFRIDVEKERWLKIRELGIDIESCKLPSSYVNQVSSFIWFEKDKSKRPRIDVDYHTLHSKDWVVFPIVFQKIPKTSRFSYWFSQKETRKRDYVRNMLDHVIGYLTSEGGEWLQYISKTSYQSATSLDPERVLQYCLTDNQELQGEVQRLLNEESATKSSGDKEVLLSHVSDIICQCWWPKFLEVIQSPAFIEELVEEVSGKLNLDFLCLEKANTLDQELRNSLLRAVVHHGSEGVDIKKVGAGLIIYTEAIQLQIPFSRS

SEQ ID NO: 1051 - protein, 245 aa, Chlamydia pneumoniae
GIDMITKQLRSWLAVLVGSSLLALPLSGQAVGKKESRVSELPQDVLLKEISGGFSKVATKATPAVVYIESFPKSQAVTHPSPGRRGPYENPFDYFNDEFFNRFFGLPSQREKPQSKEAVRGTGFLVSPDGYIVTNNHVVEDTGKIHVTLHDGQKYPATVIGLDPKTDLAVIKIKSQNLPYLSFGNSDHLKVGDWAIAIGNPFGLQATVTVVSSVLKEEINSTLQILKILFRQMLRLIQATLEALF

SEQ ID NO: 1052 - protein, 317 aa, Chlamydia pneumoniae
IPKPPVSFFWKLRPLKSRRLGNCNWKSLRSSSYGHRSVISAKGRNQLHIADFEDFIQTDAAINPGNSGGPLLNIDGQVIGVNTAIVSGSGGYIGIGFAIPSLMANRIIDQLIRDGQVTRGFLGVTLQPIDAELAACYKLEKVYGALVTDVVKGSPADKAGLKQEDVIIAYNGKEVDSLSMFRNAVSLMNPDTRIVLKVVREGKVIEIPVTVSQAPKEDGMSALQRVGIRVQNLTPETAKKLGIAPETKGILIISVEPGSVAASSGIAPGQLILAVNRQKVSSIEDLNRTLKDSNNENILLMVSQGDVIRFIALKPEE

SEQ ID NO: 1053 - protein, 104 aa, Chlamydia pneumoniae
RFSYEILPGGSRGWRSSANLPIVKVLQEIYSDLYNEECLRLVMPATIPIGPLLGEAAQTSPIICGTSYLSDDIHAAEEHFSMDQLKKGFLSICQLLDKLPKIKE

SEQ ID NO: 1054 - protein, 393 aa, Chlamydia pneumoniae
MLNHAKKHAKPYVLIFFSTKDKLSYCDIIFNNCSGKPMNLDSKHFDINSANFLEEFAKFISFPSISADSDHLQDCENCAHFLVDHVNKIFDVELWETPGHPPIIYASYKSEDPLSPTLMLYNHYDVQPAQLSDGWKGDPFILREENGNLYARGASDNKGQCFYTLKALQHYYESQGNFPLNIIWLIEGEEESGSLALFTWLEKKKEALRADYLLIVDGGFLSEKHPYVSIGARGIVSMKISLEEGNKDMHSGVLGGIAYNTNRALSEILSSLHHPDNSIAIEGFYDDLALPSDSDRPDLPKSDTLRECEENLGFRPQGYEASYSPEESALRPTVEINGISGGYTGPGFKTVIPYRATAYLSCRLVPNQDPDKAAHQVIHHLKQQVPSSLKVLL

SEQ ID NO: 1055 - protein, 978 aa, Chlamydia pneumoniae
VTESMKAGDTYRNFIIKSCKDLPEIESKLLEAEHKPTGASIMMIVNNDEENVFNICFRTCPQTSNGVAHVLEHMVLCGSENYPVRDPFFSMTRRSLNTFINAFTGPDFTCYPAASQIPEDFYNLLSVYIDAVFHPLLTKQSFLQEAWRYEFNSENHLCYTGVVFNEMKGAMMSGEARLSEALNAAIFPSVTYGVNSGGEPREIVTLSHEDVRAFHQSQYSINRCLFYFYGNIKPSRHLDFLEEKLLRQATKLEKQAVSVPLQKRFKEPVRNILTYPVDHQEEDKVLFGISWLTCSILEQQELLALHVLEIILMGTDASPLKSRLLKSGFCKQTEMSIENDIREIPMTLVCKGCSPAGAQKLEALIFASLEEIIREGISENIVEGAVHQLELSRKEITGYSLPYGLSLFFRSGLLKQHGGSAEDGLRIHNLFSELRNSLKNSDYLAKLIRKYFLDNPHFARVILLPDTELVAKDNKDEQQLLLSVSEKLTDENKEKIQQNVRELTESQEQKEDLNGILPNLALDKVPTSGKEFPLIKEGLSQGEVLHHECFTNDIVFIDVVLDIPPLSGEELPWLRLLVFLMLQLGCGGRSYKEHLEFLLEHTGGVDVSYDFSPHANKNSFLSPSVSIRGKALSSKSEKLCGIVSDMLTSVDFTDIPRIRELLMQHNEALTNSVRNSPMSYAVSMACSGNSITGAMSYLTTGLPYVKKIRELTKNFDQNIDEAVVILQRLYTKCFSGKRQIVISGSAHNYQQLKDNKFYGLLDYLIVIPEPWENPSINLYVTSRGLHIPARAAFNALAFPIGDIAYDHPDAAALTVAAEILDNVVLHTKIREQGGAYGSGAAANLSRGSFYCYSYRDPEIATTYKTFLKGVSEIASGNFTKEDIYEGALGVVQGLDMPVAPGSRASVAFYRLKSGRIPVLRQAFRRSVLEVTKEHICMVMDKYLESTVQETTLISFAGEEMLRNNVLTLDKDFPIVPAI

SEQ ID NO: 1056 - protein, 418 aa, Chlamydia pneumoniae
KKELASVMNLPVSLACLLLSGCVFFLGVFVSSSLYARKKRAFLEKIQKLEHENQLLQTSLNLSRHQEQLIEDFSNRLALSSHKLIKDMKEEAQNYFGDTSKSFQSILSPIQTTLTTFKQSLETFETKHAEDRGRLKEQISQLLAVEKKLEHETHVLTDILKHPGSRGRWGEIQLERILELAGMLKYCDYDSQTTSAQGAFRADIIIRLPQDRCLIIDAKAPISDSYFSVEEIDKGDLVDKIKEHIKTLKSKSYWEKFHQSPEYVILFLPGESLFNDAIRLAPELMEIGASSNVILSSPLTLLALLKTIAYMWKQENLQKQIQEVSLLGKELHRRLQVVFTHFQKIGKNLNQTVQSYNDMTSSFQYRVLPTLRKFEGLETSSSHQIEEPTPIESLATSFPHTCDIDTNLAVIESLEKQD

SEQ ID NO: 1057 - protein, 265 aa, Chlamydia pneumoniae
MAGLDLEARGKRRVVTPNAITAFGLCCGLFIIFKSVLRTSSSVELFHRLQGLSLLLISAMIADFSDGAIARIMKAESAFGAQFDSLSDAVTFGIAPPLIAIKSLDGIYVGNFFSSLLLITSIIYSLCGVLRLVRYNLFSQKTVDVSKPYCFIGLPIPAAAASIVSLALFLASDFFPDLPAQLRVGLLSFALLFIGGLMISPWKFPGVKHFRFNVSSFLLVVTIGLAACLFFSGLVDHFVEVFFLVSWLYTLVGFPIFSIIYRKKS

SEQ ID NO: 1058 - protein, 1047 aa, Chlamydia pneumoniae
GKVMVEVEEKHYTIVKRNGMFVPFNQDRIFQALEAAFRDTRSLETSSPLPKDLEESIAQITHKVVKEVLAKISEGQVVTVERIQDLVESQLYISGLQDVARDYIVYRDQRKAERGNSSSIIAIIRRDGGSAKFNPMKISAALEKAFRATLQINGMTPPATLSEINDLTLRIVEDVLSLHGEEAINLEEIQDIVEKQLMVAGYYDVAKNYILYREARARARANKDQDGQEEFVPQEETYVVQKEDGTTYLLRKTDLEKRFSWACKRFPKTTDSQLLADMAFMNLYSGIKEDEVTTACIMAARANIEREPDYAFIAAELLTSSLYEETLGCSSQDPNLSEIHKKHFKEYILNGEEYRLNPQLKDYDLDALSEVLDLSRDQQFSYMGVQNLYDRYFNLHEGRRLETAQIFWMRVSMGLALNEGEQKNFWAITFYNLLSTFRYTPATPTLFNSGMRHSQLSSCYLSTVKDDLSHIYKVISDNALLSKWAGGIGNDWTDVRATGAVIKGTNGKSQGVIPFIKVANDTAIAVNQGGKRKGAMCVYLENWHLDYEDFLELRKNTGDERRRTHDINTASWIPDLFFKRLEKKGMWTLFSPDDVPGLHEAYGLEFEKLYEEYERKVESGEIRLYKKVEAEVLWRKMLSMLYETGHPWITFKDPSNIRSNQDHVGVVRCSNLCTEILLNCSESETAVCNLGSINLVEHIRNDKLDEEKLKETISIAIRILDNVIDLNFYPTPEAKQANLTHRAVGLGVMGFQDVLYELNISYASQEAVEFSDECSEIIAYYAILASSLLAKERGTYASYSGSKWDRGYLPLDTIELLKETRGEHNVLVDTSSKKDWTPVRDTIQKYGMRNSQVMAIAPTATISNIIGVTQSIEPMYKHLFVKSNLSGEFTIPNTYLIKKLKELGLWDAEMLDDLKYFDGSLLEIERIPNHLKKLFLTAFEIEPEWIIECTSRRQKWIDMGVSLNLYLAEPDGKKLSNMYLTAWKKGLKTTYYLRSQAATSVEKSFIDINKRGIQPRWMKNKSASTSIVVERKTTPVCSMEEGCESCQ

SEQ ID NO: 1059 - protein, 365 aa, Chlamydia pneumoniae
LFNGRRLRILSITEKRGAKMEADILDGKLKRVEVSKKGLVNCNQVDVNQLVPIKYKWAWEHYLNGCANNWLPTEVPMARDIELWKSDELSEDERRVILLNLGFFSTAESLVGNNIVLAIFKHITNPEARQYLLRQAFEEAVHTHTFLYICESLGLDEGEVFNAYNERASIRAKDDFQMTLTVDVLDPNFSVQSSEGLGQFIKNLVGYYIIMEGIFFYSGFVMILSFHRQNKMTGIGEQYQYILRDETIHLNFGIDLINGIKEENPEVWTTELQEEIVALIEKAVELEIEYAKDCLPRGILGLRSSMFIDYVRHIADRRLERIGLKPIYHSRNPFPWMSETMDLNKEKNFFETRVTEYQTAGNLSW

SEQ ID NO: 1060 - protein, 228 aa, Chlamydia pneumoniae
FLLFMKPQDLSPPFLWKERRPCIQDGVLYVPRHYFEHQNFSTSYHQEFFQNHTSIACELCSGNGDWVVAQAQKDPQVLWIAVEQRFDRVRKIWSKMINHQIQNLRIVCGTAETFFQYYVPDQFLQRLVVNFPDPWPKMRHRKHRLLQPSFVQEISRSLQDSAVFALATDDKTYLLESIEALQTHLAPRMETPYYIKMTDTYGNSWFENLWRTKGQEIFYTEFIKKAGI

SEQ ID NO: 1061 - protein, 175 aa, Chlamydia pneumoniae
MFAYRTLLTHNVVQVSHEIFKTTVVPGDTVIDATCGNGNDSLFLARLLQGEGRLVVYDIQKEALSNALLLFETHLSEQERSVIEMKEQSHEHILEKDVKLIHYNLGYLPKGNKEITTLARTTEISLEYALNIVRPDGLITVVCYPGHPEGEKETHSVESLAQRLHPKEWCVSHFM

SEQ ID NO: 1062 - protein, 97 aa, Chlamydia pneumoniae
RSPIRSLLLAVFSVILKELLLASLLTQPGLKGLAIGGAQISPLHANFIINTGKATSDEVKQLIAIIQSTLKTQGIDLEHEIRIIPYQPKIHSPVSEK

SEQ ID NO: 1063 - protein, 263 aa, Chlamydia pneumoniae
MKEAAPMHFPFPVRRSVWLNRYSTFRIGGPANYFKAIHTIEEAREVIRFLHSINYPFLIIGKGSNCLFDDRGFDGFVLYNAIYGKQFLEDARIKAYSGLSFAALGKATAYNGYSGLEFAAGIPGSVGGAIFMNAGTNESDISSVVRNVETINSEGELCSYSVEELELSYRSSRFHRQQEFILSATFQLSKKQVSADHSKSILQHRLMTQPYTQPSAGCIFRNPEGTSAGKLIDAAWVEGISNRRGTNFSVACKLHYQYWQGHF

SEQ ID NO: 1064 - protein, 179 aa, Chlamydia pneumoniae
LRTSLAVKCVLLTIFWLLVMATLSPEKFSGSPISISKEFPQQKMREIILQMLYALDMAPSAEDSLVPLLMSQTAVSQKHVLVALNQTKSILEKSQELDLIIGNALKNKSFDSLDLVEKNVLRLTLFEHFYSPPINKAILIAEAIRLVKKFSYSEACPFIQAILNDIFTDSSLNENSLSI

SEQ ID NO: 1065 - protein, 187 aa, Chlamydia pneumoniae
SVALNFKINRQIRAPKVRLIGSAGEQLGILAIKDALDLAREAGLDLVEVASNSEPPVCKIMDYGKYRYGLTKKEKDSKKAQHQVRIKEVKLKPNIDENDFSTKLKQARTFVEKGNKVKITCMFRGRELAYPEHGFKVVQKMSQGLEDIGFVEAEPKLAGRSLICVVAPGTVKTKKKQEKSHAQDENQ

SEQ ID NO: 1066 - protein, 121 aa, Chlamydia pneumoniae
MVRATGSVASRRRRKRILKQAKGFWGDRKGHIRQSRSSVMRAMAFNYMHRKDRKGDFRSLWIARLNVASRIHSLSYSRLINGLKCANISLNRKMLSEIAIHNPEGFAEIANQAKKALEATV

SEQ ID NO: 1067 - protein, 339 aa, Chlamydia pneumoniae
MEMKEEIEAVKQQFHSELDQVNSSQALADLKVRYLGKKGIFRSFSEKLKQCTDKAKLGSLINDFKTYVEDLLQEKSLVLLASEQAEAFSKEKIDSSLPGDSQPSGGRHILKSILDDVVDIFVHLGFCVREAPNIESEANNFTLLNFTEDHPARQMHDTFYLNATTVLRTHTSNVQARELKKQQPPIKVVAPGLCFRNEDISARSHVLFHQVEAFYVDHNVTFSDLTAILSAFYHSFFQRKTELRFRHSYFPFVEPGIEVDVSCECCGKGCALCKHTGWLEVAGAGMIHPQVLRNGNVDPEIYSGYAVGMGIERLAMLKYGVSDIRLFSENDLRFLQQFS

SEQ ID NO: 1068 - protein, 690 aa, Chlamydia pneumoniae
LFWFHRGGRMKRSRRNFEQALENLEKLKEISLATSNDSYLNNPARFNQRKQTGSSVMEMKEALKNVENYLLEISCVSKSHADKALKESDFLIAGVQNVFSFLENQEDLYKSLLDEYSEVTKAYDEVKKNLKEVPTYDLSTDEETEEHKEPECFLNNLVEVKRDRSYELFYMLDEQDKRFYNDALVQIIYKQNKLHETVNEGDPLTKTLLWNSEEVKNIASSLVIVNDMPLRLFYQRALSHLDIEAVVKVHNAVMALFFSRYEATMVFKSPKKHNIWYFNDFLLFLREAWKDLNNNVIDSQERKQTKLLASALSLGIFESKLVFEEASRYLYFNIQTKLENANGKKPLSPGQYLTDAYEELHRLISKYPNGPLFKAMDRVLEHESRPYDPMILGILPSLEGTLKLHGKSIDIIRSPSPVTQSSILYANCNEEFLGFLNAKAHRSEVTLVLNIQNRISRKERARSRVIEEALEQEEHAPYVHAFSFPEPEELLQNLESIHGDIETFADFFSILQEEFHKPLLASSFFLTKELKEFVGSFLKEKLTALKDIFFAKKKILFRNDKLLLLHLLSYLIVFKLIERTNPNSIVVVSKDGLDYVSVFIAGFAFFSREAFWDEHSLKLLLTNVLSPTLVARDRLVFVSHIELLSKFVNCLKKNRQGFSSLKSFFKDDIEGWEFTGYLHELTEVSHKHNL

SEQ ID NO: 1069 - protein, 367 aa, Chlamydia pneumoniae
RMLIWKRHLLTRFWFALTSLLVLALIFYASIHHSLHTLKGASTAASGASVKLSILYYLAQISLKAEFLMPQLVAVATTSTLFAMQNKREIILLQASGLSLKSLMHPLLLSGAVIMMVLYANFQWLHPICEKISITKENMDRGTTDKEQGKIPALYLKDQTVLLYSSIEPKTLTLNNVFWIKDPKTIYTMEKLAFTTLSLPIGLNVTQFFANDSENLELKEFFDMKEFPEIEFNFYENPFSKLFSAGNKNRLSEFFKAIPWNATGLGLSTQVPQRILSLLAQFYYVLISPLACMAAIILSAYLCLRFSRTPTVTLAYLIPLGTVNIFFVFLKAGIVLASSSVLPTLPVMAFPLIVLFLLTNYAYAKLQ

SEQ ID NO: 1070 - protein, 358 aa, Chlamydia pneumoniae
AMPILWKVLIFRYLKTAAFCTLSLICISIISSLQEIVAYIAKDVPYDTVLRLMAYQIPYLLPFILPGSCFVSAFSLFRKLSDNNHMTFLRASGASQSIIMFPVLMVSGAICCLNFYTCSELASICRYQTCKEIANMAMTSPALLLQTLQKKENNRIFIAVDHCAKSKFDNVIVALKGNNEISHVGIIKSIIPDTTKDTVKAKDVVFISKLPDSLTESSSPSSQRFYIETLDELLIPKITSTLFAGKSYLKTRTDYLPWKQLVKQSLKHSHLPETLRRVAIGFLCITLTYAGMILGIHKPRFRKSIALYFIFPILDLILLIVGKNTKNLPLAFMLFVFPQLVSWVVFAARAYRESRGYA

SEQ ID NO: 1071 - protein, 319 aa, Chlamydia pneumoniae
MVLSSDLLRDDKQLDLFFASLDVKKRYLLALSGGSDSLFLFYLLKERGVSFTAVHIDHGWRSTSAQEAKELEELCAREGVPFVLYTLTAEEQGDKDLENQARKKRYAFLYESYRQLDAGGIFLAHHANDQAETVLKRLLESAHLTNLKAMAERSYVEDVLLLRPLLHIPKSSLKEALDARGISYLQDPSNEDERYLRARMRKKLFPWLEEVFGKNITFPLLTLGEESAELSEYLEKQAQPFFSAATHQDSQGELPCPDCLIQQAFLCKWVMKKFFNNAGIAVSRHFLQMVYDHLSRSSCATLRMRNKIVIIKPGVVVID

SEQ ID NO: 1072 - protein, 918 aa, Chlamydia pneumoniae
  SITE 1...918: Xaa=unknown or other
LISLVVKFMSKDKKMKPEPKKNFPTVFFFLLFGVVFGVVAFQNFLAGKKARVGFSHQIEHLVNLRLIVPEDSHKIALNDNLVSFGGRFRDVQTQEGQLRYHYLELIDQGHRLDLDLQETSKSLTTLGKEVTNSILWFSAISGSPIPEQGYAISYPSEVSGSVLTEPLVVTGPATPQLINLHSLQERYPTLSRSPEALRTYGSDLYELIGKYLSPVLGIGSETLKRELKDLYQQVEVSLTQETDTEAAYTLYGQVLSTLNRISSSLVVSEGGERFSQLRSVRLYREEWNKYHKLVEARDLNQAQLEKLRGELSQTVWYFNNQELSSRSLEKQDPEVFGHWFAGAKEEWTAFKFNHSLSFKAPDQPRNLVLEKTFKSQEPSPHXLGYLFTXLPIILVLLFVYLVFSRQMRGMSGSAMSFGKSPARMLLKGQNKVTFADVAGIEEAKEELIEIVDFLKNPNKFTSLGGRIPKGVLLIGPPGTGKTLIAKAVSGEADRPFFSIAGSDFVEMFVGVGASRIRDMFEQAKRNAPCIIFIDEIDAVGRHRGAGIGGGHDEREQTLNQLLVEMDGFGTNEGVILMAATNRPDVLDKALLRPGRFDRRVVMNLPDIKGRFEILMVHAKRIKLDPTVDLMAVARSTPGASGADLENLLNEAALLAARKDRTAVTAVDVAEARDKVLYGKERRSLEMDAEERKTTAYHESGHAVVGLCVQHGDPVDKVTIIPRGLSLGATHFLPEKNKLSYWKKELYDQLAVLMGGRAAEEIFLGDISSGAQQDISQATKLVRSMVCEWGMSPQLGNVTYDERSDGLTGYGGYHEKSYSEETAKTIDTELRMLLDAAYQRALDIINEHKAEIELMTQMLIEFETLDSKDVKEIMDHTWDPEKKRARLKEEGMLFKKSSDDLPPPPPKEDTLPGLGFNAT

SEQ ID NO: 1073 - protein, 568 aa, Chlamydia pneumoniae
  SITE 1...568: Xaa=unknown or other
SSCYLRXSAALAISDIPQSNIVAGVRIGCIDNQWVINPTKTELASSTLDLVLAGTENAILMIEGHCDFFTEEQVLDAIEFGHKHIVTICKRLQLWQEEVGKSKNLSAVYPLPAEVLTAVKECAQDKFTELFNIKDKKVHAATAHEIEENILEKLQREDDDLFSSFNIKAACKTLKSDTMRALIRDREIRADGRSLTTVRPITIETSYLPRTHGSCLFTRGETQTLAVCTLGSEAMAQRYEDLNGEGLSKFYLQYFFPPFSVGEVGRIGSPGRREIGHGKLAEKALSHALPDSATFPYTIRIESNITESNGSSSMASVCGGCLALMDAGVPISSPIAGIAMGLILDDQGAIILSDISGLEDHLGDMDFKIAGSGKGITAFQMDIKVEGITPAIMKKALSQAKQGCNDILNIMNEALSAPKADLSQYAPRIETMQIKPTKIASVIGPGGKQIRQIIEETGVQIDVNDLGVVSISASSASAINKAKEIIEGLVGEVEVGKTYRGRVTSVVAFGAFVEVLPGKEGLCHISECSRQRIENISDVVKEGDIIDVKLLSINEKGQLKLSHKATLE

SEQ ID NO: 1074 - protein, 127 aa, Chlamydia pneumoniae
  SITE 1...127: Xaa=unknown or other
SDRSKILVFETGKIARQANGAVLVRSGETCVFASACAVDLDDKVDFLPLRVDYQEKFSSTGKTLGGFIKREGRPSEKEILVSRLIDRSLRPSFPYRLMQDVQVLSYVWSYDGQVLPDPLAICAXLLL

SEQ ID NO: 1075 - protein, 163 aa, Chlamydia pneumoniae
LGGEKLINMEKDIFFMQQAFKEARKAYDQDEVPVGCVIVKDDKIIARAHNSVEKLKDATAHAEILCIGSAAQDLDNWRLLDTVLYCTLEPCLMCAGAIQLARIPRIVWAAPDVRLGAGGSWVNIFTEEHPFHTVSCTGGVCSEEAEHLMKKFFVEKRREKSEK

SEQ ID NO: 1076 - protein, 100 aa, Chlamydia pneumoniae
  SITE 1...100: Xaa=unknown or other
KSAERKVKNKIVTLLDQLYEDQESRLQKLGEEIVPNLTPEDLLQPMDFXQLEGNPAFRFEEGVLSGIGEVRAAIFNGALSRELESQRSSIGVGDLFFFTK

SEQ ID NO: 1077 - protein, 180 aa, Chlamydia pneumoniae
HLSIEELMSIQPVSNTTTKADKVIPDSTKVISDSITINKQSAFYFCISVMLRLSESTTEYGKSILAVLEDNTIVQQQRVKELINLPLLKVPDLQKKDGSDDEYKNQNEIQAYQSSNQQISANRQMIQQELSSAQQRAQANQKSVNSTTIESMQILQATSSMLSTLKELTIKANLTNSPSD

SEQ ID NO: 1078 - protein, 181 aa, Chlamydia pneumoniae
  SITE 1...181: Xaa=unknown or other
NRKPVRLNMWIIDPLSAKXPLQAAINVPGTPITGGPNTATADDIIAKFSKDSNPLIVTVYYVYQSVLVAQDNLSIIAQELQANSSAQTYLNNQEALYQYVSIPKNKLNDNSSSYLQNIQSDNQAIGASRQAIQNQISSLGNAAQVISSNLNTNNNIIQQSLQVGQALIQTFSQIVSLIANI

SEQ ID NO: 1079 - protein, 168 aa, Chlamydia pneumoniae
TKVNFFIMSITTLGTLPTVNTINSSRPPLEPLNTPKIGAVLFSIYELLLQAIEIRQQTVLTQSQQLNDNTNIQQQLNQETNQIKYAIVSAGAKEDEITRVQNQNQNYSAQRSNIQDELVTTRQNGQIILSHASTNINIIQQQSSQDSSFIKTTNSIGSTVNQLNKPLG

SEQ ID NO: 1080 - protein, 440 aa, Chlamydia pneumoniae
VLNYSFIGMLKPMYVLSKRLYRWVNQLIKLGDLVKNSRSFSVEWVFISALLLIFGCLGCASVVKVSLVPFLLLFSFLAFPLILCFRGKGYALLLGVFVTLYVAKYVVGETLYVSFWLSGLGVSFLLAFGLFLQGVWLAQEEEMVKGKEQLRLSEDLDAQRSAYEDLLLTKSQEKEFLDARAQGLDRELTECQELLKAAYQKQEYLTIDLKILADQKNSWLEDYAELHNKYIELVSKNGDVVFPWVAEPSVGESQGSERVDVSRWVSALQEKEESLERLRNEILVEKQRCSDYEHRCQELGLLLQNFTALERRCEELQNLLNQKETQINELHQLVCKSEEKVSVEPSAHAETSCVEEKQYKGLYSQLQEQFLEKSETLSLVRKKLFAVQEKYLTLKKKEELTKQDISFDDISMIQGLLERIEILEEEVSHLEELVSRSLSL

SEQ ID NO: 1081 - protein, 294 aa, Chlamydia pneumoniae
VILMKRNDPCWCGSGRKWKQCHYPQPPKMSPEALKQHYASQYNILLKTPEQKAKIYNACQITARILDELCKASQKGVTTNELDELSQELHKKYDAIAAPFHYGSPPFPKTICTSLNEVICHGIPNDIPLKDGDIMNIDVSCIVDGYYGDCSRMVMIGEVPEIKKKICQAALECLNDSIAILKPGIPLCEIGEAIEARADTYGFSVVDQFVGHGVGIEFHENPYVPHYRNRSMIPLAPGMIFTIEPMINVGKKEGVVDPKNQWEARTCDNQPSAQWEHTIAITETGYEILTLLND

SEQ ID NO: 1082 - protein, 202 aa, Chlamydia pneumoniae
MLILLNLSLLFYVLFDSPGSIPVFVALLKNFSRKKQQRVILRECLFALGALILFVTFGRSFFQFLDISLYAFQIIGGFLLFTVSIKMMLAPMPEKAKDDTSKTEPIFFPLAFPVITGPAVITALLSYMEEGIYSREIIFTAMIIAWAFSLFTLLCSSFFDRLSGNFGLLALERLFGIALLLMSVNLMLKGISIAFNIGFYIG

SEQ ID NO: 1083 - protein, 251 aa, Chlamydia pneumoniae
TSRYGPLPCSRHHEDLHKRHANTNRREIDRQFPARFLYRSQDPIYKFEDLNGKVLGFCLNNSRDLNRLLETLNRNGVVPSEVKNVSSDLISPMLLNKIDFLYGAFYNIEGVKLQTLGMPVKCFLSDTCDLPTGPQLIVFTKKGTKASEPEIVEAFQKALQESIIFSKDHPEDAFKLYAKETKSIPKNLYQEYLQWEETFPLLAQSQDPLSKDLVDKLLETIIKRYPELASEVAKFSLNDLYNPSLPEEQSV

SEQ ID NO: 1084 - protein, 303 aa, Chlamydia pneumoniae
RSPTTSFHPATVHSYVCSGSTDCTLVWLGNRCCNRPYSTHHILSAHPDYLSGHLINTRRTYRAIRPLRSTKFQLLIKLRIPHALPHIFSGLKIAIGSAGFAAIAGEWVASQSGLGILMLESRRNYEMELAFAGLATLSILTLSLFQITLLIEKLIFSLFRVKRMSLKHKSVAKKALSVLALIPIMLIPWKGNSKSPPDKKNLTSLTLLLDWTPNPNHIPLYAGVAKGYFKQHGLDLQLQKNTDSSSAVPHVLFEQVDMALYHALGIMKTSIKGMPIQIVGRLIDSSLQDFSTEVRTPSTNLKT

SEQ ID NO: 1085 - protein, 460 aa, Chlamydia pneumoniae
  SITE 1...460: Xaa=unknown or other
MRQEKDSLGIVEVPEDKLYGAQTMRSRNFFSWGPELMPYEVIRALVWIKKCAAQANQDLGFLDSKHCDMIVAAADEILEGGFEEHFPLKVWQTGSGTQSNMNVNEVIANLAIRHHGGVLGSKDPIHPNDHVNKSQSSNDVFPTAMHIAAVISLKNKLIPALDHMIRVLDAKVEEFRHDVKIGRTHLMDAVPMTLGQEFSGYSSQLRHCLESIAFSLAHLYELAIGATAVGTGLNVPEGFVEKIIHYLRKXTDEPFIPAXNYFSALSCHDALVDAHGSLATLACALTKIATDLSFLGSGPRCGLGELFFPENEPGSSIMPGKVNPTQCEALQMVCAQVLGNNQTVIIGGSRGNFELNVMKPVIIYNFLQSVDLLSEGMRAFSEFFVKGLKVNKARLQDNINNSLMLVTALAPVLGYDKCSKAALKAFHESISLKEACLALGYLSEKEFDRLVVPENMVGNH

SEQ ID NO: 1086 - protein, 443 aa, Chlamydia pneumoniae
ARSLNTCPIPLSQDSPTGLAIIIFSSQIKDFLGLQMGANIPADFLPKWIAYWDHLWTWDSKSFAVGLFTLLIMIYFRNYKPRYPGVMIAIVTATTLVWLLKIDIPTIGSRYGTLPTAIPLPKIPQLSITKILQLMPDALTIAVLSGLETLLSAVVADGMTGWRHQSNCQLVAQGVANIGTSLFSGIPVTGSLSRTAASIKSEATTPIAGIVHSIFICFILLLLAPLTVKIPLTCLAAVLILIAWNMSEIHHFIHLFTAPKKDIVVLLTVFILTVMTTITAAVQVGMMLAAFLFMKQMSDLSDVISTAKYFDKDSDFLSKAEVPQNTEIYEINGPFFFGIADRLKNLLNDIEKPPKIFILCMTRVPTIDASAMHALEEFFLECDRQGTLLLLAGVKKTPLADLKRYHLDELIGVDHIFSNIKSALLFAQALTNLESKTSTRHLV

SEQ ID NO: 1087 - protein, 143 aa, Chlamydia pneumoniae
KNFIPKLYTSIKEGYSFNTFKKDFQAGITVGILAFPFAIAIAIGVGVSPIQGLLASIIGGLLASAMGGSNVLISGPSSAFISILYCLSAKYGAEALFTVTLLAGVFLIAFGLTGLGTFIKYMPYPVVTGLTHRTCDHYILLAN

SEQ ID NO: 1088 - protein, 422 aa, Chlamydia pneumoniae
  SITE 1...422: Xaa=unknown or other
VTMLKLQLCALFLFGYLAIVFEHIVRVNKSAIALAMGGLMWLVCFSHIPMADHMILVEEIADMSQVIFFLFSAMAIVELIDAHKGFSVIVKFCRIQSRTLLLWALIGLSFFLSAALDNLTSIIIIISILKRLVKAREDRLLLGAICVIAVNAGGAWTPLGDVTTTMLWINNKITSWGIIRALFVPSLVCVLVAGFCGQFFLRKRGSTLIAKDVELQSAPPKSLWIIFIGLGSLLMVPVWKACLGLPPFMGALLGLGLVWLTSDWIHSPHGEDRYHLRVPHILTKIDISSITFFIGILLAVNALSFANLLTDFSLWMDKIFSRNVVAIVIGLLSSVLDNVPLVAXTMGMYTLPLDDTLWKLIAYAAXTGGSILIIGSAAGVAFMGLEKVDFLWYFKRISWIALASYFGGLFSYFVLESLNFFI

SEQ ID NO: 1089 - protein, 624 aa, Chlamydia pneumoniae
KREVFMKKGKLGAIVFGLLFTSSVAGFSKDLTKDNAYQDLNVIEHLISLKYAPLPWKELLFGWDLSQQTQQARLQLVLEEKPTTNYCQKVLSNYVRSLNDYHAGITFYRTESAYIPYVLKLSEDGHVFVVDVQTSQGDIYLGDEILEVDGMGIREAIESLRFGRGSATDYSAAVRSLTSRSAAFGDAVPSGIAMLKLRRPSGLIRSTPVRWRYTPEHIGDFSLVAPLIPEHKPQLPTQSCVLFRSGVNSQSSSSSLFSSYMVPYFWEELRVQNKQRFDSNHHIGSRNGFLPTFGPILWEQDKGPYRSYIFKAKDSQGNPHRIGFLRISSYVWTDLEGLEEDHKDSPWELFGEIIDHLEKETDALIIDQTHNPGGSVFYLYSLLSMLTDHPLDTPKHRMIFTQDEVSSALHWQDLLEDVFTDEQAVAVLGETMEGYCMDMHAVASLQNFSQSVLSSWVSGDINLSKPMPLLGFAQVRPHPKHQYTKPLFMLIDEDDFSCGDLAPAILKDNGRATLIGKPTAGAGGFVFQVTFPNRSGIKGLSLTGSLAVRKDGEFIENLGVAPHIDLGFTSRDLQTSRFTDYVEAVKTIVLTSLSENAKKSEEQTSPQETPEVIRVSYPTTTSAL

SEQ ID NO: 1090 - protein, 310 aa, Chlamydia pneumoniae
MRKLILCNPRGFCSGVVRAIQVVEVALEKWGAPIYVKHEIVHNRHVVNALRAKGAIFVEELVDVPEGERVIYSAHGIPPSVRAEAKARKLIDIDATCGLVTKVHSAAKLYASKGYKIILIGHKKHVEVIGIVGEVPEHITVVEKVADVEALPFSSDTPLFYITQTTLSLDDVQEISSALLKRYPSIITLPSSSICYATTNRQKALRSVLSRVNYVYVVGDVNSSNSNRLREVALRRGVPADLINNPEDIDTNIVNHSGDIAMTAGASTPEDVVQACIRKLSSLIPGLQVENDIFAVEDVVFQLPKELRCS

SEQ ID NO: 1091 - protein, 245 aa, Chlamydia pneumoniae
RMSYFNYQKNSVVLRSLGLLAKFFSRLLYRVFFSFREGIYLFSSLYLKYPRLFFYDLGKYVYSLRHCPYAKLGRLPGASLLKEGNVYGETPWSVLAKICQAFDITSQDILYDLGCGLGKVCFWFSHVVRCQVIGIDNQPHFIRFSSNMHRKLSSGFALFDTEEFKNVVLSQASYVYFYGSSFSRRLLNEIILKLSEMAPGSVVISISFPLDSFSRGKECFFTEKSCSVRFPWGKTIAYKNIRKGS

SEQ ID NO: 1092 - protein, 385 aa, Chlamydia pneumoniae
KSLSAESTSSNSTGKASTETTSSSFPFFSCKAPEGDSSVDKTFTVSVQTPKAQEQQEASASQSQAQFHVRSYSSSTIKEHSAKEKVSQSTKSAETQKHTQTKSDATLSPMSLYSTLHKEVPQALSSTKSQQKDEEHRDQRQQEGYEQEQEQEEGKKKTPWCTVESLQQTSSSNQVYESYTPIIPDPIVEFALSESQLSVLAGKRVTNLDVLRICTELMKLMLKSRANDTMTRLEERELMEREAHELAASYSRQAKYARWLGIATATLGILGAIAPMVGEISGDSILGFVQRISGRFKDATAKTFFKGIGKVFTSLSQLTEAASKVHELSESAVRAVAEYRKEVFRMRQDEVTRTIEEVKDNWKSMDNFLLNILQTEHDAARSLYQ

SEQ ID NO: 1093 - protein, 112 aa, Chlamydia pneumoniae
  SITE 1...112: Xaa=unknown or other
IHRRXIMTVSYQSISTPPPEGEFDIFVDGNATEEAVVAAEVQVALPAGEQYAMLRATSELCFGIXTQSECALTQALPPKEKTITRRAISSKKWHINAINISAEPKTRTIAAD

SEQ ID NO: 1094 - protein, 515 aa, Chlamydia pneumoniae
CGNSTMSSWLSQASEVLLNQDPYIPDAPRSQESSVPKISYSITVAPQEAQKSLPKFFTQKFQSQCKSEPPITHHKTFIIATPRERILRFGSSFESQLHNTSQAQTSSPWNLFSQKNSTEASKALMQELTMPKSPEKTSEKALDKNLSSKQEGSCKNFDTLHLQQHLKLFGTVDSLYSQSLDSEQQELLQSRREERSETYANQQSSEKKIETKVQIKDLCKDLFSQDQDSNQKQKKSPFQQDTSRKNRIAKAAQAVPVIPPPSIGVFTLSYLLTKQGILSDFSSYGCHKDSVESTQRELDALHEKRIETIKVSIEKEKRERLWGSLSDIIGWLAPFVSIGIGIVAILSGGGIFAFAGFFAGLISLVIKCLEKLKFWDWLEKHLPINNEELRRKIITIIQWVVYLTPVILSICTLKVENLGFSPIIEGAIKGIQPAIESTMAALRCAILFSQAEIYKLKGKLTKIQLDIELKSFDRDDHYERSQELLDNMESSFEALSRILNYMRELDQVYLHSLRG

SEQ ID NO: 1095 - protein, 191 aa, Chlamydia pneumoniae
CIEVIERTYGHLHLQPTPLMSHLNYLLEKIAASSKEDFPFPDDLESYLEGYVPDKNIALDTYQKIFKISSEDLEKVYKEGYHAYLDKDYAKSITVFRWLVFFNPFVSKFWFSLGASLHMSEQYSQALHAYGVTAVLRDKDPYPHYYAYICYTLTNEHEEAEKALEMAWVRAQHKPLYNELKEEILDIRKHK

SEQ ID NO: 1096 - protein, 339 aa, Chlamydia pneumoniae
  SITE 1...339: Xaa=unknown or other
TTASSSNTKRLCCKKTQRRPSPETQARASLSQASSSSQRSLPPQESAPERTLLEQQKASSFSPLSQFSAEKQKEALTTSKSHELYKERDQDRQQREQHDRKHDQEEDAESKKKKKKRGLGVEAVAEEPGENLDIAALIFSDQMRPPAEETSXKETTFKKKLPSPMSVFSRFIPSKNPLSVGSSIHXPIQTPKVENVFLRFMKLMARILGQAEAEANELYMRVKQRTDDVDTLTVLISKINNEKKDIDWSENEEMKALLNRAKEIGVTIDKEKYTWTEEEKRLLKENVQMRKENMEKITQMERTDMQRHLQEISQCHQARSNVLKLLKELMDTFIYNLRP

SEQ ID NO: 1097 - protein, 211 aa, Chlamydia pneumoniae
FSFFFYALKLQIMNMPVPSAVPSANITLKEDSSTVSTASGILKTATGEVLVSCTALEGSSSTDALISLALGQIILATQQELLLQSTNVHQLLFLPPEVVELEIQVVDLLVQLEHAETITSEPQETQTQSRSEQTLPQQSSSKQSALSPRSLKPEISDSKQQQALQTPKDSAVRKHSEDRHLRHKLALPYLRQAQVLRDPYLRKKVRQKEHY

SEQ ID NO: 1098 - protein, 106 aa, Chlamydia pneumoniae
IFLEIFIMKKVVTLSIIFFATYCASELSAVTVVAVPLSEAPGKIQVRPVVGLQFQEEQGSVPYSFYYPYDYGYYYPETYGYTKNTGQESRECYTRFEDGTIFYECD

SEQ ID NO: 1099 - protein, 301 aa, Chlamydia pneumoniae
MTMPSTQFHTTILEQFSLFLSVDRGLCQQSIAAYRQDISSFLTISAISSPQDISQNSVYIFAEELYRRKEAETTLARRLIALKVFFLFLKDQQLLPYPPIIEHPKIWKRLPSVLTPQEVDALLAVPLQMEKNPRHLAFRDTAILHTLYSTGVRVSELCDLRLGHVSDDCIRVTGKGSKTRLVPLGSRAREAIDAYLCPFRDQYQKKNPHEDHLFLSTRGHKLERSCVWRRIHNYAKQVTSKPVSPHSLRHAFATHLLDNKADLRVIQEMLGHARIASTEVYTHVAADSLIEKFLAHHPRNL

SEQ ID NO: 1100 - protein, 553 aa, Chlamydia pneumoniae
VEGIVILANECNFSIGSGEFSSYREKTMERKRFIDCDSTKILQELALNPLDLTAPGVLSAERIKKFSLLGGGFTFSFATERLDDAILAALISLAEERGLHESMLAMQQGQVVNYIEGFPSEMRPALHTATRAWVTDSSFTGEAEDIAVRSRVEAQRLKDFLTKVRSQFTTIVQIGIGGSELGPKALYRALRAYCPTDKHVHFISNIDPDNGAEVLDTIDCAKALVVVVSKSGTTIETAVNEAFFADYFAKKGLSFKDHFIAVTCEGSPMDDTGKYLEVFHLWESIGGRFSSTSMVGGVVLGFAYGFEVFLQLLQGASAMDQIALQPNARENLPMLSALISIWNRNFLGYPTEAVIPYSSGLEFFPAHLQQCCMESNGKSIVQDGRRVGFSTSPVIWGEPGTNGQHSFFQCLHQGTDIIPVEFIGFEKSQKGEDISFQGTTSSQKLFANMIAQAIALACGSENTNPNKNFDGNRPSSVLVSSQLNPYSLGELLSYYENKIVFQGFCWGINSFDQEGVSLGKALANRVLELLEGADASNFPEAASLLTLFNIKFR

SEQ ID NO: 1101 - protein, 523 aa, Chlamydia pneumoniae
NMPGSVSSPPLSPVIVRERVPSSSGSDLIQPHAVLKISILIFALVTILGIVLVVSSALGALPSLVLTVSGCIAIAVGLIGLGILVTRLILSTIRKVDAMGYDAAVKEEQYLSRIRELESENREIRDRNRAVEDQCAHLSEENKDLRDPEYLHGMTERLIASLEIENQALVAENILLKDWNASLSRDFRAYKQKFPLGALEPWKEDIACIMEQNLFLKPECIAMVKSLPLETQRLFLYPKGFQSLVNRFAPRSRFFQTPKYEYNSRNENEDGKVAAVCARLKKEFFSAVLGACSYEELGGICERAVALKETLPLPEAVYDTLVQEFPNLLTAESLWKEWCFYSYPYLRPYLSVDYCKRLFVQLFEELCLKLFTTGSPEDQALVRLFSYYRNHIPAVLASFGLPPPETGGSVFVLLPKQENLLWSQIEVLATRYLKDTFVRNSEWTGSFEMMFSYNEMCKEISEGRIRFAEDYETRHSEEFPPSPLSEEGEGEEFLPPCSEEEVSVLERPDLDVDSMWVWHPSGP

SEQ ID NO: 1102 - protein, 335 aa, Chlamydia pneumoniae
  SITE 1...335: Xaa=unknown or other
FFLKGVRMAFKEVVRVAVTGGKGQIAYNFLFALAHGDVFGVDRGVDLRIYDVPGTERALSGVRMELDDGAYPLXHRLRVTTSLNDAFDGIDAAFLIGAVPRGPGMERGDLLKQNGQIFSLQGAALNTAAKRDAKIFVVGNPVNTNCWIAMKHAPRLHRKNFHAMLRLDQNRMHSMLAHRAEVPLEEVSRVVIWGNHSAKQVPDFTQARISGKPAAEVIGDRDWLENILVHSVQNRGSAVIEARGKSSAASASRALAEAARSIFCPKSDEWFSSGVCSDHNPYGIPEDLIFGFPCRMLPSGDYEIIPGLPWEPFIRNKIQISLDEIAQEKASVSSL

SEQ ID NO: 1103 - protein, 82 aa, Chlamydia pneumoniae
SEHTPEENHSSLLGQKIDRAASASARDADAAEDFPLASITALPRFCTECTKMFSNQSRSPITSAAGFPEIRACVKSGTCFAE

SEQ ID NO: 1104 - protein, 275 aa, Chlamydia pneumoniae
  SITE 1...275: Xaa=unknown or other
SXCASKALNVPIVISQGILRPAIDEDQAQLFTERVEEFPKEVEWWEXARCEISIPSMVIPPNLGALFIKSGVTLNNDLYIQGLADACMKLGTQFYDELIEDLADIEEFYDHIIVTPGANASILPELKDMPVNKVKGQLLEISWPKDLAMLSFSINAHKYMVANTQKNTCILGATFEHNQPEETPDPAIAYQEIMPPVLSLFPGLKDAQVLHCYAGMRSSSKSRLPVISRIREKLWFLGGLGSKGLLYHGITGDMLAQAVLRKSTAYIAKEFLFTI

SEQ ID NO: 1105 - protein, 485 aa, Chlamydia pneumoniae
MTSRTKSSKNLGTIALAGMVVSSIIGGGIFSLPQNMAATAGAGAVILSWILTGFGMFFIANTFRILSTIRPDLKEGIYMYSREGFGPYIGFTIGWGYWLCQIFGNVGYAVITMDALNYFFPPYFQGGNTLPAILGGSILIWVFNFIVLKGIRQASIINVIGTIFKIIPLIIFIILTAFFFKLAVFKTDFWGHAVTKAQPSLGSVSSQLKGTMLVTLWAFIGIEGAVVMSGRAKNPLSVGQATVLGFLGCLTIYILFSLLPFGSLFQHQLANIPNPSTAGVLDILVGKWGEVLMNVGLIIAVLSSWLSWTIIVAEIPFSAAKNGTFPEIFTIENKEKSPSVSLYITSSVMQLAMLLVYFSSNAWNTMLSITGVMVLPAYLASAAFLFKLSKSKTYPKKGSIKAPLAMITGILGVVYSLWLIYAGGLKYLFMALVLLALGIPFYIDAGKKKKNAKTFFAKKEIVGMTFIGLLALTAIFLFSTGRIKI

SEQ ID NO: 1106 - protein, 196 aa, Chlamydia pneumoniae
LMAYGTRYPTLAFHTGGIGESDDGMPPQPFETFCYDSALLQAKIENFNIVPYTSVLPKELFGNIVPVDTCVKSFKHGAVLEVIMAGRGAALSDGTHAIATGIGICWGKDKNGELIGGWAAEYVEFFPTWINDEIAETHAKMWLKKSLQHELDLRSIAKHSEFQFFHNYINIKQKFGFCLTALGFLNFENAEPAKVN

SEQ ID NO: 1107 - protein, 165 aa, Chlamydia pneumoniae
QKATYNFYGYASWTPKPSCGDGQYSVLLYSTRKVPEQNSQVTGWSLNAAQHIHEKLYLFGRINGATGTALPINRSYVLGLVSENPLNRHSQDLLGIGFATNKVNAKAISNVNKLRRYESVMEAFATIGFGPYISLTPDFQLYIHPALRPERRTSQVYGLRANLSL

SEQ ID NO: 1108 - protein, 354 aa, Chlamydia pneumoniae
  SITE 1...354: Xaa=unknown or other
NNKKKDYSGEFLTTDTVDSIAFLSSEENFCYIKTILFFRVKKKHYAFFYGEFMIXFRFLLLSGLCALGISSYAETPKETTGHYHRYKARIQKKHPESIKESAPSETPHHNSLLSPVTNIFCSHPWKDGISVSNLLTSVEKATNTQISLDFSILPQWFYPHKALGQTQALEIPSWQFYFSPSTTWTLYDSPTAGQGIVDFSYTLIHYWQTNGVDANQAAGTASSMNDYSNRENNLAQLTFSQTFPGDFLTLAIGQYSLYAIDGTLYDNDQYSGFISYALSQNASATYSLGSTGAYLQFTPNSEIKVQLGFQDSYNIDGTNFSIYNLTKSNIQLLRLRLLDSKTFVWRWTVLCIAL

SEQ ID NO: 1109 - protein, 286 aa, Chlamydia pneumoniae
KTSWQKYKKYLSYSILVQKIARYVMKTWLFFTFLFSCSSFYASCRYAEVRSIHEVAGDILYDEENFWLILDLDDTLLQGGEALSHSIWKSKAIQGLQKQGTPEQEAWEAVVPFWIEIQEMGTVQPIESAIFLLIEKIQKQGKTTFVYTERPKTAKDLTLKQLHMLNVSLEDTAPQPQAPLPKNLLYTSGILFSGDYHKGPGLDLFLEICTPLPAKIIYIDNQKENVLRIGDLCQKYGIAYFGITYKAQELHPPIYFDNIAQVQYNYSKKLLSNEAAALLLRHQMHE

SEQ ID NO: 1110 - protein, 504 aa, Chlamydia pneumoniae
VVQLPLMVPIVHLQIWRFSMIYYGVSVMLCATVSGPSFCEAKQQILKSLHLVDIIELRLDLINELDDQELHTLITTAQNPILTFRQHKEMSTALWIQKLYSLAKLEPKWMDIDVSLPKTALQTIRKSHPKIKLILSYHTDKNEDLDAIYNEMLATPAEIYKIVLSPENSSEALNYIKKARLLPKPSTVLCMGTHGLPSRVLSPLISNAMNYAAGISAPQVAPGQPKLEELLSYNYSKLSEKSHIYGLIGDPVDRSISHLSHNFLLSKLSLNATYIKFPVTIGEVVTFFSAIRDLPFSGLSVTMPLKTAIFDHVDALDASAQLCESINTLVFRNQKILGYNTDGEGVAKLLKQKNISVNNKHIAIVGAGGAAKAIAATLAMQGANLHIFNRTLSSAAALATCCKGKAYPLGSLENFKTIDIIINCLPPEVTFPWRFPPIVMDINTKPHPSPYLERAQKHGSLIIHGYEMFIEQALLQFALWFPDFLTPESCDSFRNYVKNFMAKV

SEQ ID NO: 1111 - protein, 384 aa, Chlamydia pneumoniae
MLQTIMSETIITTPHVVKLISNFFQKKLFSSISTAYPLVIITDVSVQQHLLGPILDHIKMLGYQVIVLTFPPGEPNKTWETFISLQYQLVDQNISPKSSIIGIGGGTVLDMTGFLAATYCRGLPLYLIPTTITAMVDTSIGGKNGINLRGIKNRLGTFYLPKEVWMCPQFLSTLPREEWYHGIAEAIKHGFIADAYLWEFLNSHSKMLFSSSQILHEFIKRNCQIKAAIVAEDPYDRSLRKILNFGHSIAHAIETLAKGTVNHGQAVSVGMMIETRISLAEGVMKTPQLIDQLERLLKRFNLPSTLKDLQSIVPEHLHNSLYSPENIIYTLGYDKKNLSQHELKMIMIEHLGRAAPFNGTYCASPNMEILYDILWSECHVMRHC

SEQ ID NO: 1112 - protein, 376 aa, Chlamydia pneumoniae
TSVSRSHYLVKVMKNSFGSLFSFTTWGESHGPSIGVVIDGCPAGLELHESDFVPAMKRRRPGNPGTSSRKENDIVQILSGVYKGKTTGTPLSLQILNTDVDSSPYENSERLYRPGHSQYTYEKKFGIVDPNGGGRSSARETACRVAAGVVAEKFLANQNIFTLAYLSSLGSLTLPHYLKISPELIHKIHTSPFYSPLPNEKIQEILTSLHDDSDSLGGVISFITSPIHDFLGEPLFGKVHALLASALMSIPAAKGFEIGKGFASAQMRGSQYTDPFVMEGENITLKSNNCGGTLGGITIGVPIEGRIAFKPTSSIKRPCATVTKTKKETTYRTPQTGRHDPCVAIRAVPVVEAMINLVLADLVLYQRCSKLSCQRQ

SEQ ID NO: 1113 - protein, 184 aa, Chlamydia pneumoniae
WKLELRNVMTIILCGLPTSGKSSLGKALAKFLNLPFYDLDDLIVSNYSSALYSSSAEIYKAYGDQKFSECEARILETLPPEDALISLGGGTLMYEASYRAIQTRGALVFLSVELPLIYERLEKRGLPERLKEAMKTKPLSEILTERIDRMKEIADYIFPVDHVDHSSKSSLEQASQDLITLLKS

SEQ ID NO: 1114 - protein, 449 aa, Chlamydia pneumoniae
VCFTMLTYKVSPSSVYGNAFIPSSKSHTLRAILWASVAEGKSTIYNYLDSPDTEAMICACKQMGASIKKFPQILEIVGNPLAIFPKYTLIDAGNSGIVLRFMTALACVFSKEITVTGSSQLQRRPMAPLLQALRNFGASFHFSSDKSVLPFTMSGPLRSAYSDVEGSDSQFASALAVACSLAEGPCSFTIIEPKERPWFDLSLWWLEKLHLPYSCSDTTYSFPGSSHPQGFSYHVTGDFSSAAFIAAAALLSKSLQPIRLRNLDILDIQGDKIFFSLMQNLGASIQYDNEEILVFPSSFSGGSIDMDGCIDALPILTVLCCFADSPSHLYNARSSKDKESDRILAITEELQKMGACIQPTHDGLLVNPSPLYGAVLDSHDDHRIAMALTIAALYASGDSRIHNTACVRKTFPNFVQTLNIMEARIEECHDNYSMWSTHKRKVFARESFG

SEQ ID NO: 1115 - protein, 96 aa, Chlamydia pneumoniae
RCEGESAKQQRTVRMGRASIQPSISIEPPENDEGNTKISSLSYCIEAPKFCMREKKILSPWISKMSKLRRRIGWSDFESRAAAAMKAALLKSPVTW

SEQ ID NO: 1116 - protein, 283 aa, Chlamydia pneumoniae
RPSQSLFLRTWSPSSSFREHTVCAAPLLYPRRRSPDYLFSPTGCPMSTTTVKHFIHTASRWEPVLKEIVASNYWHAQWINTLSFLENSGAKKISASEHPTEVKEEVLKHAAEEFRHGHYLKTQISRISETSLPDYTSKNLLGGLLTKYYLHLLDLRTCRVLENEYSLSGQTLKTAAYILVTYAIELRASELYPLYHDILKEAQSKITVKSIILEEQGHLQEMERELKDLPHGEGTLRLCLPIRRGALLAVCREIRTNDLRSFLDFYKVLEFFLDDKSEVRQIT

SEQ ID NO: 1117 - protein, 505 aa, Chlamydia pneumoniae
LVMFLDFSEPSISRKYQSHLFNGRSNALTKPQYLRYGGKWVSRGRRALANSRNQASYNRDSCQGKRNHKDNHKLLCRTMEGSMDKQSSGNSGCIWHPFTQSALDSTPIKIVRGEGAYLYAESGTRYLDAISSWWCNLHGHGHPYITKKLCEQAQKLEHVIFANFTHEPALELVSKLAPLLPEGLERFFFSDNGSTSIEIAMKIAVQYYYNQNKAKSHFVGLSNAYHGDTFGAMSIAGTSPTTVPFHDLFLPSSTIAAPYYGKEELAIAQAKTVFSESNIAAFIYEPLLQGAGGMLMYNPEGLKEILKLAKHYGVLCIADEILTGFGRTGPLFASEFTDIPPDIICLSKGLTGGYLPLALTVTTKEIHDAFVSQDRMKALLHGHTFTGNPLGCSAALASLDLTLSPECLQQRQMIERCHQEFQEAHGSLWQRCEVLGTVLALDYPAEATGYFSQYRDHLNRFFLERGVLLRPLGNTLYVLPPYCIQEEDLRIIYSHLQDALCLQPQ

SEQ ID NO: 1118 - protein, 219 aa, Chlamydia pneumoniae
MQRIIIVGIDTGVGKTIVSAILARALNAEYWKPIQAGNLENSDSNIVHELSGAYCHPEAYRLHKPLSPHKAAQIDNVSIEESHICAPKTTSNLIIETSGGFLSPCTSKRLQGDVFSSWSCSWILVSQAYLGSINHTCLTVEAMRSRNLNILGMVVNGYPEDEEHWLTQEIKLPIIGTLAKEKEITKTIISCYAEQWKEVWTSNHQGIQGVSGTPSLNLH

SEQ ID NO: 1119 - protein, 383 aa, Chlamydia pneumoniae
PMLCQQFLIEALARRKSKHTYRSLSLNSHLIDFTSNDYLGFASSPELRKEYITKLHAIESLGATGSRLLTGHSQLCQRIEEQLAAYHNFESCLIFNTGYTANLGLLYALATDQDRILHDLYIHASIYDGIRLSKAQSFPFNHNDLNHLEKRLASSHLGRTFVCVESVYSLHGSVAPLQAISELCERYSAYLIVDEAHAVGVFGDQGEGLVSALGLQDKVLATVYTFGKALGTHGAAIAGSSILKDYLINFCRPFIYTTAQPPHALTAIELAYEHNQRAFNQREHLSALIHHFREKAQNLGLQLMKDNTTTPIQSICVSGSHRARQAALQIQNSGYDVRPIVSPTVKQREELLRICLHAFNTKNEIDHLLHTLEQIFLCNVSSL

SEQ ID NO: 1120 - protein, 334 aa, Chlamydia pneumoniae
AKHMREETVSWSLEDIREIYHTPVFELIHKANAILRSNFLHSELQTCYLISIKTGGCVEDCAYCAQSSRYHTHVTPEPMMKIVDVVERAKRAVELGATRVCLGAAWRNAKDDRYFDRVLAMVKSITDLGAEVCCALGMLSEEQAKKLYDAGLYAYNHNLDSSPEFYETIITTRSYEDRLNTLDVVNKSGISTCCGGIVGMGESEEDRIKLLHVLATRDHIPESVPVNLLWPIDGTPLQDQPPISFWEVLRTIATARVVFPRSMVRLAAGRAFLTVEQQTLCFLAGANSIFYGDKLLTVENNDIDEDAEMIKLLGLIPRPSFGIERGNPCYANNS

SEQ ID NO: 1121 - protein, 259 aa, Chlamydia pneumoniae
SEFMVSTPFLTVFSMEKLLSKIFLDYLEAFGLLSDFLDHQAVIKFFELETHFSYYPVSGFVAPHQYLSLLQDRYFPIASVMRTLDKDNFSLTPDLIHDLLGHVPWLLHPSFSEFFINMGRLFTKVIEKVQALPSKKQRIQTLQSNLIAIVRCFWFTVESGLIENHEGRKAYGAVLISSPQELGHAFIDNVRVLPLELDQIIRLPFNTSTPQETLFSIRHFDELVELTSKLEWMLDQGLLESIPLYNQEKYLSGFEVLCQ

SEQ ID NO: 1122 - protein, 264 aa, Chlamydia pneumoniae
MGSSMHVGVIGCSGRTGKVIVSALEQSSEYTLGPGFSRSSALTLFQVIAHNDVLVDFSHPLLTKEVVAHLLISPKPLIIGTTGFPGKCKEAHDSLEELTHIVPVVVCPNASLGAYIHKRLVMLLSQLCNPQFDIRIRETHHRYKKDSLSGTAQDLLDTIQQVKQEDWGEEYEVGQRDSSKKTIEVQSSRVGDIPGEHEVAFISSGEQILVRHTVFSRNVFGRGILSILDWLKTLNPQPGLYSLGDTLELVLRNEHCLLKKTTDH

SEQ ID NO: 1123 - protein, 295 aa, Chlamydia pneumoniae
IWAIVWRCLYLAGAIGPMPEMVRDLPIRKIEEVQSDIVVSFLPSSAESMEAYCLSQGKVVFSNASTYRMHSSVPIIIPEVNSDHFQLLEEQPYPGKIITSPNCCVSGITLALAPLRKFSLDHVHIVTLQSASGAGYPGVPSLDLLANTVPHIVGEEEKILRETVKILGSSKQPLPCKLSVTVHRVPVAYGHTLSLHVTFSKDVDLDEILYSYQEKNKEFPNTYQLYDNPWSPQARKHLSHDDMRVHLGPITYGGDFRTIKMNVLIHNLVRGAAGTLLASMENYFFDYLKREMCLR

SEQ ID NO: 1124 - protein, 441 aa, Chlamydia pneumoniae
NVSKIVYKFGGTSLATAENICLVCDIICKDKPSFVVVSAIAGVTDLLVDFCSSSLREREEVLRKIEGKHEEIVKNLAIPFPVSTWTSRLLPYLQHLEISDLDFARILSLGEDISASLVRAVCSTRGWDLGFLEARSVILTDDSYRRASPNLDLMKAHWHQLELNQPSYIIQGFIGSNGLGETVLLGRGGSDYSATLIAELARATEVRIYTDVNGIYTMDPKVISDAQRIPELSFEEMQNLASFGAKVLYPPMLFPCMRAGIPIFVTSTFDPEKGGTWVYAVDKSVSYEPRIKALSLSQYQSFCSVDYTVLGCGGLEEILGILESHGIDPELMIAQNNVVGFVMDDDIISQEAQEHLVDVLSLSSVTRLHHSVALITMIGDNLSSPKVVSTITEKLRGFQGPVFCFCQSSMALSFVVASELAEGIIEELHNDYVKQKAIVAT

SEQ ID NO: 1125 - protein, 271 aa, Chlamydia pneumoniae
KSYSRHVGRIMHLLTATVTPFFPNGTIDFASLERLLSFQDAVGNGVVLLGSTGEGLSLTKKEKQALICFACDLQLKVPLFVGTSGTLLEEVLDWIHFCNDLPISGFLMTTPIYTKPKLCGQILWFEAVLNAAKHPAILYNIPSRAATPLYLDTVKALAHHPQFLGIKDSGGSVEEFQSYKSIAPHIQLYCGDDVFWSEMAACGAHGLISVLSNAWPEEAREYVLNPQEQDYRSLWMETCRWVYTTTNPIGIKAILAYKKAITHAHCACPCL

SEQ ID NO: 1126 - protein, 256 aa, Chlamydia pneumoniae
FFIQKMKYNSREKIKSALRICSSYCITVFRNNFSLSCYDKIFYSLSCYVFNGPNSIGRCRSFCFFRGKKTEVETKEVKIKDEIRPSLEGNDPVKVAESFPKRRAALESLSSQSSIGNLCAISNFLDSQMLSRNFSKEIWGSTIFTRSKSTCDAEGSEPFRYTACGYLAGLRSKLAGSYELGVTAGLLQGRLKDVSDSHRTRATSSILSVHGSMVTRPLSCTKYIVGKARPLLFFFRLTSDVRRDLKKKFRLEFCKD

SEQ ID NO: 1127 - protein, 119 aa, Chlamydia pneumoniae
HILFYSKFTYRTPLRVTSPSGRHDFNIDMHVAPKIGAVLSHGTREAKEIPGSSKDYAFFSLTARESLMISEKLAMTFQVSEVIQNCYSQCTKVTKTNLKEQYRHLSHNTGFELSVKSAF

SEQ ID NO: 1128 - protein, 810 aa, Chlamydia pneumoniae
  SITE 1...810: Xaa=unknown or other
CKYFYLRSYPPPQHSVGSISSPSKLRVLAITFLVFGMLLLISGALFLTLGIPGLSAAISFGLGIGLSALGGVLMISGLLCLLVKREIPTVRPEEIPEGVSLAPSEEPALQAAQKTLAQLPKELDQLDTDIQEVFACLRKLKDSKYESRSFLNDAKKELRVFDFVVEDTLSEIFELRQIVAQEGWDLNFLINGGRSLMMTAESESLDLFHVSKRLGYLPSGDVRGEGLKKSAKEIVARLMSLHCEIHKVAVAFDRNSYAMAEKAFAKALGALEESVYRSLTQSYRDKFLESERAKIPWNGHITWLRDDAKSGCAEKKLRDAEERWKKFRKAVFWVEEDGGFDINNLLGDWGTVLDPYRQERMDEITFHELYEKTTFLKRLHRKCALAKTTFEKXRSKKNLQAVXEANARRLKYVRDWYDQXFQKAGERLEKLHALYPEVSVSIRENKIQETRSNLXKAYEAIEXNYRCCVREQEDYWKEEEKREAXFRERGNXILSPEELEXSLEQFDHGLKNFSEKLMELEGHILKLQKEATAEVENKILSDAESRLEIVFEDVKEMPCRIEEIEKTLRMAXLPLLPTKKAFEKACSQYNSCAEMLEKVKPYCKESLAYVTSKERLVSLDEDLRRAYTECQKRFQGDSGLESEVRACREQLRERIQEFETQGLDLVEKELLCVSSRLRNTECDCVSGVKKEAPPGKKFYAQYYDEIYRVRVQSRWMTMSERLREGVQACNKMLKAGLSEEDKVLKEEEYWLYREERKNKEKRLVGTKIVATQQRVAAFESIEVPEIPEAPEEKPSLLDKARSLFTREDHT

SEQ ID NO: 1129 - protein, 132 aa, Chlamydia pneumoniae
VACRAGSSEGATETPSGISSGRTVGTSRFAKRHRSPETTSTPPNAERPMPNPKEIAALNPEIPNVRKRAPEIKKSTPRTKKVIAKTRNLDRQKKAPTEWSGGGGGSCGDRGTCIMNLWRHHAQTHKLNPLSY

SEQ ID NO: 1130 - protein, 320 aa, Chlamydia pneumoniae
WRHRFIMQVPLSPQLPPPPPDHSVGAFFCLSKFRVLAITFLVLGVLFLISGALFLTLGISGLSAAISFGLGIGLSALGGVLVVSGLLCLLAKREVPTVRPEEIPEGVSVAPSEEPALQATQKTLAQLPKELDQLDRYIQEVVSCLGKLKDLRCEDQGLLKDAKEKLQVFDFVWKDMMTEFVELQQIMDQEGWYLKCLIQEMRDIGSTLFMSQVSLFKLWEWLGYLPSGDVRGERLKKSAREVVDRFMRRICDTRKVAMTFDRNAYGVAKTAFEKAFGALETCVYKSMTESYREAFCEYKKTKILRDEEKILRICYLELRR

SEQ ID NO: 1131 - protein, 249 aa, Chlamydia pneumoniae
  SITE 1...249: Xaa=unknown or other
GEDIKDMLSRVEEIEMMLRVIELPLLPIKQALEKAFVQYNSYKAKLTKVEPCFRESPAYITSEERLXSLDQTLERAYKEYQKRFQEPSRLESEVSGCREHLREQVKQFETQGLDLIKEELIFVSDVLFRKMVSCLVSTVHVPFMEFYYEYFELHRLRLRAQWMANAEIYSKVRKAFPEMLKETLEKAKAPREEEYWLLCEERKSKEKRLILNKIEAAQQRVKDLEPPPIKETGKQKRKKEYSFFIRLKS

SEQ ID NO: 1132 - protein, 679 aa, Chlamydia pneumoniae
MPEPLYTNKLITEKSPYLLLYAHTPVNWYPWGAEAFHIAAIENKPVFLSIGCKHSRWCQVMLQESYTNPEIAAMLNEYFVNVKVDKEELPYVAKLYGDLAQMLAVSGDHQETVSWPLNVFLTPDLVPFFSVNYLGNEGKLGLPSFPQIIDKLHFMWEDAEEREALVEQAMRFLEIASFLEGCVRKEILDESSLKRTVAALYQDIDPHYGGVKAFPKRLPGLLLQFFLRYSLEYQESRGLFFVDRSLSMVALGGVRDHIGGGVYSYTIDDKWLIPAFEKRLIDNALMALNYLEAWACLGKEEYRGIGKQILSYILSELYSPEVGAFYSSEQAENWGAGGQNFYTWSVEEISNALGEDAEIFCDYYGISREGFFNGRNILHIPVHREIEELSEKYHRSIEAIEDIVDRSRDILKGIRAQRSHRSKDDLSLTFNNGWMIYTFAYAGRLLGEVEYIEIEKKCGEFVRNSLYKHHELYRRWREGEAKYRASLEDYGALILGVLALYESGCGSFWLSFAEELMQEVVLSFRSEEGGFYSDDGRDSTLLIKQSPLSDGETISGNALICQCLLSLHLITEKKHYLTYAEDILQIAQACAHTHKFSSLGLLIASQNYFSRKHVKVLIPLGDQEDRSPVLKCLSGLFLPYLSLIWMTQENQEHLETVLPEYEHCLIPKRGIAQLRQFMF

SEQ ID NO: 1133 - protein, 365 aa, Chlamydia pneumoniae
EVMKLYQTLRGIVLVSTGCIFLGMHGGYAAEVPVTSSGYENLLESKEQDPSGLAIHDRILFKVDEENVVTALDVIHKLNLLFYNSYPHLIDSFPARSQYYTAMWPVVLESVIDEFLMVADAKAKRIATDPTAVNQEIEEMFGRDLSPLYAHFEMSPNDIFNVIDRTLTAQRVMGMMVRSKVMLKVTPGKIREYYRKLEEEASRKVIWKYRVLTIKANTESLASQIADKVRARLNEAKTWDKDRLTALVISQGGQLVCSEEFSRENSELSQSHKQELDLIGYPKELCGLPKAHKSGYKLYMLLDKTSGSIEPLDVMESKIKQHLFALEAESVEKQYKDRLRKRYGYDASMIAKLLSEEAPPLFSLL

SEQ ID NO: 1134 - protein, 277 aa, Chlamydia pneumoniae
VTRSSPAQLSRFLSEIQNKPKKSLSQNFLVDQNIVKKIVATSEVIPQDWVLEIGPGFGALTEELIAAGAQVIAIEKDPMFAPSLEELPIRLEIIDACKYPLDQLQEYKTLGKGRVVANLPYHITTPLLTKLFLEAPDFWKTVTVMVQDEVARRIVAQPGGRDYGSLTIFLQFFADIHYAFKVSASCFYPKPQVQSAVIHMKVKETLPLSDEEIPVFFTLTRTAFQQRRKVLANTLKGLYPKEQVEQALKELGLLLNVRPEVLSLNDYLALFHKMQAG

SEQ ID NO: 1135 - protein, 644 aa, Chlamydia pneumoniae
MTSSSCPLLDLILSPADLKKLSISQLPGLAEEIRYRIISVLSQTGGHLSSNLGIVELTIALHYVFSSPKDKFIFDVGHQTYPHKLLTGRNNEGFDHIRNDNGLSGFTNPTESDHDLFFSGHAGTALSLALGMAQTTPLESRTHVIPILGDAAFSCGLTLEALNNISTDLSKFVVILNDNNMSISKNVGAMSRIFSRWLHHPATNKLTKQVEKWLAKIPRYGDSLAKHSRRLSQCVKNLFCPTPLFEQFGLAYVGPIDGHNVKKLIPILQSVRNLPFPILVHVCTTKGKGLDQAQNNPAKYHGVRANFNKRESAKHLPAIKPKPSFPDIFGQTLCELGEVSSRLHVVTPAMSIGSRLEGFKQKFPERFFDVGIAEGHAVTFSAGIAKAGNPVICSIYSTFLHRALDNVFHDVCMQDLPVIFAIDRAGLAYGDGRSHHGIYDMSFLRAMPQMIICQPRSQVVFQQLLYSSLHWSSPSAIRYPNIPAPHGDPLTGDPNFLRSPGNAETLSQGEDVLIIALGTLCFTALSIKHQLLAYGISATVVDPIFIKPFDNDLFSLLLMSHSKVITIEEHSIRGGLASEFNNFVATFNFKVDILNFAIPDTFLSHGSKEALTKSIGLDESSMTNRILTHFNFRSKKQTVGDVRV

SEQ ID NO: 1136 - protein, 127 aa, Chlamydia pneumoniae
ASPARSIAKITGRSCMQTSWKTLSRARCKNVEYIEQITGLPAFAMPALKVTAWPSAIPTSKKRSGNFCLKPSKRDPIDIAGVTTWRREETSPSSHSVWPNISGKEGLGLIAGRCFADSRLLKFALTP

SEQ ID NO: 1137 - protein, 554 aa, Chlamydia pneumoniae
MSSPPQAVASLTERIKTLLESNFCQIIVKGELSNVSLQPSGHLYFGIKDSQAFLNGAFFHFKSKYYDRKPKDGDAVIIHGKLAVYAPRGQYQIVAHALVYAGEGDLLQKFEETKRRLTAEGYFATEKKKPLPFAPQCIGVITSPTGAVIQDILRVLSRRARNYKILVYPVTVQGNSAAHEISKAIEVMNAENLADVLIIARGGGSIEDLWAFNEEILVKAIHASTIPIVSAVGHETDYTLCDFASDVRAPTPSAAAEIVCKSSEEQVQVFEGYLRHLLSHSRQLLTSKKQQLLPWRRFLDRAEFYTTAQQQLDSIEIAIQKGVQGKIHESKQRYDNISRWLQGDLVSRMTCRLQSLKKMLSQALSHKALSLQVRCHQLKKSLTYPRQIQQASQKLSPWRQQLDTLISRRLHYQKEEYFHKHTRLKHAHNVLEQQLRSHVQKLELLGRRLSRGCELNLQNQKIAYANVKETLATILERRYENSVARYSALKEQLHSLNPKNVLKRGYAMLFDFNENSAMISVDSLQENARVRIQLQDGEAILTVTNIEICKLIKG

SEQ ID NO: 1138 - protein, 184 aa, Chlamydia pneumoniae
MTYAQVEVLMATPDISKYHGLRDRCLMELFYSSGLRISEIVAVNKQDFDLSTHLIRIRGKGKKERIIPVTSNAIQWIQIYLNHPDRKRLEKDPQAIFLNRFGRRISTRSIDRSFQEYLRRSGLSGHITPHTIRHTIATHWLESGMDLKTIQALLGHSSLETTTVYTQVSVKLKKQTHQEAHPHA

SEQ ID NO: 1139 - protein, 288 aa, Chlamydia pneumoniae
MSHLIPSLRNSVTSYFHKPQPIKQAAPSKSIRDICNIAYLIIICVLVVVVLVGAMLCMFIPSVGIPLCLSSLALLVLLSIFNPCLINWISTKKTKEIAPKDASESQPTKSASRKGSPQLSPHHDHEPKNFIRTQLEKGVNYVTNKFKSGEESPHISDEHHSPRQSKRSSEIESSDESSPELHRKAKGKAPHTATTKGSKTSTTESSKKKKKTKHSLHRTTSSIHKRSAPKPMVPSKKRKPVLLKKTVPLPIEDLEHQSSGNESSDSSSPPPVQRKAILPWFCKQPTDP

SEQ ID NO: 1140 - protein, 153 aa, Chlamydia pneumoniae
MLRRRIWKKTLTPDQENLSLPLPSPTTLKKIHALHILVRSGKTYNELIQEGFSFTKITDLGQAPSPKQDIGFSYNSLLPNFYFHSLVSVPNISGEERALNYHKEQQEEMAVKLKTMQACSFVFRSLHLPSMQTKDKKAGFGLLTFFPWKIYPL

SEQ ID NO: 1141 - protein, 136 aa, Chlamydia pneumoniae
LAMAKNVPLLGYSSLEGYLLSKDEKKALMLPLGKRGGVLTLSSEIPEEGLNEKRRGVGPGALLSYEEASDYCVAHGYYHVISPNPQLFASSFSDKITVEEVAPSVEQIRRHVISQFMFVEYDKQLSPDYRSYSCIF

SEQ ID NO: 1142 - protein, 82 aa, Chlamydia pneumoniae
MIEFPSAVWMIEEILPECDFLSIGTNDLVQYTLGISRESALPKHLNVTLPPAVIRMIHHVLQAANKIRFLLAFVERPQGSSV

SEQ ID NO: 1143 - protein, 108 aa, Chlamydia pneumoniae
LFDALHISLHRNIPRMGNHETYIHPGVLPSSHAQDVSRSTVYPSRSFIMRRMLMGWNFNRVPSKSSEQLMDGHRIPLIFFGKHHPTISILNVNRFSWLSIFYNGERGF

SEQ ID NO: 1144 - protein, 141 aa, Chlamydia pneumoniae
MATKTKTQWTCNQCGATAPKWLGQCPGCHNWNSLVEEYVPQARSGTSSRSSTSAIALSSIELENESRIFIDHAGWDRILGGGVVRGSLTLLGGDPGIGKSTLLLQTAERLASQKYKVLYVCGEESVTQTSLRAKRSISHHL

SEQ ID NO: 1145 - protein, 77 aa, Chlamydia pneumoniae
MTKIQCSAQYYRSRPAERAQTPPQPFLARDRADFWERHPRFSACCRVLLLVAWVVLALLFLFVMLLPLAAGSYLLAF

SEQ ID NO: 1146 - protein, 121 aa, Chlamydia pneumoniae
  SITE 1...121: Xaa=unknown or other
LTYTRVNDGHLAPFRAGAKWILIHYVRLRRQHNQNDFFTPGHSCYYARLAFNQTQRLYHQLFNVEKLRSIYANMDKDPLCHPWAXIPIYDLLKTEDHGDGFLEQQEDREYPSRAAQDQFWG

SEQ ID NO: 1147 - protein, 170 aa, Chlamydia pneumoniae
VSAEFKLMLDLRQYMGSVMQRLGLSNLFHCLLLFLRYYYSKLVFGLTVLLAAISVICLLGCSEPSLSSFTEYVGPEYSAAAQLSIEQSCHDEVYGQQVVVTWSLPSRMRKCLPVTLYLWVYYGNGKVEKLTYEVNQSAGYRVYCLKGLEYKELQGIISYPLRYVAGIKRL

SEQ ID NO: 1148 - protein, 101 aa, Chlamydia pneumoniae
MVSPLSLFHKMLLENWTPVEEPFPWPPAEKNQKIFAWALNQSKLIFVSTSGNIAQPRLVTDSMSMMIVNAANRTMSRDGAGTNQVLSAAVSVDSWGCRNDL

SEQ ID NO: 1149 - protein, 119 aa, Chlamydia pneumoniae
VALKIRLRQQGRRNHVVYRLVLADVESPRDGKYIELLGWYDPHSSINYQLKSERIFYWLERGAQLSSKAEALVKQGAPGVYSALLSKQEARKLVVRKKRRAYRQRRSTQREEAAKDATK

SEQ ID NO: 1150 - protein, 170 aa, Chlamydia pneumoniae
MSEVKPLFLKNDSFDLATQRFQNLINMLQEQAEIYNEYEEKNARVQNEIKEQKDFVKRCIEDFEARGLGVLKEELASLTRDFHDKAKAETSMLIECPCIGFYYSIHQEEQRQRQERLQKMAERYRDCKQVLEAVQVEQKDMISSRVVVDDSYFEEEKEEQKVDNRKKEQD

SEQ ID NO: 1151 - protein, 90 aa, Chlamydia pneumoniae
LVFSYYCMGLFFFSGAISSCGLLVSLGVGLGLSVLGVLLLLLAGLLLFKIQSMLREVPKAPDLLDLEDASERLRVKASRSLASLPKKSVS

SEQ ID NO: 1152 - protein, 94 aa, Chlamydia pneumoniae
LLLCSAMGIFSSAKALIAWNKASLNLSPALLGAILIFEPIFGLVLTYLYSQSLPSLQEGIGIFLMLGGSLLCLVLFGRKVQKSLENSQVSSSNE

SEQ ID NO: 1153 - protein, 248 aa, Chlamydia pneumoniae
  SITE 1...248: Xaa=unknown or other
MFPSANQESRTRNVPLGIFHGLVACLYWGIVFVIPNFLGSFGDLDIVLTRYTIFGIFSLIACAIKNPSVIKKTPLYIWRKSLLWTLLINPVYYFGITLGIRYVGSAITVVIASLAPTAVLYHSNTKQKELPYSLLFAISSVIITGVILTHLSALNLPTAASPLYSILGVIAVILSTSLWVIYVIRNQSLLEKHPXLTPDYLELPHRNQRFDHLPPYDYYSRSLWNYPRNTQSYLAYTGIRATALLVAM

SEQ ID NO: 1154 - protein, 149 aa, Chlamydia pneumoniae
MAVQSIKEAVTSAATSVGCVNCSREAIPAFNTEERATSIARSVIAAIIAVVAISLLGLGLVVLAGCCPLGMAAGAITMLLGVALLAWAILITLRLLNIPKAEIPSPGNNGEPNERNSATPPLEGGVAGEAGRGGGSPLTQLDLNSGAGS

SEQ ID NO: 1155 - protein, 124 aa, Chlamydia pneumoniae
MGNSCFWRGGLLRYPCGEEIEKSRANFFTADTTTVMSYPPNPYGLYDMAGNVYEWCQDWYGYDFYEISAQEPESPQGPAQGVYRVLRGGCWKSLKDDLRCAHRHRNNPGAVNSTYGFRCAKNIN

SEQ ID NO: 1156 - protein, 181 aa, Chlamydia pneumoniae
KLKLLKASFIKLLLTLDWPTELLLKNRPFDFTGHPEEEKLIKDILLKEEGNKYFSLESKKLLARHMMHNIVVLSEEPGRSAFLGRTAFFPNKYPIAQGGVGIPSTIGNLFTIWYCFYFYRAATPQSDHPDGCGFILLERLKELGAGFFYCDLRESNTTGFTLFFEGSNKGVLKNHLFIRDE

SEQ ID NO: 1157 - protein, 131 aa, Chlamydia pneumoniae
MNIYQFSPGASPNWQASLMAQLNSYFCLGGETVTRIISLRPSGLILAKKEKAVVSTAEKILKILSFILFPLVLIALAIRYLLYNKFNKDLDRAVFFIPTEITKAEELIIAKNSCASERSGSNCFSALLFSS

SEQ ID NO: 1158 - protein, 111 aa, Chlamydia pneumoniae
MLQHLFIDGITQENPEALPNNTSGRLTLFPSVRYIYSHFTPQNPTIWPQVFFRQGPLDEDRGGGFEILEQLQELGVRFPICPSQGPDNPNFQGFQGIRIYWEDSYQPNKEV

SEQ ID NO: 1159 - protein, 111 aa, Chlamydia pneumoniae
MSESINRSIHLEASTPFFIKLTNLCESRLVKITSLVISLLALVGAGVTLVVLFVAGILPLLPVLILEIILITVLVLLFCLVLEPYLIEKPSKIKELPKVDELSVVETDSTL

SEQ ID NO: 1160 - protein, 75 aa, Chlamydia pneumoniae
LAFNESVRIYRKLFNTAELKQMYGAGDYEQQNEDNLKSILSFVQILDEKDGFDDFLATHKDTTFIGRGGADIFCS

SEQ ID NO: 1161 - protein, 87 aa, Chlamydia pneumoniae
MEEALTFDDVLLIPQYSEILPSEVSLKTAISKTLSLNIPILSAAMDSVTETAMALALAQEGGLGILHKNMSEVEQSSSVRKIKEAYP

SEQ ID NO: 1162 - protein, 91 aa, Chlamydia pneumoniae
MDFSVFPDRFVESTSPSPIEDIDAKTLVSNCCHYCSRCLFIFLSLLSIIICFSVYGTSGETASLVFGILSLIVLVLLIIECRNRECCRRIS

SEQ ID NO: 1163 - protein, 95 aa, Chlamydia pneumoniae
LQAGRSGIIPGKKAILLNVNDAKTPNYSCIFESIGFFNEQDLEAQHNQQAALVRKILKVVPHHFLKGLIAKLPRSLKKDRKFMSSLIFTKLSYCF

SEQ ID NO: 1164 - protein, 95 aa, Chlamydia pneumoniae
MMKIKKAISRHIDRYLSPMKIPIMAHPGQKDSPSTLSFHFPLSYWFKELSSHGFLVSGLEEWTSSKTSTGKRAKAENLCRKEFPLFLMISCIKIK

SEQ ID NO: 1165 - protein, 238 aa, Chlamydia pneumoniae
MENLSSAPSRSIWKSIIQNKMLVLGLTTLIILMLGALLLPWFYQDYEQTSLKDILVSPCSRFPFGTDTLGRCMFARTLRGLRLSLLIATIATLIDVCVGLLWATVAISGGKKIDFLMMRTTEILFSLPRIPIIILLLVIFHHGLLPLILAMTITGWIPISRIIYGQFLLLKNKPFVLSAKAMHASTFHILKKHLLPNTLAPIISTLIFTIPNAIYTEAFISFLGLGIQPPQAKPRHLS

SEQ ID NO: 1166 - protein, 211 aa, Chlamydia pneumoniae
MGPLKKEEKTILMIFFLLVVLWTFGDLLGISATTAALIGLSLLILTNILDWQKDVIANTTAWETFIWFGALIMMASFLNQLGFIPLVGDSAAALVSGLSWKIGFPLLFLIYFYSHYLFASNTAHIGAMYPIFLAVSISLGTNPIFAALTLAFASNLFGGLTHYGSGPAPLYFGSHLVTVQEWWRSGFALSIVNIVIWIGIGSLWWKALGLI

SEQ ID NO: 1167 - protein, 81 aa, Chlamydia pneumoniae
LKMETYSFSTELQKNTSLYIMEKLDSYFSFQGKRTRVIAITPAGLAIAYEQNIHLSMTVKILKVLSFPRSLLRTTSLWYRP

SEQ ID NO: 1168 - protein, 228 aa, Chlamydia pneumoniae
LKGFLSVNELIFGFQTFSVVVLGVFFASRGKAWLTGWLSLLSSIMNVFVLKQIHLWGFEVTSADVYVIGLLTCLNYAREHYEKNDINDAMLCSWVISIAFLVLTQLHLFLIPSPNDSSQEHFLALFSSTPRIVVASLVTLIFVQIVDIKLFTFLQRVFSKKYFAMRSTISLLFSQLIDTIIFSFLGLYGLVSNLCDVMIFAMLVKGIVITLAIPTLTVTKAVLDRRSS

SEQ ID NO: 1169 - protein, 189 aa, Chlamydia pneumoniae
LGIFCFKKINLFKTFILMNNNVYLFCFLIFLSKKVFFESYEDFANVASSWPKSLRALVQGRYFVDSELKETPYRIHDFKKTPIHHRLYRSLPIISTIGGIIRLIEAHSGPIHPRDKMKYRFEVLQAVIEILGLGVLILVFDIIGCFLAFLVAIILSLLLYCNSTFTCVQNLSFTERMLEGIGEAVNFLA

SEQ ID NO: 1170 - protein, 92 aa, Chlamydia pneumoniae
VGLSYWDSGFVVLACKVLATALKFLFSKASSKIKQMKWREKARNLAAKDTVQSIKEFCSVDLTSCFTRCFRLRNRVVEEGASENQTVREIIV

SEQ ID NO: 1171 - protein, 130 aa, Chlamydia pneumoniae
MVNRYKSSAEFSADHYYDDNLVRMGYKRNLRGLAPVENEVCLFEENNLLESVMASIPIMGSILGLGRLHSVWSTQDPKDSKISIIFHTALGILETLGLGIIVLLIKITITILLILFTPCLLCYFMYSCCL

SEQ ID NO: 1172 - protein, 125 aa, Chlamydia pneumoniae
MTKNAINSQTTTPQPNLTDAEPIASRAQCKSIAVIISLFALGMLLLCLGIILISIPIPGLAAQVALGLGIVSLILGIALANIGFLCLLLRCKQFPKNPIHCPLKALNSLPREALPPHSHGKLENF

SEQ ID NO: 1173 - protein, 141 aa, Chlamydia pneumoniae
LKEIMMINFIRSYALYFAWAISCAGTLISIFYSYILNVEPCILCYYQRICLFPLTVILGISAYREDSSIKLYILPQAVLGLGISIYQVFLQEIPGMQLDICGRVSCSTKIFLFSYVTIPMASVVAFGAIVCLLVLTKNYRG

SEQ ID NO: 1174 - protein, 146 aa, Chlamydia pneumoniae
  SITE 1...146: Xaa=unknown or other
LXIEQENFSFKFKKSALSFTYNTANLTKSTFTFILLLLLRKKDQGLRFMDKETLENIYRHFRYRFLKLNILPAFLGLLLLCSPNTLNYTQVDVIFSDRLCSCLLIFLAIASLTKRSLLWLGAPLGIWVTLFACVADDLLLFLQMIL

SEQ ID NO: 1175 - protein, 95 aa, Chlamydia pneumoniae
  SITE 1...95: Xaa=unknown or other
LLVFVKVNSSMGLPTFPXXFLNICCWFIIVLFILAFAESLRHLRWMNLIFSAAILFSPVLFHIPVESPMFLPIIVTGLILIILSIGKRRRTKRKL

SEQ ID NO: 1176 - protein, 85 aa, Chlamydia pneumoniae
  SITE 1...85: Xaa=unknown or other
LVYFMVFSPSSESVVKANSVVRSNFCYFLENKFVSPSESTEVMFSEIMKGRVPDIESLFDRPTDMMMTGFKXRRIWGICSIASEY

SEQ ID NO: 1177 - protein, 114 aa, Chlamydia pneumoniae
MLYPVIAVVCAVVSVVLLILKVLFLLLSFPFKLCSASSALPGERVSLGSHFKCLYGGGLPYLLACLLIVPVIGTAIHGFIISHRTSEDARLSSAIVFMQAPILQLAGMSGLIKP

SEQ ID NO: 1178 - protein, 79 aa, Chlamydia pneumoniae
LFFYIYSILKRYIVVLGKILGLITIQFYQNLGGMSSERYSALHSRKSLSVLPHVVRKVLLSFPDFRGNGDVNLRNIRSD

SEQ ID NO: 1179 - protein, 163 aa, Chlamydia pneumoniae
LKAKAYLDKGAFVPSDFVWEILKEKLQSQACSKGCIIDGFPRTLDQAHLLDSFLMDVHSNYTVIFLEISEDEILKRVCSRFLCPSCSRIYNTSQGHTECPDCHVPLIRRSDDTPEIIKERLTKYQERTAPVIAYYDSLGKLCRVSSENKEDLVFEDILKCIYK

SEQ ID NO: 1180 - protein, 128 aa, Chlamydia pneumoniae
MSQCQSSSTSTWEWMKSFVPNWKNPTPPLSPIPSEDEFILAYEPFVLPKTDPENAQANPPGTSTPNVENGIDDLNPLLGQPNEQNNANNPGTSGSNPTSLPAPERLPETEENSQEEEQGSQNNEDLIG

SEQ ID NO: 1181 - protein, 94 aa, Chlamydia pneumoniae
LKSMLDPKKHSTLGIEISSETAETIESCSLGLISINLLLSGLCLRSSHDRSQAVKIIQQFCPQFSSEEVQNFVEQRNILLHFYIICLKGTKSPC

SEQ ID NO: 1182 - protein, 314 aa, Chlamydia pneumoniae
  SITE 1...314: Xaa=unknown or other
MNKKHASFSSRLGFIFSMIGIAVGAGNIWRFPRVAAQNGGGAFLILWLCFLFLWSIPLIIIELSIGKLTKKAPIGALIKTAGKKFAWAGGFITLVTTCILAYYSTIVGWGLSYFYYAVSGKIHLGNDFAKLWTSHYQSSIPLWAHLTSLGLAYLVIRKGIVHGIEKCNKILIPAFFLCTIALLLRAVTLPGAVQGIKQLFSCDKSCFSNYKVWIEALTQNAWDTGAGWGLLLVYAGFASKKTGVVSNGALTAICNNLVSLIMGDHYLFHMCFFRHFRNHAATRWSRSXKHRDYLYLPTRVIYPFAWRNLSNHPV

SEQ ID NO: 1183 - protein, 132 aa, Chlamydia pneumoniae
MRAEMAVIYWDRSKIVWSFEPWSLRLTWYGVFFTVGIFLACLSARYLALSYYGLKDHLSFSKSQLRVALENFFIYSILFIVPGARLAYVIFYGWSFYLQHPEEIIQIWHGGLSSHGGVLWLSFVGGHFFLDI

SEQ ID NO: 1184 - protein, 171 aa, Chlamydia pneumoniae
MSVHITPRKCFILCILSMFTLPTLFPKAHLILFSPYIVLCFYCFSKDKGLVLALGCGVLSDLALGSRGVFLLLYPLTALITHKAHLIFSKESKAALVIVNMIFYGVFLLLTIPMCALFGHEVRWSIDVLMIPLKCSFLDNLIFTSVIYILPCAINSGIHKMISFFRRLVCY

SEQ ID NO: 1185 - protein, 205 aa, Chlamydia pneumoniae
MFMKICSLKLKNFRNHSDLEISLAPKLNYAQGKTNLLEALYVLSLGRSFRTQHLTDTITFGSSHFFLETQFEKDHLPQALSIYTDKQGKKICYNQLPIKTLSQLIGKVPIVLFSSKDRLLISGAPADRRLFLNLLLSQCDNHYTLCLSYYHRALQQRNALLKSKQTSTVASGMNSWSNTAPTYPSNGFSVVRNFQIYPKNFGLTT

SEQ ID NO: 1186 - protein, 81 aa, Chlamydia pneumoniae
LRFRNIKKSLIFIKRIRYSQSGKEQKGARPFFKKSITSSLVILLLEAIFNENFSSIIQNNFNKNFKNKNISINRIFVKFTI

SEQ ID NO: 1187 - protein, 79 aa, Chlamydia pneumoniae
VQLFQYMNESGWDWLCDFDSQGEGFQLSRLVGLLHSSWALYEAKEQFYLPEVSLLTWEELIEMQFVKQTNKTRGCKRSL

SEQ ID NO: 1188 - protein, 119 aa, Chlamydia pneumoniae
MPVSSAPLPTSHRPSSGNLGLMEPNSKALKAKHQDKTTKTIKLLVKILVAILVIEVLGIIAAFFIPGTPPICLIILGGLILTTVLCVLLLVIKLALVNKTEGTTAEQQIKRKLSSKSIS

SEQ ID NO: 1189 - protein, 105 aa, Chlamydia pneumoniae
MSSPVVTGTSSASPVEQTKLGEFLERLSGSGRCIKIAFAASTALLLLNTFVSGIVAIAMIFVATSVGAYFTVIGPLFLLSLILLAIMLISMYKITHPSQNTPISN

SEQ ID NO: 1190 - protein, 162 aa, Chlamydia pneumoniae
MLCTCSRIQDGNPWMKSERLKKLESELHDLTQWMQLGLVPKKEISRHQEEIRILEHKIYEEKERLQLLKENGEIEEYVTPRRSPAKTVYPDGPSMSDIEFVEPTETEIDIDPGETVELELTDEGREDGAVEVDYSHEDDEDPFSDRNRWRRGGIIDPDANEW

SEQ ID NO: 1191 - protein, 83 aa, Chlamydia pneumoniae
LVIQIGVLPPLVATKKIDINRFMQDADNWIPMFSHPFFLREKTLSDGKDIHILSRLKGLQTCAPCSPHEERTITLLSHSNSVS

SEQ ID NO: 1192 - protein, 95 aa, Chlamydia pneumoniae
MNKSRFLRLCCCLCFCGSLFYFYINKQNSLTKLRLEIPCLSVRLRQLEQQNISLRFLIDKIERPDHLMEIAALPEYQYLEYPSEESISLLSYELP

SEQ ID NO: 1193 - protein, 101 aa, Chlamydia pneumoniae
MDPASPVAPHVLQDHVQLSSEELSALSSGVSRVKKLTIAIMVLSLIAISLVACGLFLTGSAPLQLSIWIAASCITLSMLVCACWRYKISNALEKTKVAHES

SEQ ID NO: 1194 - protein, 77 aa, Chlamydia pneumoniae
VMWYSDYHVWILPVHERVVRLGLTEKMQKNLGAILHVDLPSVGSLCKEGEVLVILESSKSAIRGVKSCIRRGYRYQP

SEQ ID NO: 1195 - protein, 172 aa, Chlamydia pneumoniae
MGFKNICKQGSQLYLNGIFPERILARKLKNCAKSYPRTALTIEVLVSSVLGALKVILIPCASTYAALTLPLRALFNAIKTKSCQHLASYAMAWLLHILTIAVIIGLVFSLVFIPPPVVFISLGLLMSVTTSVTLFQVHKNLFPPYEPPPSRPHTPPPFADEYVPLISESYFD

SEQ ID NO: 1196 - protein, 224 aa, Chlamydia pneumoniae
VTPSADDAKKIAVEKKKDLSASARMEEHEASQRQDARHRRIGREAQGSFFYSSRNPEHRRSFGSLSRFKTKPSDAASTRPASISPPFKDDFQPYHFKDLRSSSFGSGASSAFTPIMPASSRSPNFSTGTVLHPEPVYPKGGKEPSIPRVSSSSRRSPRDRQDKQQQQQNQDEEQKQQSKKKSGKSNQSLKTPPPDGKSTANLSPSNPFSDGYDEREKRKHRKNK

SEQ ID NO: 1197 - protein, 139 aa, Chlamydia pneumoniae
LIKKRAIFERMFPIPPPHCPPNNKNNFYHLTTDTKDPLLLRILRTIGYVLLHIITLGLLLLIHYYKHHRVVRKEGLPTPPTLPKGPEPKTIEIAKQPPKDGEDKKPDVPKPGTPPPEDTPPPPPKAPSPASPKVPKTTC

SEQ ID NO: 1198 - protein, 79 aa, Chlamydia pneumoniae
VVESAFYQQVVLGTFGLAGEGALGGGGGVSSGGGVPGLGTSGFLSSPSLGGCLAISIVFGSGPLGRVGGVGKPSFLTTR

SEQ ID NO: 1199 - protein, 90 aa, Chlamydia pneumoniae
LDDSWILEVKVTPKAKENKIVGFDGQALKVRVTEPPEKGKANDAVISLLAKALSLPKRDVTLIAGETSRKKKFLLPNRVQDIIFSLHIDV

SEQ ID NO: 1200 - protein, 107 aa, Chlamydia pneumoniae
LQNSMHKVFADPSLTDTITLPIDAPGDPAYPHVLGEAFISPQAALRFLENTSPNQEDIYEEISRYLVHSILHMLGYDDTSSEEKRKMRVKENQILCMLRKKHALLTA

SEQ ID NO: 1201 - protein, 279 aa, Chlamydia pneumoniae
MSSLLSCGRIEPTRVTCSLKTYLEDTSQNQLSTRLVRASVIFLCALLIILVCVALSSLIPSIMALATSFTVMGLILFVMSLLGDVAIISYLTYSTVTSYRQNKRAFEIHKPARSVYYEGVRHWDLGRSSLGTGEIPIVRTLFSPFQNHGLNHALAAKIFLFMEHFSPEPPNEPLVDWACLIRDFRPHVSSLCFVIEKQGSSLRTKEGNTICEAFRSDYDAHFAMVDCYRLIHSKLIIEKMGLKNIDIIPSVMVREDYPSRPGEGYREGLLRMYGGKGAL

SEQ ID NO: 1202 - protein, 239 aa, Chlamydia pneumoniae
LKVQKLRQPSFYPKRLMTLYLGLNQKTARKYQAHYLPILTLFPYAKSTPQNKRALQFLPQATHVILTSPSSTHLFLSRMTSLLSKATLKTKTYLCIGESTKERLLSFLGQVKYVVATQEIAEGIFPLLQALPSSARILYPHSSLARPVIREFLYNRFTFFSYPHYTVKPRKLKKNILSKYKKIIFTSPSTVRAFAKIFPRFPEKTYWCQGRMTLQEFQKFSSQKQVSLLETLGKSRTSP

SEQ ID NO: 1203 - protein, 110 aa, Chlamydia pneumoniae
MASSATPGFDGTAPSLFPPATRPRYNFKLALFVTIAIALVWIALIATTIAIGLCIHPLCSFIFLTAIPLYFISRYICSHYARNVYIALDVVPDHSKLQDMRSHSPIFSDR

SEQ ID NO: 1204 - protein, 196 aa, Chlamydia pneumoniae
  SITE 1...196: Xaa=unknown or other
MLILGLLTPTFGSLKTFPSHSAGKQTHSMIGWVPQHFSYDPCFPISVKDVVLSGRLSQLSWHXKYKXKDFEAVDHALDNVGLSDHHHHCFAHLSGGQIQRVLLARALASYPEILILDEPTTNIDPDNQQRILSILKKLNRTCTILMVTHDLHHTTNYFNKVFYMNKTLTSLADTSTLTDQFCCHPYKNQEFSCSPH

SEQ ID NO: 1205 - protein, 92 aa, Chlamydia pneumoniae
MLSSLIRDSFPLLILLPTFLAALGASVAGGVMGTYIVVKRIVSISGSISHAILGGIGLTLWIQYKLHLSFFPMYGAIVGAIFLALCIGKRST

SEQ ID NO: 1206 - protein, 188 aa, Chlamydia pneumoniae
  SITE 1...188: Xaa=unknown or other
LHRQKIHLKYQEREDSLIAMIWSVGMAIGIIFISRLPTFNGELINFLFGNILWVTPSDLYSLXIFDLLVLGIVVLCHTRFLALCFDERYTALNHCSVQLWYFLLLVLTAITIVMLIYVMGTILMLSMLVLPVAIACRFSYKMTRIMFISVLLNILCSFSGICIAYCLDFPVGPTISLLMGLXYTASLV

SEQ ID NO: 1207 - protein, 112 aa, Chlamydia pneumoniae
VFSYLLLCIILVYVRFMYEGKSRMASPTPGQLHLQQKVESKAYDYSRSLAMIATALLFFIVALILSGLSLLPQVFLPFSGAYFIIGSFLAFIALGILLINCVCDLKQYLTSS

SEQ ID NO: 1208 - protein, 320 aa, Chlamydia pneumoniae
VLISISLATLPILAFSWASFIEPNWLRTTAIPWRLPKKHAHLHGLRIAQISDLHFHKRVPEKFLNKVSKSIKNFSPDLIVFCGDLLCRARLEDKERLETFLNTLEAPLGVFAILGNHDYSSYISRNTKGEITCIPEEKSRPIQRAIIAVMQGLFSSPSYRYDPNLTPQEPHPDLLKLLKNTPLTLLHNTTHVIPNTLNIVGLGDLFARQFHPEQAFKNYDPSLPGLLLSHNPDGITRLQQYPGDFVLSGHSHGPQVTLSWPKFARKFFERLSGLENPYLARGYFVTKEGKQLYVNRGLGGLKRIRFCSPPEICYITCSYD

SEQ ID NO: 1209 - protein, 185 aa, Chlamydia pneumoniae
MTATMSLLNLPSSQDSASEDSTSQSQIFDPIRNRELVSTPEEKVRQRLLSFLMHKLNYPKKLIIIEKELKTLFPLLMRKGTLIPKRRPDILIITPPTYTDAQGNTHNLGDPKPLLLIECKALAVNQNALKQLLSYNYSIGATCIAMAGKHSQVSALFNPKTQTLDFYPGLPEYSQLLNYFISLNL

SEQ ID NO: 1210 - protein, 173 aa, Chlamydia pneumoniae
MADDTLIPKLMKNSLSQACSEGLLIAKYPPLQVIVHFDNNLVVKTHLSVAPVFSCLFLGPAAHKAMQEIVLWCSRYANKEHPPFSSHFAKDLIPSQYLEILNCVAEIPFGEQQTYAEIAKKTDTHPRTVGAACKQNPFLLFFPCHRVVGSHGERNYVLGPVIHEILLKFENSY

SEQ ID NO: 1211 - protein, 137 aa, Chlamydia pneumoniae
MIENDFPEASNFESSHFYRDKVGVIILCGGEGKRLSPLTNCRCKPTVSFGGRYKLIDIPISHAISAGFSKIFVIGQYLTYTLQQHLFKTYFYHGVLQDQIHLLAPEARQGDQIWYQGTQMQFEKTYFISKIQKSNTF

SEQ ID NO: 1212 - protein, 94 aa, Chlamydia pneumoniae
MLIRLFLGISLPKGFPLYLEPPLVLATFQGTQFVGTYSEATNPLYIDNLNLNYHYTQELLYKAVPCNYKSIYREIPLIIFPEVLIGSTPTQSTE

SEQ ID NO: 1213 - protein, 168 aa, Chlamydia pneumoniae
  SITE 1...168: Xaa=unknown or other
MRQFCNLLSLSRLWLALYFCQEKLHIRLLAIVGAMLSDVLDGYLARRYKATSRLGSILDPITDKVFVFVCITVLYMEGSLSIAHLFFICARDLFLXTFVFYLSLVKGWKGYDYGSLFWGKIFTVVQFIILLGVTAGGEIPWTGLVPLVALGFLYFLERIMDYKKQFLR

SEQ ID NO: 1214 - protein, 88 aa, Chlamydia pneumoniae
MSRSLRKGPFVDHHLLKKVRAMNIEEKKTPIKTWSRRSMITPEMIGHTFEVHNGKKFLTVFVSETMVGHKLGEFSPTRIFKSHPVKKG

SEQ ID NO: 1215 - protein, 252 aa, Chlamydia pneumoniae
MLIVLAFRQVFFSHSRSQLDRLKNYLRLLKQNFAITLPKERTSKGHSLMLTFDFASFDFYTNIFPFLEEQKIPAVVGVASRYIPSNAAQDLHPSHRLKPSETLAFQDEIFSNYMPFCCQNELIEMAKSPYIQLASSGFAIRNLMNNPPYLTTEILLSRHHIETITGAKPLAFLFPFGKSDPTSRKLAADHYPYSFLLGNTINRKLKTHNIYRLDIKPMQYVCPSLFQSSRYLKNWIKEKSKQLYLKKQLPKR

SEQ ID NO: 1216 - protein, 149 aa, Chlamydia pneumoniae
MADLEVFQADFALLFEAGLLAIKQGDEDSARKLFQSLHILNPNHYGHDLGLALISLHKMDLFDAEERLSALIKGNEDNWSIKAFLSLTHMLIVLHQGSSFEVRRESLESCLKFADQVIANCKIESTRALAQSVLDWHDTLVAKSAGPLG

SEQ ID NO: 1217 - protein, 75 aa, Chlamydia pneumoniae
MFFAPLLYESLRRGLMHPTSHMQQQLARLEFINDQLTTELEHVNELLCSLGFPEGLTTIKAIAEEVLSDDEPLLD

SEQ ID NO: 1218 - protein, 467 aa, Chlamydia pneumoniae
LPSNRKNAKRNLYKLSFIIVRKCVVTSALNDFFLTETVMNATKHCRASFSNSPRHLLAQLAEDITSTHQKPFTKRWILVANATTGHWIKNQLVHVLSDHIFMGSTIFTASDSIVKHLFLGSGCSQPNIPDYLTLPLLINNILEEISKASKFENGREFLSPPTYGTTKKLAAAFKQFHTFSQRPTKNASHYQELFQILESHFSSYEEMFTTILNNRTQEEDCSLHIFGYAHLPKHLAEFFINLSTYFPVYFYCFSPCREYFGDLLSDRAIDFFWNQLPDSPIKNAWEHYVLSDRQALLANLAHKSQSSQNFFLDREIDYQEMFLPSKHDSSLGVIQNSILDLKPTSPQDFSQTKQTICIYRALNIPREVQEVFCKVTELLHRGVSPEEIFILSSHIESYKVHLNAIFNPHVPIYFTDEVDPRAEDLRNKNPPTFFYFTNTRGFTLHSSTPYAPTTTTTYRSKQGSLSD

SEQ ID NO: 1219 - protein, 81 aa, Chlamydia pneumoniae
LEAPMNEGIHSVCFQKTPRLTAKSVVSMEMLLTTQQLPSAEGMPSVANLEADFLRAEALLAEMREIRGCLEQSLRTLVPSE

SEQ ID NO: 1220 - protein, 95 aa, Chlamydia pneumoniae
MMKYLPYIAITACIHGGILLLVFASPLPKKRLQPKAFQEKLVTIQPKPPVPTPSVVVDPAKTIRPSVLRSHKNKLNAALLKRTSRRLYKNPFQKL

SEQ ID NO: 1221 - protein, 96 aa, Chlamydia pneumoniae
  SITE 1...96: Xaa=unknown or other
LNKFKTYLQTALIAPFFSFPALSGSFSSIQAEEIXQQVNHPGAELLSEGSYIPGLQTFRLGIKIYSFQREPYLLEESRRNWKSSQNFLAVAERFRG

SEQ ID NO: 1222 - protein, 76 aa, Chlamydia pneumoniae
VRALFRSGYKGRQGIYEFLRPNTLFRSEVASNRPYHILRETAEQNGFLPILEHGIALAVSGETTLAEVLRVTKRCD

SEQ ID NO: 1223 - protein, 185 aa, Chlamydia pneumoniae
VPTLAKSFYINIRDSRFYSWLCFIMKETYYRDFLHENYLKNKKSMFMKIYKTAGEFFLANAKWPLVPAGYRRVRGKDFVLSPLVDLVILFPWVTKDSRYSPCSMTFTCICRSIVECIPVVSTLFGIGRFCAVWCVEGFSGSTFDKIYHTIVAVLGILGLGILTFILRIIFSVLMLPVWFLFKCYS

SEQ ID NO: 1224 - protein, 75 aa, Chlamydia pneumoniae
  SITE 1...75: Xaa=unknown or other
MWWNPAVENQATDRVHRIGQSRSVSSYKLVTLNTIEEKILTLQNRKXSLVKKVINSDDEVVSKLTWEEVLELLQI

SEQ ID NO: 1225 - protein, 122 aa, Chlamydia pneumoniae
MRDRLGSLSLILKVKIHKYLDTLHNQKRLALTVSRNIQATNKRIADLHLERYEHFISRDNIKHYDILLEYLKTLQSSLYKQQSESLRFLEIHHQQLQELINRRKIIEKIKNNKYSKDQEIGT

SEQ ID NO: 1226 - protein, 178 aa, Chlamydia pneumoniae
  SITE 1...178: Xaa=unknown or other
VTTPQSPGSLSQSHLPHPHDPWDTEPTSLXEXPNDKASQELHSLVHLFRKLSIHLLSEVEKTVQQLKPDLLELALLICEKFLYKKLENPQELALLLSTALQRHTTLRSLTPIKVFLHPEDLKTLTDWISTHELPMIKHAEFFPDTSCRRSGFKIETPNGILRQEISEELDHLLSVLTA

SEQ ID NO: 1227 - protein, 161 aa, Chlamydia pneumoniae
  SITE 1...161: Xaa=unknown or other
LLLRYHAKAEKPTLQLTLNENYIAHLTKEESEKIVAHTKHYLLSNXDDSYDIVIETLPFARLQNKKSFSAKVLIGSMILVISLMIVALASFYLARHAYERVSPEPRKIKRGINISKLLEIIQKESPEKIALILSYLDPKKAEALLNRLPEDLKHQVLKYKL

SEQ ID NO: 1228 - protein, 75 aa, Chlamydia pneumoniae
VFFQNLAKKLTALGISPLGCLLIGGVVSCAILFGRSSNPSLAPTQVKTEKTSGNWLKLTQMGNPKLIESLTKKDS

SEQ ID NO: 1229 - protein, 100 aa, Chlamydia pneumoniae
MGYVFYVIAGSIFLGISLGAYCQLYYSVKSVLFSWYLLTVYALEKRHALLALSQLVGEEDAQSQKEIDFLSQCDKLSWRAFLKNSYEIIPTFQRDGRPSF

SEQ ID NO: 1230 - protein, 103 aa, Chlamydia pneumoniae
VTSSLGVRSSKIATRSSQHFKEMEDLLSERVQGFLESIETIAEHDRAILCIENFWASKNLFDFEIAAYEEAVEKYLKLRQRAPLRLASKLFRFLDVPSIRFSS

SEQ ID NO: 1231 - protein, 94 aa, Chlamydia pneumoniae
SIATGETMLYFIEQLNKLSTSFCVFPMILLLGGFLTWKLRGLQFHGLKLGFNLMLQNKLDDSSSKANEVSSYEAVAGILAGNFGTGNIAGMLSP

SEQ ID NO: 1232 - protein, 240 aa, Chlamydia pneumoniae
VPNRHVDMNSWWRSACYPRSTFYPLSDGDSTFHRRITKPDFRLCSTCKSCSQPILYLYALLVIANHDEISFGLLRYFLGGYRPSKTARLAMSILQIHGVMLDSQLVKTSISTMTPTLLTKSVHSLLAILHITNQKSIPKYSKGSRGLFVLLRVNSIFTATTISPSLSLRQCPDRYTIRAGRNLPDKEFRYLSTVIVTAAIHQGLGSMLSLRLTYPFNLLALGRRHTIYFPLEVCIVLCFC

SEQ ID NO: 1233 - protein, 133 aa, Chlamydia pneumoniae
LNFVSTLTGSDFYAPVLEKLEEAFADTTGQAILFSSSPDFIVHPIAQQLGISSWYASCYRDQSAEQTIYKKCLTGDKKAQILSYIKKINQARSHTFSDHILDLPFLMLGEEKTVVRPQGRLKKMAKKYYWNIV

SEQ ID NO: 1234 - protein, 118 aa, Chlamydia pneumoniae
VILLQNIKRCSLKQLKVLATLLLSLSLPTLEAAENRDSDSIVWHLDYQEALQKSKEAELPLLVIFSGSDWNGPCMKIRKEVLESPEFIKRVQGKFVCVEVEYLKHRPQLKTFVSKILL

SEQ ID NO: 1235 - protein, 87 aa, Chlamydia pneumoniae
MKSFKFLLPFLSVILCCGNLLSSPRSRAISVTESIGMSAVKTLVLSEKAHEFLEGIGYGVGASSILRDWQTQQWLEIESLLAQNEVM

SEQ ID NO: 1236 - protein, 141 aa, Chlamydia pneumoniae
MQYFSPAKLNLFLKIWGKRFDNFHELTTLYQAIDFGDTLSLKNSMKDSLSSNVNELLSPSNLIWKSLEIFRRETQIHQPVSWHLNKSIPLQSGLGGGSSNAATALYALNEHFQTHIPITTLQLWAREIGSDVPFFFLQEQH

SEQ ID NO: 1237 - protein, 174 aa, Chlamydia pneumoniae
LGSRNRKRCSFFFSSGTALGKGRGEHLFSIKKLNHKHKYVLYLDHQGIPTEKAYQSLLPQDYSTGNHNACFYGENDLEKSVFRIRTDLKNKKHMLERMWSPFESHVLMSGSGATLFVCYLEELEQDSKVSSQIHSLIKQTQGIPVSRLYREPHWYSLKQSTYKNSPLECFQPQI

SEQ ID NO: 1238 - protein, 106 aa, Chlamydia pneumoniae
MGLYDRDYIQDSRVQGTFASRVYGWMTAGLIVTSCVALGLYFSGLYRSLFSFWWVWCFATLGVSFFINSKIQTLSVVGQVMAYAMVLAKGMEIDCPRNLAKSVTVE

SEQ ID NO: 1239 - protein, 217 aa, Chlamydia pneumoniae
  SITE 1...217: Xaa=unknown or other
MSNKVLGGSLLIAGSAIGAGVLAVPVLTAKGGFFPATFLYIVSWLFSMASGLCLLEVMTWMKESKNPVNMLSMAESILGHVGKISICLVYLFLFYSLLIAYFCEGGNILCRVFNCQNLGISWIXXLGPLGFAILMGPIIXXGTXXIDYCXXFFXXGLXVXFGIXXALGFLKIQPSFMVRSSMVNYNKRISCVFSLLFGFQSXIPTLYYYMDKKSWRC

SEQ ID NO: 1240 - protein, 115 aa, Chlamydia pneumoniae
LVSSFVGVALGVMDFLADGLKWNKKSHPFSIFFLTFIIPLAWAVCYPEIVLTCLKYAGGFGAAVIIGVFPTLIVWKGRYGKQHHREKQLVPGGKFALFLMFLLIVINVVSIYHEL

SEQ ID NO: 1241 - protein, 105 aa, Chlamydia pneumoniae
LFPLVLLAWVIRYQLHANFHCSVVPFPGFSVNQAYKCSEAKIEEMLDLLDLETLEWSSRCLRQDMTFANRLEEELIQELRVSETEELISLGGKRNLVRLLLTHSF

SEQ ID NO: 1242 - protein, 158 aa, Chlamydia pneumoniae
MRVIFPDKHNNFPNLSKLLKKLPSVILVTSCIAPFFSYIINKFFGIPGLLEILALSVKGIQKHHFWQFLTYPLITADSLSLNKDQSFEITQRLLLRNVLDFFLFYKAIQHLIRKLGAFSVLVVISGQALIIGAVLWGFMALITAPNLSSVRKVLSVVF

SEQ ID NO: 1243 - protein, 135 aa, Chlamydia pneumoniae
MRLKNYPMIQFSFFLPQTCILLLASDSLTNILALHHLLANYSVKQRMLVLLRESFFAFIAMFALYGLALGGLKVLNTPVCAIEVVGGIAVTLAGVRAVLRLGKEESWIPYKFNMSPSYSPCISPIALPLMFGPSG

SEQ ID NO: 1244 - protein, 160 aa, Chlamydia pneumoniae
MKKKFIFYFVIVFSLLFLWEMTSRHRPTFSFFCPPPSSIASSTLQSLPLLLTSAWHTLKAILGGFFLAITLSIVLATIMLSYKSAKDLLQPLFILLQCTPMFALAPLIVLWFGWGIGAVIVPTALTIFFPLTLTIYQGILSTPEELIEQFVLCGVQNSNS

SEQ ID NO: 1245 - protein, 227 aa, Chlamydia pneumoniae
  SITE 1...227: Xaa=unknown or other
MLWGVSMRQSFDELSQNAFKNIFNKQRFCFIFCSLCCFGFVFALFLKLCSRLAPEISLSTLGLGAFFCAFSVICASAIIVQFLLHKESQGETSKLCCAIKNTWSSLWLSLLVSMPFFIAMVAVVTVAMLSSFLGSLPWVGKLFHTVLIFIPYLSATALILLFLGSFSCLFFCIPVLHNQESIDYRKLPRVFSWEYPSAVYRGGDCFGSXSPMQLVSFRFFLFDDTSC

SEQ ID NO: 1246 - protein, 78 aa, Chlamydia pneumoniae
VVIALVPLALCSWLALDSFYLMTHLVEIADIHTWSFLAQMFVLIVPIALILTPAVSFFFNFSFSFYLAKQEEEKALVK

SEQ ID NO: 1247 - protein, 94 aa, Chlamydia pneumoniae
LRAFFPVKAWRSPEDIPEAPSPKGIGSKRSIVAVPWEWRSRCQVTESPAYPAPKTAIRIKCTLNQVSLHRPCLENKRIRDKRTGGNLSDWEIKM

SEQ ID NO: 1248 - protein, 86 aa, Chlamydia pneumoniae
  SITE 1...86: Xaa=unknown or other
MRIAVLGAGYAGLSVTWHLLLHSQGTATIDLFDPIPLGEGASGMSSGLLHAFTGKKALKPPLVGSRNQCYTRVNHXALVKPSTYLL

SEQ ID NO: 1249 - protein, 232 aa, Chlamydia pneumoniae
  SITE 1...232: Xaa=unknown or other
LPMNTSHRKTLVFSYLSSTFTLLLVLSNLVLSSKLIPTTFFNFIIPGGLILYPLTFLISDVVNEIFGPKKARVMIFSAFIANLLASSIVQIFMFFPVASPEMQTAWHCLFDLSPLRFLASLLAFIVSQQLDIVLYTFFKNRTPNSSLWLRSNGSTWISQXPDTFIVDTCILYFGMGLSFPQTLNIMFYSYIYKITFCVLTTPLFYLAVNTIRKFLGMPSTKIANTVPLINQP

SEQ ID NO: 1250 - protein, 103 aa, Chlamydia pneumoniae
MTPKSIQQLHLIKTIDPVRKISPVTTKKSSFFRQSLLRFLELFWMFLYCIRSIRFHCVHIATFICRGLILFLTTLFLSMICILHFITLPWICKEDPRIIRKNK

SEQ ID NO: 1251 - protein, 79 aa, Chlamydia pneumoniae
LNFAKIDHNHLYLTCLGDLGVACPILSTDCLPNYSEKASHEVLVYSKFRCISGEPSRLATSGNDTYYSIVSLPIGLRYE

SEQ ID NO: 1252 - protein, 85 aa, Chlamydia pneumoniae
MVEIHHKDPSLKKLFALQQSLETLNSLSDIVATYEAMFSLIYEGLNKALRKDQLCYLLSVNSKGELLKSPSGDPIVQTFPIHPHH

SEQ ID NO: 1253 - protein, 75 aa, Chlamydia pneumoniae
MEEVPFENAMQRLEEIVDLMNQPTTSLDASLALYEEADALMRICESRIRQVEQRVRELAEKRHESSLFEEQAVVR

SEQ ID NO: 1254 - protein, 126 aa, Chlamydia pneumoniae
MYISSSFSSSAKVSAICLASICSKVSSRFLSNNINPKTNRTTPREIVLIPNPQTMSALNPEITPLSTIAPQTTRRMPTTNKVIPRARDLLSLGITNFVSSGGVGDTCRIAGAAVMIEYQNHKRNID

SEQ ID NO: 1255 - protein, 81 aa, Chlamydia pneumoniae
MESKKVSKLASNSTFFLASVSCLGSTVPPYRALRSLTRVSTSSCFFRKNFVLASSRRSTKSDKSFLFASVDSFELSSRSFS

SEQ ID NO: 1256 - protein, 80 aa, Chlamydia pneumoniae
LLGMCTLLLIPKQLRLLILTKCLSITLSHTLIHTRLQGSKCLFKGRLRHTINMPIKSHGYLPYVTSRSHKAIHNLTSRFL

SEQ ID NO: 1257 - protein, 87 aa, Chlamydia pneumoniae
GSTFANLSLHLLYCTKALVNACFIGWSGRSAIRSIISISSTRGRVSSISSHKTLRRFAASESMVYSISSVASLSTPKAKVSAFDNLL

SEQ ID NO: 1258 - protein, 81 aa, Chlamydia pneumoniae
MHPHSKCRFLGFSCFKKLSIAGTNVLLIKEDFPDPETPVTPISRANGRRIERFLRLWIVASVSKSQDVGASRDSGMGMVSS

SEQ ID NO: 1259 - protein, 107 aa, Chlamydia pneumoniae
MIAPSLPALLAICFNGAVNAFRIIRVPIASSSFASIGRKASSVGIQRTKAVPPPGRIPSSTAAMVACCASSTLSFFSFISISVAAPTRITATPPESLAKRSWSFSLS

SEQ ID NO: 1260 - protein, 76 aa, Chlamydia pneumoniae
LPPALQVLYMKSLDNANLEILHKIFQVQVEANELPLQMLHETTPKALLQGHAAFSDQNELLEISYTYHKLTSYKEA

SEQ ID NO: 1261 - protein, 76 aa, Chlamydia pneumoniae
MCNRCKDSSTSLVFSTCLGTHKTETPSFINFCTTGSHFPASLLCIEPRITNFESVGNLKRSLQVSLSKCSAVCAAT

SEQ ID NO: 1262 - protein, 80 aa, Chlamydia pneumoniae
MLNHQQHKVVSISQFHQQRQLVHKKNWRRGSTTHKECATDAKILQHPWSFQRVLAPIKLRPPLLLISALQEAIFLHHFYA

SEQ ID NO: 1263 - protein, 112 aa, Chlamydia pneumoniae
MIRLWSCSSIKIETVPYSKEIAYCRWYSNTTLSYWILIREKCRPTKKSASSRFLTKNNNIVHHMSSQKLFAFQAKIFVAFFFQKNIFYQFFFFRMTCKVKRSIFQEEFCRPI

SEQ ID NO: 1264 - protein, 148 aa, Chlamydia pneumoniae
SGRIISVMLSAPPCELHSDLIDPDLFEFNHRLNICISAEVRGRVTTHTFRGDSCNMSFNCSVRGNVITIPRIIRIEIRSLTSSFSIITKCKRISSRLRITNIIAYWSLRYVCLRIDIKTVRECSSIKLRTFRRHITLHNKFTWRSRGI

SEQ ID NO: 1265 - protein, 130 aa, Chlamydia pneumoniae
SFFSFRKVPNFSNQPMCFLIRSCWSASINAWRGDRFCDSSLSNHDHMVCNRNMPSNSGLPSNDDMFTNFCRTCNACLGNNNTMLSNFYVMSYLYLVIYFSSFMDHGVLESTTIYRSVGSDFYIITYNHIA

SEQ ID NO: 1266 - protein, 78 aa, Chlamydia pneumoniae
EAVFVSGKKDGVRGMIFVPLSILVLIFLPLPQILLDFGLCISFALSLLTVCWVFTLNSSNSAKFFLHFSYIFAYCGWD

SEQ ID NO: 1267 - protein, 74 aa, Chlamydia pneumoniae
LCTDSTSISCCSIIIEGCNSWVVFYRTTNAIDSPSRGMVSRDVRFHGKIIVEDHRTGILCKNALLMYSYCTTQT

SEQ ID NO: 1268 - protein, 90 aa, Chlamydia pneumoniae
MGAEIEISGVLDSELSLVLAPCLCAHPTKAFINGESSRGLPFLRGTSCGEPVLSVSSISEGDPTDIESSSEEVHSSPRHVQQRPTASAAA

SEQ ID NO: 1269 - protein, 184 aa, Chlamydia pneumoniae
FFVFTHVWYLISRGYFYSLFSLGVGALATLTLATRIGRSPILYPFANSSKIVPSGTSEVSSVCTASCRKGLNFWPIEEYSIIPFSSKICLNWLRIMLNPRAQFFTSSDICVANPRAFSMLSMGLRKSIKVFSKAYCISSWRSFCKRFLEFSDSARAMRYLSFFSFNSVFRVTISCCKCSTSFSF

SEQ ID NO: 1270 - protein, 98 aa, Chlamydia pneumoniae
LISVEETPESSIFAFSAASLSLCKAILSLLRSMPSCFLNSSIIHLIMTSSKSSPPRRVSPFVDRTSKTPSPISRMEISKVPPPRSKTAIFLSPTLSIP

SEQ ID NO: 1271 - protein, 78 aa, Chlamydia pneumoniae
FLKTMTKGFAFCSASFPIAIIENVVSKSVEGVSHPEGENANPSLLSLVMASWTLGGTSTSSLNKALAKVLISSGDVFP

SEQ ID NO: 1272 - protein, 122 aa, Chlamydia pneumoniae
MTTGSCSPSKALFVCINCIAFIEMSTNTTEAAPRLRASKPIAPIPAKRSKKAAPSISSLQILKNASFTKPEVGRICGLENVFKDFPLYLPAKILTSPLEEQSLRNQQPLVCSGSLGYYRIHL

SEQ ID NO: 1273 - protein, 112 aa, Chlamydia pneumoniae
FTFFFLAQLEKQLPHLVLFFFFSATSSLRASFIHSSLWSRVFSSSFLRFAKFTSAFSSSLEAASTTSFCLLTFSSSSESCTATTLMYDFICKTASLVVPSSNKSRSCWIFCI

SEQ ID NO: 1274 - protein, 82 aa, Chlamydia pneumoniae
LSAKLMKTSLGVCVGIAGISKGRCLINAKSPFSLKISERSERERVWRSYVYSVDVGPGVFLMMTSKRERLFPRRIAVTTPET

SEQ ID NO: 1275 - protein, 134 aa, Chlamydia pneumoniae
MNSPTIKDPSLETACADDLLAPGILESRCCSPSFQYTALAISSLPMASPTITEPSSEASQAQECRSSGKLGRTTIPVSSHFTAKFVSVSSLYRHPTIVFPSLETPSAKDCIPSENIPRSTSAPFTHFTARQDGS

SEQ ID NO: 1276 - protein, 84 aa, Chlamydia pneumoniae
MRSWTRWTRCGSCCRCSGSWRCSRSCCRNHGSNTNYSSSCCPSGETSCYHSCQTSDHRGYKSGCQIWNKSIYQNFSQSDCQSHF

SEQ ID NO: 1277 - protein, 76 aa, Chlamydia pneumoniae
MREFSCIKDRKNRCFRAAAVKIMCTPSRSSARTTRPKEVKKRTSLEYIQSIWDLGPLDVYSCFSKETSSELYAKRF

SEQ ID NO: 1278 - protein, 78 aa, Chlamydia pneumoniae
MMIVRCCFRALLCFSMCSRTSRPRSPIKAITLIVDFDPKAIAESSEDFPLPGSEKTPIRCPFPKVRNASIALIPVGKI

SEQ ID NO: 1279 - protein, 86 aa, Chlamydia pneumoniae
MRRIFPTSILLIATFCKLPSSKTSQPVVGASCFKETKVLFAFPDTICPNASEIANKTRSKAPSKAPPIKIEPKGADVIKISMFTTF

SEQ ID NO: 1280 - protein, 124 aa, Chlamydia pneumoniae
VKGVLKRQRLSLTMGGRSKLKRRSWLKAAQTTPVVCWRRNVIFSTVIFSPAIIRSPSSSLEASSTTITNFPALKSSIARSKETKFAEPTSSRVSIIDSLALTDSDAKHATLKILSFQFLMGSKT

SEQ ID NO: 1281 - protein, 85 aa, Chlamydia pneumoniae
IQRTLCLLFFKKFILLILVRTLRFPILTFLSWLNFRLKLIFSLILYGLANVAQLVRASDCGSEGRGFKPRRSPSLSSLFLLFFLI

SEQ ID NO: 1282 - protein, 112 aa, Chlamydia pneumoniae
VLYNPKAFITHAASLRQTFVHCERFSTAASRRSLGSVSVPVLAVNLSIRLDVIALVGFYPTNKLISHKLFLNRKVRRSPSLIYIRCLITLHSVLAIVSNRYPQVEGRLSMYY

SEQ ID NO: 1283 - protein, 77 aa, Chlamydia pneumoniae
LESGLPRFRLGFTCLALLRYRLASFVFSFTGLSPCIVQLSRSIQLKLKIPCYRPYNPILKIWFRLFPFRSPLHRESL

SEQ ID NO: 1284 - protein, 85 aa, Chlamydia pneumoniae
MIYQNGIGVWNINPVFYQCSSNEDVGFLIFEFRKDIREVLSSHLTMSYANTSLRNQIANGLSKSIDALNPIMNDIGLSSSKELVP

SEQ ID NO: 1285 - protein, 94 aa, Chlamydia pneumoniae
VKLKLFSVIACITFQKRDTLCSIYTIGDFLQIQSIDSIWVMDQNNLFFYKPWKKGKSHKNNCILQGFLGINGFCLHEESLSCPRCARTYHWIFR

SEQ ID NO: 1286 - protein, 74 aa, Chlamydia pneumoniae
MQQSVRKLFGTDGVRGRANFEPMTVETTVLLGKAVARVLREGRSGKHRVVVGKDTRLSGYMFENALIAGSILWG

SEQ ID NO: 1287 - protein, 88 aa, Chlamydia pneumoniae
VHFSNSSPFNVWTLWLAACCTLIARNHNTLINFQILILSWLLITLATFSLQIFCKGNKVLLATQTVLGLFVTIVGTQLLVSGLQQAFL

SEQ ID NO: 1288 - protein, 119 aa, Chlamydia pneumoniae
MFRRKLSILFQLSLTSSMVRVTSSCLILKTSFLYSATARTALSDNSCTLEAASVSCDREVKTFPIPLKKVFAVASLNLPEILWTNPKMLSPEISPTIGAIAPKIPNVAVAIPSQRAYLA

SEQ ID NO: 1289 - protein, 126 aa, Chlamydia pneumoniae
MVIIFRLSSSLFIGRCFSSQSQNFSFSKHLITREISPAKKPAKAKIPPPLKIATMPIPIETNGASQPIMSERDPHNLSRFSFSMLTLIVSILFSCRASSSRCVDSTESLWHPYEEKSERIPCFVSR

SEQ ID NO: 1290 - protein, 94 aa, Chlamydia pneumoniae
RDYVGHPMGIYRNRRCRGDVWTSKKSSLCRASYSLRIFRLPNNLHLIFFITFWLALPTSTSEHPQSLYSWCPRHPRREMGRSAHECRPDYCCFI

SEQ ID NO: 1291 - protein, 98 aa, Chlamydia pneumoniae
MGFCNFVIYPCREEFNIFCCPSANKLSIFIFTPANADSGGDRMGSVRESSTTTRHDYFKDSAVFERFYTGIYRNDIPKELFRKYRCIRDDIKIFDFCL

SEQ ID NO: 1292 - DNA, 20 bp, Chlamydia pneumoniae
tgaccacttggttgtaggga

SEQ ID NO: 1293 - DNA, 20 bp, Chlamydia pneumoniae
ggagttctcctttggagtta

SEQ ID NO: 1294 - DNA, 20 bp, Chlamydia pneumoniae
cgcttagtccatcggctttt

SEQ ID NO: 1295 - DNA, 20 bp, Chlamydia pneumoniae
cgaacacctgaacttgctct

SEQ ID NO: 1296 - DNA, 20 bp, Chlamydia pneumoniae
tctgagagcgttgaagcaga

SEQ ID NO: 1297 - DNA, 20 bp, Chlamydia pneumoniae
taggagcatagaccgcaagc

SEQ ID NO: 1298 - DNA, 20 bp, Chlamydia pneumoniae
ggaaggattcactgcacgta

SEQ ID NO: 1299 - DNA, 20 bp, Chlamydia pneumoniae
ggtcactccgagcgtcgtca

SEQ ID NO: 1300 - DNA, 20 bp, Chlamydia pneumoniae
gcatgcaggacatctaccta

SEQ ID NO: 1301 - DNA, 20 bp, Chlamydia pneumoniae
ccacgaatctcttggggaaa

SEQ ID NO: 1302 - DNA, 20 bp, Chlamydia pneumoniae
ggctcggatcgttgttttct

SEQ ID NO: 1303 - DNA, 20 bp, Chlamydia pneumoniae
ctgaaaccccgatcataggt

SEQ ID NO: 1304 - DNA, 20 bp, Chlamydia pneumoniae
gcgggttatttcttattgga

SEQ ID NO: 1305 - DNA, 20 bp, Chlamydia pneumoniae
cttgggttggatggagatag

SEQ ID NO: 1306 - DNA, 20 bp, Chlamydia pneumoniae
gtggagtcgtagaagtgcaa

SEQ ID NO: 1307 - DNA, 20 bp, Chlamydia pneumoniae
ggggaagaaatgccgcaaaa

SEQ ID NO: 1308 - DNA, 20 bp, Chlamydia pneumoniae
ccaagaagcacagggtttac

SEQ ID NO: 1309 - DNA, 20 bp, Chlamydia pneumoniae
catgggtctgttcgcattca

SEQ ID NO: 1310 - DNA, 20 bp, Chlamydia pneumoniae
cactctgccactcttccgta

SEQ ID NO: 1311 - DNA, 20 bp, Chlamydia pneumoniae
cagacgcagcaccaaagaaa

SEQ ID NO: 1312 - DNA, 20 bp, Chlamydia pneumoniae
cgcttttctcctaagtgatg

SEQ ID NO: 1313 - DNA, 20 bp, Chlamydia pneumoniae
ggggcatgaactttttaggc

SEQ ID NO: 1314 - DNA, 20 bp, Chlamydia pneumoniae
ctgaagagcttatccaggag

SEQ ID NO: 1315 - DNA, 20 bp, Chlamydia pneumoniae
catgagcggagatttaggtt

SEQ ID NO: 1316 - DNA, 20 bp, Chlamydia pneumoniae
cccgcgtttgaaataggaga

SEQ ID NO: 1317 - DNA, 20 bp, Chlamydia pneumoniae
agtcccacgttcaatgcaca

SEQ ID NO: 1318 - DNA, 20 bp, Chlamydia pneumoniae
gggctagaattttctgtcac

SEQ ID NO: 1319 - DNA, 20 bp, Chlamydia pneumoniae
aagaaagctacggcagtgcg

SEQ ID NO: 1320 - DNA, 20 bp, Chlamydia pneumoniae
ggacgagcttaccgtttttg

SEQ ID NO: 1321 - DNA, 20 bp, Chlamydia pneumoniae
gaccttgccagaacttcctt

SEQ ID NO: 1322 - DNA, 20 bp, Chlamydia pneumoniae
gagcgcttcgaagaggttcc

SEQ ID NO: 1323 - DNA, 20 bp, Chlamydia pneumoniae
gggaccatactcttttctgg

SEQ ID NO: 1324 - DNA, 20 bp, Chlamydia pneumoniae
cccaatctcgtttggctgat

SEQ ID NO: 1325 - DNA, 20 bp, Chlamydia pneumoniae
ggtcatgggctagaagagaa

SEQ ID NO: 1326 - DNA, 20 bp, Chlamydia pneumoniae
cgagcggatcgattaaagag

SEQ ID NO: 1327 - DNA, 20 bp, Chlamydia pneumoniae
ccaactgttcaagggacgac

SEQ ID NO: 1328 - DNA, 20 bp, Chlamydia pneumoniae
cgagtcaaaggcttctaacc

SEQ ID NO: 1329 - DNA, 20 bp, Chlamydia pneumoniae
cctaagtacgaagatcgagg

SEQ ID NO: 1330 - DNA, 20 bp, Chlamydia pneumoniae
gagcggatccaagagtttga

SEQ ID NO: 1331 - DNA, 20 bp, Chlamydia pneumoniae
gggtcgatttcttctccatc

SEQ ID NO: 1332 - DNA, 20 bp, Chlamydia pneumoniae
cagcgagttgcagcatttga

SEQ ID NO: 1333 - DNA, 20 bp, Chlamydia pneumoniae
caggaagtgttcgcatgttt

SEQ ID NO: 1334 - DNA, 20 bp, Chlamydia pneumoniae
cgtgatcttaggcaactctt

SEQ ID NO: 1335 - DNA, 20 bp, Chlamydia pneumoniae
gtgcgttagcgaaaacaacc

SEQ ID NO: 1336 - DNA, 20 bp, Chlamydia pneumoniae
gcacagtagatcctaagcag

SEQ ID NO: 1337 - DNA, 20 bp, Chlamydia pneumoniae
caactgcgagagcggatcca

SEQ ID NO: 1338 - DNA, 20 bp, Chlamydia pneumoniae
cctcttagctgaggatcttc

SEQ ID NO: 1339 - DNA, 20 bp, Chlamydia pneumoniae
gttactttctggagaaaggc

SEQ ID NO: 1340 - DNA, 20 bp, Chlamydia pneumoniae
gctgcagctggagatctaaa

SEQ ID NO: 1341 - DNA, 20 bp, Chlamydia pneumoniae
cgacagtgaacgttggaatc

SEQ ID NO: 1342 - DNA, 20 bp, Chlamydia pneumoniae
ctgcgcaaggacatacgata

SEQ ID NO: 1343 - DNA, 20 bp, Chlamydia pneumoniae
ggtggactagtcagatagaa

SEQ ID NO: 1344 - DNA, 20 bp, Chlamydia pneumoniae
cgatgctatttttccatggc

SEQ ID NO: 1345 - DNA, 20 bp, Chlamydia pneumoniae
ggaggtgctatcgcgattgc

SEQ ID NO: 1346 - DNA, 20 bp, Chlamydia pneumoniae
gaacaggcacagcaatcaca

SEQ ID NO: 1347 - DNA, 20 bp, Chlamydia pneumoniae
cggtttctctcaggatgcaa

SEQ ID NO: 1348 - DNA, 20 bp, Chlamydia pneumoniae
gtatcggctctttagtccct

SEQ ID NO: 1349 - DNA, 20 bp, Chlamydia pneumoniae
cctagtagaggttgagtgaa

SEQ ID NO: 1350 - DNA, 20 bp, Chlamydia pneumoniae
agctccatacatcgaaggga

SEQ ID NO: 1351 - DNA, 20 bp, Chlamydia pneumoniae
tcgaactggcttccggagga

SEQ ID NO: 1352 - DNA, 20 bp, Chlamydia pneumoniae
ctgcagatctcggcaatatc

SEQ ID NO: 1353 - DNA, 20 bp, Chlamydia pneumoniae
cggaggaactctctattacc

SEQ ID NO: 1354 - DNA, 20 bp, Chlamydia pneumoniae
gccctctctttgtcttgctt

SEQ ID NO: 1355 - DNA, 20 bp, Chlamydia pneumoniae
gaggggcaattgcgattcta

SEQ ID NO: 1356 - DNA, 20 bp, Chlamydia pneumoniae
cgtatcaatgaggtcagtgc

SEQ ID NO: 1357 - DNA, 20 bp, Chlamydia pneumoniae
gcggttcctgtagggataaa

SEQ ID NO: 1358 - DNA, 20 bp, Chlamydia pneumoniae
gctcttcactcaaggagggg

SEQ ID NO: 1359 - DNA, 20 bp, Chlamydia pneumoniae
gttaagggaagctggggaaa

SEQ ID NO: 1360 - DNA, 20 bp, Chlamydia pneumoniae
gagacctcacctggatctat

SEQ ID NO: 1361 - DNA, 20 bp, Chlamydia pneumoniae
ggggaatcaggtcactacaa

SEQ ID NO: 1362 - DNA, 20 bp, Chlamydia pneumoniae
caggctttgacccacagtat

SEQ ID NO: 1363 - DNA, 20 bp, Chlamydia pneumoniae
gacacaggaggttcattctc

SEQ ID NO: 1364 - DNA, 20 bp, Chlamydia pneumoniae
tctgctcttcaagacctcgg

SEQ ID NO: 1365 - DNA, 20 bp, Chlamydia pneumoniae
gaaggtaacgaacggctcta

SEQ ID NO: 1366 - DNA, 20 bp, Chlamydia pneumoniae
gcggatctgaggagtggatg

SEQ ID NO: 1367 - DNA, 20 bp, Chlamydia pneumoniae
cggaggtagagatatatccc

SEQ ID NO: 1368 - DNA, 20 bp, Chlamydia pneumoniae
ggcgaatgtagctcagaaac

SEQ ID NO: 1369 - DNA, 20 bp, Chlamydia pneumoniae
ggatggggtctttggttttc

SEQ ID NO: 1370 - DNA, 20 bp, Chlamydia pneumoniae
cctctgtcgtgagagacaaa

SEQ ID NO: 1371 - DNA, 20 bp, Chlamydia pneumoniae
tcgggttgtggagagcaacc

SEQ ID NO: 1372 - DNA, 20 bp, Chlamydia pneumoniae
cgcaggatccccactttttt

SEQ ID NO: 1373 - DNA, 20 bp, Chlamydia pneumoniae
caaacgtcataagcgccaca

SEQ ID NO: 1374 - DNA, 20 bp, Chlamydia pneumoniae
gtatggcattcgatgtcacg

SEQ ID NO: 1375 - DNA, 20 bp, Chlamydia pneumoniae
gacctgcagtatagtctacc

SEQ ID NO: 1376 - DNA, 20 bp, Chlamydia pneumoniae
aggagcgaggttaccacgtt

SEQ ID NO: 1377 - DNA, 20 bp, Chlamydia pneumoniae
cccaatccattgttcccgat

SEQ ID NO: 1378 - DNA, 20 bp, Chlamydia pneumoniae
ccttgattgcgtgttcgtgt

SEQ ID NO: 1379 - DNA, 20 bp, Chlamydia pneumoniae
aagagctttgccctgttctc

SEQ ID NO: 1380 - DNA, 20 bp, Chlamydia pneumoniae
gcttgtttgatcggttgagg

SEQ ID NO: 1381 - DNA, 20 bp, Chlamydia pneumoniae
gctttaggaaggctagcttc

SEQ ID NO: 1382 - DNA, 20 bp, Chlamydia pneumoniae
gatagatcaacacgtacgtc

SEQ ID NO: 1383 - DNA, 20 bp, Chlamydia pneumoniae
ggtggaggagatgaagaatc

SEQ ID NO: 1384 - DNA, 20 bp, Chlamydia pneumoniae
gggtaaaaagagggagcgat

SEQ ID NO: 1385 - DNA, 20 bp, Chlamydia pneumoniae
ccctaagtaggtctgcagat

SEQ ID NO: 1386 - DNA, 20 bp, Chlamydia pneumoniae
cccgttcctcgcctgaaata

SEQ ID NO: 1387 - DNA, 20 bp, Chlamydia pneumoniae
ctccatgataactcgcacca

SEQ ID NO: 1388 - DNA, 20 bp, Chlamydia pneumoniae
ctccagaaactcctgtgatg

SEQ ID NO: 1389 - DNA, 20 bp, Chlamydia pneumoniae
ggtatattccgccgaagaag

SEQ ID NO: 1390 - DNA, 20 bp, Chlamydia pneumoniae
gacgcatgtacttctataag

SEQ ID NO: 1391 - DNA, 20 bp, Chlamydia pneumoniae
gagacgacttcgctaaaacc

SEQ ID NO: 1392 - DNA, 20 bp, Chlamydia pneumoniae
ggtaatgcatgcccagtgtt

SEQ ID NO: 1393 - DNA, 20 bp, Chlamydia pneumoniae
tggtgaaggagcttgaccaa

SEQ ID NO: 1394 - DNA, 20 bp, Chlamydia pneumoniae
gttcatgggaaaggtcgtgg

SEQ ID NO: 1395 - DNA, 20 bp, Chlamydia pneumoniae
cggtccagatcttggaattg

SEQ ID NO: 1396 - DNA, 20 bp, Chlamydia pneumoniae
gaccttgccagcttgggtcg

SEQ ID NO: 1397 - DNA, 20 bp, Chlamydia pneumoniae
gctgctaaatcccatcgctt

SEQ ID NO: 1398 - DNA, 20 bp, Chlamydia pneumoniae
gttttgtggctttggcagtg

SEQ ID NO: 1399 - DNA, 20 bp, Chlamydia pneumoniae
actttcctaagaagcgtagc

SEQ ID NO: 1400 - DNA, 20 bp, Chlamydia pneumoniae
gaggaatggcgcaggagtta

SEQ ID NO: 1401 - DNA, 20 bp, Chlamydia pneumoniae
gcagtgaaaacggaatccag

SEQ ID NO: 1402 - DNA, 20 bp, Chlamydia pneumoniae
gcgtggggattgtagggata

SEQ ID NO: 1403 - DNA, 20 bp, Chlamydia pneumoniae
ggccggggatcaatcagcta

SEQ ID NO: 1404 - DNA, 20 bp, Chlamydia pneumoniae
gaataagatgcaggcggaag

SEQ ID NO: 1405 - DNA, 20 bp, Chlamydia pneumoniae
gggagacgtttgtgcgtaaa

SEQ ID NO: 1406 - DNA, 20 bp, Chlamydia pneumoniae
cgtcctgcaggtgttattgt

SEQ ID NO: 1407 - DNA, 20 bp, Chlamydia pneumoniae
caaggggtgtagagaaagga

SEQ ID NO: 1408 - DNA, 20 bp, Chlamydia pneumoniae
gaagacaaaccttgtcctgg

SEQ ID NO: 1409 - DNA, 20 bp, Chlamydia pneumoniae
cgtactagggattgagcata

SEQ ID NO: 1410 - DNA, 20 bp, Chlamydia pneumoniae
gagtgtctgacgtttctgag

SEQ ID NO: 1411 - DNA, 20 bp, Chlamydia pneumoniae
ggaccgccattacgagaaat

SEQ ID NO: 1412 - DNA, 20 bp, Chlamydia pneumoniae
gagttgaactcctgccttga

SEQ ID NO: 1413 - DNA, 20 bp, Chlamydia pneumoniae
atcagatcgaagagctccag

SEQ ID NO: 1414 - DNA, 20 bp, Chlamydia pneumoniae
ggtctaagcacgtaggttgt

SEQ ID NO: 1415 - DNA, 20 bp, Chlamydia pneumoniae
gggatggccttaggtaaagt

SEQ ID NO: 1416 - DNA, 20 bp, Chlamydia pneumoniae
ctgagagctgaacttgcttg

SEQ ID NO: 1417 - DNA, 20 bp, Chlamydia pneumoniae
ctttggaacatcgcaaagcg

SEQ ID NO: 1418 - DNA, 20 bp, Chlamydia pneumoniae
cttggtagggttgtagagtc

SEQ ID NO: 1419 - DNA, 20 bp, Chlamydia pneumoniae
gagttgaactcctgccttga

SEQ ID NO: 1420 - DNA, 20 bp, Chlamydia pneumoniae
ggcatgtttatagtgtggcg

SEQ ID NO: 1421 - DNA, 20 bp, Chlamydia pneumoniae
atgtgacaggtgctacccca

SEQ ID NO: 1422 - DNA, 20 bp, Chlamydia pneumoniae
gagaatcagaggcaagtcca

SEQ ID NO: 1423 - DNA, 20 bp, Chlamydia pneumoniae
gaaggcttccttagtgagca

SEQ ID NO: 1424 - DNA, 20 bp, Chlamydia pneumoniae
cagcgagttgcagcatttga

SEQ ID NO: 1425 - DNA, 20 bp, Chlamydia pneumoniae
tcgcatgtttaggaccgctg

SEQ ID NO: 1426 - DNA, 20 bp, Chlamydia pneumoniae
ttcctgaggccccagaagag

SEQ ID NO: 1427 - DNA, 20 bp, Chlamydia pneumoniae
gcatgtttaggaccgctgaa

SEQ ID NO: 1428 - DNA, 20 bp, Chlamydia pneumoniae
ccatactctctgatgcagcg

SEQ ID NO: 1429 - DNA, 20 bp, Chlamydia pneumoniae
ggctcttagagaaaccgagt

SEQ ID NO: 1430 - DNA, 20 bp, Chlamydia pneumoniae
ctcggcaacgagttcaagaa

SEQ ID NO: 1431 - DNA, 20 bp, Chlamydia pneumoniae
ggatatccagcacgtgctct

SEQ ID NO: 1432 - DNA, 20 bp, Chlamydia pneumoniae
gttgtggctcaagaaggaca

SEQ ID NO: 1433 - DNA, 20 bp, Chlamydia pneumoniae
gcgtgtgaaagaagctgaag

SEQ ID NO: 1434 - DNA, 20 bp, Chlamydia pneumoniae
cagctgaaggctttcatttg

SEQ ID NO: 1435 - DNA, 20 bp, Chlamydia pneumoniae
gcggagttgtgtgggtattt

SEQ ID NO: 1436 - DNA, 20 bp, Chlamydia pneumoniae
gcaacaaaggcgaaatggca

SEQ ID NO: 1437 - DNA, 20 bp, Chlamydia pneumoniae
cctatctatcttacccaccg

SEQ ID NO: 1438 - DNA, 20 bp, Chlamydia pneumoniae
gggaagcatcatcctactat

SEQ ID NO: 1439 - DNA, 20 bp, Chlamydia pneumoniae
gtgcagatagcctctattgc

SEQ ID NO: 1440 - DNA, 20 bp, Chlamydia pneumoniae
ggcatcgacgccatcagtga

SEQ ID NO: 1441 - DNA, 20 bp, Chlamydia pneumoniae
gtggcgtttgatttccagca

SEQ ID NO: 1442 - DNA, 20 bp, Chlamydia pneumoniae
gattttgtcacgtggccgat

SEQ ID NO: 1443 - DNA, 20 bp, Chlamydia pneumoniae
ggagatagcctaagttagcc

SEQ ID NO: 1444 - DNA, 20 bp, Chlamydia pneumoniae
cgaacaacccctcctccaag

SEQ ID NO: 1445 - DNA, 20 bp, Chlamydia pneumoniae
ggggttttgagaagaaaacc

SEQ ID NO: 1446 - DNA, 20 bp, Chlamydia pneumoniae
gagcagtagctccacattga

SEQ ID NO: 1447 - DNA, 20 bp, Chlamydia pneumoniae
cttaaactcgcagctttcgc

SEQ ID NO: 1448 - DNA, 20 bp, Chlamydia pneumoniae
ccaaggacagcatctcctaa

SEQ ID NO: 1449 - DNA, 20 bp, Chlamydia pneumoniae
acaggggtcagagtaacaga

SEQ ID NO: 1450 - DNA, 20 bp, Chlamydia pneumoniae
ccccgcttgctttcaatact

SEQ ID NO: 1451 - DNA, 20 bp, Chlamydia pneumoniae
cagagtttagcgtggggtta

SEQ ID NO: 1452 - DNA, 20 bp, Chlamydia pneumoniae
gagcgcgttaccgataaaga

SEQ ID NO: 1453 - DNA, 20 bp, Chlamydia pneumoniae
cggctttgagtgatcaagtg

SEQ ID NO: 1454 - DNA, 20 bp, Chlamydia pneumoniae
aaactccctctgcttggcgt

SEQ ID NO: 1455 - DNA, 20 bp, Chlamydia pneumoniae
agagattgttgccgcctgta

SEQ ID NO: 1456 - DNA, 20 bp, Chlamydia pneumoniae
ccccgaaggcttcaaaaatc

SEQ ID NO: 1457 - DNA, 20 bp, Chlamydia pneumoniae
cagggaaataccaagtagag

SEQ ID NO: 1458 - DNA, 20 bp, Chlamydia pneumoniae
gcgggaaaagtaaagctcct

SEQ ID NO: 1459 - DNA, 20 bp, Chlamydia pneumoniae
ccctcaggaacagaacctaa

SEQ ID NO: 1460 - DNA, 20 bp, Chlamydia pneumoniae
ctcggagcggtttggcttta

SEQ ID NO: 1461 - DNA, 20 bp, Chlamydia pneumoniae
gagtacttgctttcctagca

SEQ ID NO: 1462 - DNA, 20 bp, Chlamydia pneumoniae
tgctataggcatccatacgc

SEQ ID NO: 1463 - DNA, 20 bp, Chlamydia pneumoniae
tccctctgcttggcgtggat

SEQ ID NO: 1464 - DNA, 20 bp, Chlamydia pneumoniae
ggctctagatggaaaacctg

SEQ ID NO: 1465 - DNA, 20 bp, Chlamydia pneumoniae
gcgcacgtatgcaggaatct

SEQ ID NO: 1466 - DNA, 20 bp, Chlamydia pneumoniae
caccctacacttgacctatg

SEQ ID NO: 1467 - DNA, 20 bp, Chlamydia pneumoniae
gaatgggagtcccaaactca

SEQ ID NO: 1468 - DNA, 20 bp, Chlamydia pneumoniae
tttgggcgagtccgttcgta

SEQ ID NO: 1469 - DNA, 20 bp, Chlamydia pneumoniae
gagagagaaaaagcaacctc

SEQ ID NO: 1470 - DNA, 20 bp, Chlamydia pneumoniae
gcctcaggaataggattctc

SEQ ID NO: 1471 - DNA, 20 bp, Chlamydia pneumoniae
ggagtcgtagacctaaggta

SEQ ID NO: 1472 - DNA, 20 bp, Chlamydia pneumoniae
gataccgaaatgcccctgta

SEQ ID NO: 1473 - DNA, 20 bp, Chlamydia pneumoniae
aggctgcatccggattctat

SEQ ID NO: 1474 - DNA, 20 bp, Chlamydia pneumoniae
gttgcctgatgtaacctcag

SEQ ID NO: 1475 - DNA, 20 bp, Chlamydia pneumoniae
gtgacaggggattggacgac

SEQ ID NO: 1476 - DNA, 20 bp, Chlamydia pneumoniae
ctcaagatcaattttggggc

SEQ ID NO: 1477 - DNA, 20 bp, Chlamydia pneumoniae
gcccccccttaatatcagta

SEQ ID NO: 1478 - DNA, 20 bp, Chlamydia pneumoniae
caataggttgtgaaaggaga

SEQ ID NO: 1479 - DNA, 20 bp, Chlamydia pneumoniae
ctgattgtcactctgggatg

SEQ ID NO: 1480 - DNA, 20 bp, Chlamydia pneumoniae
gacgggtcacttatacgcat

SEQ ID NO: 1481 - DNA, 20 bp, Chlamydia pneumoniae
gttactatgctcgtctagcc

SEQ ID NO: 1482 - DNA, 20 bp, Chlamydia pneumoniae
gtaggtgcgtgactgattag

SEQ ID NO: 1483 - DNA, 20 bp, Chlamydia pneumoniae
ccgccaccaggatattttga

SEQ ID NO: 1484 - DNA, 20 bp, Chlamydia pneumoniae
ggcgattcctgaagacacta

SEQ ID NO: 1485 - DNA, 20 bp, Chlamydia pneumoniae
ggctctctccgactgtctat

SEQ ID NO: 1486 - DNA, 20 bp, Chlamydia pneumoniae
gggttgtctacagacatcgt

SEQ ID NO: 1487 - DNA, 20 bp, Chlamydia pneumoniae
cgcatgtacagagattctcc

SEQ ID NO: 1488 - DNA, 20 bp, Chlamydia pneumoniae
gctcattggaacagttgctc

SEQ ID NO: 1489 - DNA, 20 bp, Chlamydia pneumoniae
cgatctagaagagctcagtc

SEQ ID NO: 1490 - DNA, 20 bp, Chlamydia pneumoniae
ccttcgcacccgtagattta

SEQ ID NO: 1491 - DNA, 20 bp, Chlamydia pneumoniae
cgcaaggttttgtgaaaggg

SEQ ID NO: 1492 - DNA, 20 bp, Chlamydia pneumoniae
ttatcggcacggtttccgaa

SEQ ID NO: 1493 - DNA, 20 bp, Chlamydia pneumoniae
attacacgcgcgctatcagg

SEQ ID NO: 1494 - DNA, 20 bp, Chlamydia pneumoniae
agcctccagtctcctcttta

SEQ ID NO: 1495 - DNA, 20 bp, Chlamydia pneumoniae
cgtggttctgctttgaaagc

SEQ ID NO: 1496 - DNA, 20 bp, Chlamydia pneumoniae
gaccgcgcaggcgtatgtaa

SEQ ID NO: 1497 - DNA, 20 bp, Chlamydia pneumoniae
ccttcgcacccgtagattta

SEQ ID NO: 1498 - DNA, 20 bp, Chlamydia pneumoniae
ggatggacaatgcgtctctg

SEQ ID NO: 1499 - DNA, 20 bp, Chlamydia pneumoniae
gtacagcaggtatagtcgag

SEQ ID NO: 1500 - DNA, 20 bp, Chlamydia pneumoniae
gtcgttagggaagtaactgg

SEQ ID NO: 1501 - DNA, 20 bp, Chlamydia pneumoniae
aggtgctgctggagtcaata

SEQ ID NO: 1502 - DNA, 20 bp, Chlamydia pneumoniae
ggctctagaagcatatgggg

SEQ ID NO: 1503 - DNA, 20 bp, Chlamydia pneumoniae
catgacagccgatgttgaag

SEQ ID NO: 1504 - DNA, 20 bp, Chlamydia pneumoniae
tattactggcggtttgcctc

SEQ ID NO: 1505 - DNA, 20 bp, Chlamydia pneumoniae
agcctgtggctattccttcg

SEQ ID NO: 1506 - DNA, 20 bp, Chlamydia pneumoniae
cagatgcagcttgttgtagc

SEQ ID NO: 1507 - DNA, 20 bp, Chlamydia pneumoniae
gtagcaagcataaccccttg

SEQ ID NO: 1508 - DNA, 20 bp, Chlamydia pneumoniae
gctgctggatgagctaaaga

SEQ ID NO: 1509 - DNA, 20 bp, Chlamydia pneumoniae
ggttgagggaatctctacag

SEQ ID NO: 1510 - DNA, 20 bp, Chlamydia pneumoniae
cgtcagtttgtagcactatg

SEQ ID NO: 1511 - DNA, 20 bp, Chlamydia pneumoniae
caacgtggagatagtgtgat

SEQ ID NO: 1512 - DNA, 20 bp, Chlamydia pneumoniae
ggatctagaagaaggcctac

SEQ ID NO: 1513 - DNA, 20 bp, Chlamydia pneumoniae
ggaaggtattcgagctgttg

SEQ ID NO: 1514 - DNA, 20 bp, Chlamydia pneumoniae
catgtgagtcctagagctgt

SEQ ID NO: 1515 - DNA, 20 bp, Chlamydia pneumoniae
cccttgttgttgcaaaggca

SEQ ID NO: 1516 - DNA, 20 bp, Chlamydia pneumoniae
cagggcgttttggatgacta

SEQ ID NO: 1517 - DNA, 20 bp, Chlamydia pneumoniae
gagagcgagggttttttctc

SEQ ID NO: 1518 - DNA, 20 bp, Chlamydia pneumoniae
tcgccagatgggactagata

SEQ ID NO: 1519 - DNA, 20 bp, Chlamydia pneumoniae
gttcctcagctcttcttgag

SEQ ID NO: 1520 - DNA, 20 bp, Chlamydia pneumoniae
cctgtggactgttattgtcc

SEQ ID NO: 1521 - DNA, 20 bp, Chlamydia pneumoniae
gattccgtgcaagagtcttg

SEQ ID NO: 1522 - DNA, 20 bp, Chlamydia pneumoniae
gtctttatgcggattcccgt

SEQ ID NO: 1523 - DNA, 20 bp, Chlamydia pneumoniae
cccgagagtcttcgatctat

SEQ ID NO: 1524 - DNA, 20 bp, Chlamydia pneumoniae
aagtcatggccgaagtctcg

SEQ ID NO: 1525 - DNA, 20 bp, Chlamydia pneumoniae
cctgtggactgttattgtcc

SEQ ID NO: 1526 - DNA, 20 bp, Chlamydia pneumoniae
ggaggagtgattcatggact

SEQ ID NO: 1527 - DNA, 20 bp, Chlamydia pneumoniae
catcaccgatgtaggtcaag

SEQ ID NO: 1528 - DNA, 20 bp, Chlamydia pneumoniae
gagtcgcttcacatgcagta

SEQ ID NO: 1529 - DNA, 20 bp, Chlamydia pneumoniae
gtctccgaggtccttacttt

SEQ ID NO: 1530 - DNA, 20 bp, Chlamydia pneumoniae
ccgttgcgttatgtagcggg

SEQ ID NO: 1531 - DNA, 20 bp, Chlamydia pneumoniae
gcttttgtgctcttcttctc

SEQ ID NO: 1532 - DNA, 20 bp, Chlamydia pneumoniae
tgatactatacgcctgggga

SEQ ID NO: 1533 - DNA, 20 bp, Chlamydia pneumoniae
acactgggatcgcagtgtct

SEQ ID NO: 1534 - DNA, 20 bp, Chlamydia pneumoniae
gatcgcattttccctgcttc

SEQ ID NO: 1535 - DNA, 20 bp, Chlamydia pneumoniae
gacggtcagagaattccaag

SEQ ID NO: 1536 - DNA, 20 bp, Chlamydia pneumoniae
gaacgatttcctcggagtta

SEQ ID NO: 1537 - DNA, 20 bp, Chlamydia pneumoniae
cagagactcctgtaactccg

SEQ ID NO: 1538 - DNA, 20 bp, Chlamydia pneumoniae
gcatagaacagggcattctc

SEQ ID NO: 1539 - DNA, 20 bp, Chlamydia pneumoniae
gagaagagcaaggtgcgaaa

SEQ ID NO: 1540 - DNA, 20 bp, Chlamydia pneumoniae
gctaagtttgtgagggctgt

SEQ ID NO: 1541 - DNA, 20 bp, Chlamydia pneumoniae
gcaacgcagatgctagaatc

SEQ ID NO: 1542 - DNA, 20 bp, Chlamydia pneumoniae
gctaagtttgtgagggctgt

SEQ ID NO: 1543 - DNA, 20 bp, Chlamydia pneumoniae
cacgagctgaagtctctgat

SEQ ID NO: 1544 - DNA, 20 bp, Chlamydia pneumoniae
cagaagctccaagcactcca

SEQ ID NO: 1545 - DNA, 20 bp, Chlamydia pneumoniae
ccgtgactccaagcacttct

SEQ ID NO: 1546 - DNA, 20 bp, Chlamydia pneumoniae
cggaggtcttgaacggtatt

SEQ ID NO: 1547 - DNA, 20 bp, Chlamydia pneumoniae
caaaggcgattccaggatag

SEQ ID NO: 1548 - DNA, 20 bp, Chlamydia pneumoniae
ctcgggtgccccagaaaaat

SEQ ID NO: 1549 - DNA, 20 bp, Chlamydia pneumoniae
ccgtctgctgtaaaaagtgc

SEQ ID NO: 1550 - DNA, 20 bp, Chlamydia pneumoniae
tgggaagacaaccttgggta

SEQ ID NO: 1551 - DNA, 20 bp, Chlamydia pneumoniae
ggaaagctgcgtcgtatcat

SEQ ID NO: 1552 - DNA, 20 bp, Chlamydia pneumoniae
ggccttcctttcatcattac

SEQ ID NO: 1553 - DNA, 20 bp, Chlamydia pneumoniae
ggagctcatatgagtgcctt

SEQ ID NO: 1554 - DNA, 20 bp, Chlamydia pneumoniae
tcgtctaaccgttggttgaa

SEQ ID NO: 1555 - DNA, 20 bp, Chlamydia pneumoniae
tagttgccagtgcgtttgct

SEQ ID NO: 1556 - DNA, 20 bp, Chlamydia pneumoniae
cagcatagggttttgattgc

SEQ ID NO: 1557 - DNA, 20 bp, Chlamydia pneumoniae
ttgctgcatactggcccaga

SEQ ID NO: 1558 - DNA, 20 bp, Chlamydia pneumoniae
cctcactccccatgaaatca

SEQ ID NO: 1559 - DNA, 20 bp, Chlamydia pneumoniae
tctggtctgggtaaaagcgt

SEQ ID NO: 1560 - DNA, 20 bp, Chlamydia pneumoniae
cgcgtagatcccagaagaaa

SEQ ID NO: 1561 - DNA, 20 bp, Chlamydia pneumoniae
gcagagatgaatgggggaat

SEQ ID NO: 1562 - DNA, 20 bp, Chlamydia pneumoniae
ctggtggccatgggaacggc

SEQ ID NO: 1563 - DNA, 20 bp, Chlamydia pneumoniae
catctatgatccagaagccc

SEQ ID NO: 1564 - DNA, 20 bp, Chlamydia pneumoniae
ccaacgccctccgcatgcaa

SEQ ID NO: 1565 - DNA, 20 bp, Chlamydia pneumoniae
gtatccatctcatgcggact

SEQ ID NO: 1566 - DNA, 20 bp, Chlamydia pneumoniae
ctgaccgcatcgcattaaga

SEQ ID NO: 1567 - DNA, 20 bp, Chlamydia pneumoniae
ctgtagatgctcacggaagt

SEQ ID NO: 1568 - DNA, 20 bp, Chlamydia pneumoniae
gcggaggatatgacgacttt

SEQ ID NO: 1569 - DNA, 20 bp, Chlamydia pneumoniae
ggacatgcaacgcaaattga

SEQ ID NO: 1570 - DNA, 20 bp, Chlamydia pneumoniae
gttctttgagaccctcgact

SEQ ID NO: 1571 - DNA, 20 bp, Chlamydia pneumoniae
cgcacatccttgagcaacaa

SEQ ID NO: 1572 - DNA, 20 bp, Chlamydia pneumoniae
cactacctgctgctaaagga

SEQ ID NO: 1573 - DNA, 20 bp, Chlamydia pneumoniae
ggtcttcccatgcaacgttt

SEQ ID NO: 1574 - DNA, 20 bp, Chlamydia pneumoniae
cttaaagcccggattcgtga

SEQ ID NO: 1575 - DNA, 20 bp, Chlamydia pneumoniae
ggagctggagataaaggaag

SEQ ID NO: 1576 - DNA, 20 bp, Chlamydia pneumoniae
gtatcgcccaagaattgcct

SEQ ID NO: 1577 - DNA, 20 bp, Chlamydia pneumoniae
caagcccgagaatgggtttt

SEQ ID NO: 1578 - DNA, 20 bp, Chlamydia pneumoniae
aagaacggaggcgattatcc

SEQ ID NO: 1579 - DNA, 20 bp, Chlamydia pneumoniae
gcgaagccctgtatattctc

SEQ ID NO: 1580 - DNA, 20 bp, Chlamydia pneumoniae
ggtacgatccacatagctct

SEQ ID NO: 1581 - DNA, 20 bp, Chlamydia pneumoniae
gccgtcgcaaatgaaaatgc

SEQ ID NO: 1582 - DNA, 20 bp, Chlamydia pneumoniae
gctgctgcttcgcatttgat

SEQ ID NO: 1583 - DNA, 20 bp, Chlamydia pneumoniae
gctctcttggatgccgatgt

SEQ ID NO: 1584 - DNA, 20 bp, Chlamydia pneumoniae
cgagaagttcaagctgagaa

SEQ ID NO: 1585 - DNA, 20 bp, Chlamydia pneumoniae
gtagctatggggcaagatgt

SEQ ID NO: 1586 - DNA, 20 bp, Chlamydia pneumoniae
ggtgaaggcatggaaaagag

SEQ ID NO: 1587 - DNA, 20 bp, Chlamydia pneumoniae
gaggcgattatcctgtccat

SEQ ID NO: 1588 - DNA, 20 bp, Chlamydia pneumoniae
cccatgacattccttgtaag

SEQ ID NO: 1589 - DNA, 20 bp, Chlamydia pneumoniae
gatggtccattgcaaacgag

SEQ ID NO: 1590 - DNA, 20 bp, Chlamydia pneumoniae
ctcggatgcctagtgtatct

SEQ ID NO: 1591 - DNA, 20 bp, Chlamydia pneumoniae
gagcaaagtgagcgtagaac

SEQ ID NO: 1592 - DNA, 20 bp, Chlamydia pneumoniae
gcctagtgaactacgcgatt

SEQ ID NO: 1593 - DNA, 20 bp, Chlamydia pneumoniae
gcatgcgaagaggacttttg

SEQ ID NO: 1594 - DNA, 20 bp, Chlamydia pneumoniae
ggatacgatgtatgctaggg

SEQ ID NO: 1595 - DNA, 20 bp, Chlamydia pneumoniae
gctagcagctgcaaatcagt

SEQ ID NO: 1596 - DNA, 20 bp, Chlamydia pneumoniae
cgtttagcggcttttcctgt

SEQ ID NO: 1597 - DNA, 20 bp, Chlamydia pneumoniae
cggtgtagagtatgtccagt

SEQ ID NO: 1598 - DNA, 20 bp, Chlamydia pneumoniae
aaactgggatagggattgcc

SEQ ID NO: 1599 - DNA, 20 bp, Chlamydia pneumoniae
gagttccccttcatttaccc

SEQ ID NO: 1600 - DNA, 20 bp, Chlamydia pneumoniae
ctgctgcagaagatgctttg

SEQ ID NO: 1601 - DNA, 20 bp, Chlamydia pneumoniae
ccgcagattttctccataga

SEQ ID NO: 1602 - DNA, 20 bp, Chlamydia pneumoniae
cgttgtcgatgacagctact

SEQ ID NO: 1603 - DNA, 20 bp, Chlamydia pneumoniae
ccttaggattgggctgtggt

SEQ ID NO: 1604 - DNA, 20 bp, Chlamydia pneumoniae
cgctttctgaagctgagtct

SEQ ID NO: 1605 - DNA, 20 bp, Chlamydia pneumoniae
gcgcaagaggaggttacaaa

SEQ ID NO: 1606 - DNA, 20 bp, Chlamydia pneumoniae
gtttgttgcgtcagtggaag

SEQ ID NO: 1607 - DNA, 20 bp, Chlamydia pneumoniae
cttgcatctttgacgcgtga

SEQ ID NO: 1608 - DNA, 20 bp, Chlamydia pneumoniae
gtagtgcgaaaccgcctttt

SEQ ID NO: 1609 - DNA, 20 bp, Chlamydia pneumoniae
gaagatgcaagtgaacggct

SEQ ID NO: 1610 - DNA, 20 bp, Chlamydia pneumoniae
cttccgaagagaactaggca

SEQ ID NO: 1611 - DNA, 20 bp, Chlamydia pneumoniae
gaggaagaggagcatcatct

SEQ ID NO: 1612 - DNA, 20 bp, Chlamydia pneumoniae
ccccagtataggcaggcaac

SEQ ID NO: 1613 - DNA, 20 bp, Chlamydia pneumoniae
gcaatgagcaagagcttagg

SEQ ID NO: 1614 - DNA, 20 bp, Chlamydia pneumoniae
agcctgcgagcatagtgtct

SEQ ID NO: 1615 - DNA, 20 bp, Chlamydia pneumoniae
cttttacgggatccggtcta

SEQ ID NO: 1616 - DNA, 20 bp, Chlamydia pneumoniae
cagcagttgagcgggttttt

SEQ ID NO: 1617 - DNA, 20 bp, Chlamydia pneumoniae
gtagtgagggtgtttctcct

SEQ ID NO: 1618 - DNA, 20 bp, Chlamydia pneumoniae
cttcacaagctgcggttcta

SEQ ID NO: 1619 - DNA, 20 bp, Chlamydia pneumoniae
tcgaactcggtgataagctg

SEQ ID NO: 1620 - DNA, 20 bp, Chlamydia pneumoniae
cgctacttgagacaaaggga

SEQ ID NO: 1621 - DNA, 20 bp, Chlamydia pneumoniae
cttcctgtgttaaggctatc

SEQ ID NO: 1622 - DNA, 20 bp, Chlamydia pneumoniae
atctccttggaagacgtagc

SEQ ID NO: 1623 - DNA, 20 bp, Chlamydia pneumoniae
agcacggtaaggggattcag

SEQ ID NO: 1624 - DNA, 20 bp, Chlamydia pneumoniae
acttgctgagaatgatgtgc

SEQ ID NO: 1625 - DNA, 20 bp, Chlamydia pneumoniae
cggaacagcttttactccct

SEQ ID NO: 1626 - DNA, 20 bp, Chlamydia pneumoniae
cggttagatagccattgctc

SEQ ID NO: 1627 - DNA, 20 bp, Chlamydia pneumoniae
cgctacttgagacaaaggga

SEQ ID NO: 1628 - DNA, 20 bp, Chlamydia pneumoniae
gagcgcccatgttttcatgt

SEQ ID NO: 1629 - DNA, 20 bp, Chlamydia pneumoniae
cgtaggggaatatggtgaag

SEQ ID NO: 1630 - DNA, 20 bp, Chlamydia pneumoniae
ggtaagatgattcctccacg

SEQ ID NO: 1631 - DNA, 20 bp, Chlamydia pneumoniae
gagacctcatggaaaattgt

SEQ ID NO: 1632 - DNA, 20 bp, Chlamydia pneumoniae
gggagaacgatcttttccag

SEQ ID NO: 1633 - DNA, 20 bp, Chlamydia pneumoniae
gtggcttcttcttcttccct

SEQ ID NO: 1634 - DNA, 20 bp, Chlamydia pneumoniae
gggttgtaattcggcgtatc

SEQ ID NO: 1635 - DNA, 20 bp, Chlamydia pneumoniae
gggatgttatgttggaatag

SEQ ID NO: 1636 - DNA, 20 bp, Chlamydia pneumoniae
cgtccgtgagtatctaggaa

SEQ ID NO: 1637 - DNA, 20 bp, Chlamydia pneumoniae
gtggtaggcaatgagttgga

SEQ ID NO: 1638 - DNA, 20 bp, Chlamydia pneumoniae
gagatttcaaatcccagggt

SEQ ID NO: 1639 - DNA, 20 bp, Chlamydia pneumoniae
gaaaccatccgcagatgaga

SEQ ID NO: 1640 - DNA, 20 bp, Chlamydia pneumoniae
cacttggatatcgaaacctg

SEQ ID NO: 1641 - DNA, 20 bp, Chlamydia pneumoniae
ccttgagatcggatttcctc

SEQ ID NO: 1642 - DNA, 20 bp, Chlamydia pneumoniae
ggtaggagttgggggaaaaa

SEQ ID NO: 1643 - DNA, 20 bp, Chlamydia pneumoniae
cgaagcgtttgcagagttct

SEQ ID NO: 1644 - DNA, 20 bp, Chlamydia pneumoniae
gggtaggaacggatcttttg

SEQ ID NO: 1645 - DNA, 20 bp, Chlamydia pneumoniae
ggctagaaaaagccgtgagt

SEQ ID NO: 1646 - DNA, 20 bp, Chlamydia pneumoniae
gatgccactctatagtcacg

SEQ ID NO: 1647 - DNA, 20 bp, Chlamydia pneumoniae
ccacagcgctactactatgt

SEQ ID NO: 1648 - DNA, 20 bp, Chlamydia pneumoniae
cttgctttctaaggctttgc

SEQ ID NO: 1649 - DNA, 20 bp, Chlamydia pneumoniae
gggtgtagggaaaactgcta

SEQ ID NO: 1650 - DNA, 20 bp, Chlamydia pneumoniae
caggaagactgccagaagtt

SEQ ID NO: 1651 - DNA, 20 bp, Chlamydia pneumoniae
acagagggggctttgaatgc

SEQ ID NO: 1652 - DNA, 20 bp, Chlamydia pneumoniae
catatccaaagtggctcctc

SEQ ID NO: 1653 - DNA, 20 bp, Chlamydia pneumoniae
cccgccctttaaaacgtttg

SEQ ID NO: 1654 - DNA, 20 bp, Chlamydia pneumoniae
tctccaagagcgtcaacgcc

SEQ ID NO: 1655 - DNA, 20 bp, Chlamydia pneumoniae
cgtggcttttctcctgaaga

SEQ ID NO: 1656 - DNA, 20 bp, Chlamydia pneumoniae
agcgtcaacgccatcttgcc

SEQ ID NO: 1657 - DNA, 20 bp, Chlamydia pneumoniae
cgtggcttttctcctgaaga

SEQ ID NO: 1658 - DNA, 20 bp, Chlamydia pneumoniae
gcaggagaagccggtcgcgg

SEQ ID NO: 1659 - DNA, 20 bp, Chlamydia pneumoniae
ggtgcgtactcctgaagaaa

SEQ ID NO: 1660 - DNA, 20 bp, Chlamydia pneumoniae
cctgtgacgaacgaacagtt

SEQ ID NO: 1661 - DNA, 20 bp, Chlamydia pneumoniae
agcatgggggaccaatggct

SEQ ID NO: 1662 - DNA, 20 bp, Chlamydia pneumoniae
gtgccaagattggtatgggt

SEQ ID NO: 1663 - DNA, 20 bp, Chlamydia pneumoniae
gtggtgttgcaggagaagcc

SEQ ID NO: 1664 - DNA, 20 bp, Chlamydia pneumoniae
ctgctatccggaattgtggg

SEQ ID NO: 1665 - DNA, 20 bp, Chlamydia pneumoniae
catcgtaataatcctggggc

SEQ ID NO: 1666 - DNA, 20 bp, Chlamydia pneumoniae
ggcgaagaaagctatagacc

SEQ ID NO: 1667 - DNA, 20 bp, Chlamydia pneumoniae
ggtggagaggtgattccaaa

SEQ ID NO: 1668 - DNA, 20 bp, Chlamydia pneumoniae
gcagaaagaactgttgggtc

SEQ ID NO: 1669 - DNA, 20 bp, Chlamydia pneumoniae
ctaagagcaaggagtttgag

SEQ ID NO: 1670 - DNA, 20 bp, Chlamydia pneumoniae
gccaaaatgagacctgtagg

SEQ ID NO: 1671 - DNA, 20 bp, Chlamydia pneumoniae
ggacgacttaaggaatcaag

SEQ ID NO: 1672 - DNA, 20 bp, Chlamydia pneumoniae
gaagcccctatagctactga

SEQ ID NO: 1673 - DNA, 20 bp, Chlamydia pneumoniae
gagtattagagaggctacct

SEQ ID NO: 1674 - DNA, 20 bp, Chlamydia pneumoniae
gtctgggcaagaagctaaag

SEQ ID NO: 1675 - DNA, 20 bp, Chlamydia pneumoniae
caattggagcccatacactc

SEQ ID NO: 1676 - DNA, 20 bp, Chlamydia pneumoniae
ggaacgtggatctcaacttg

SEQ ID NO: 1677 - DNA, 20 bp, Chlamydia pneumoniae
gcccctatagctactgaaaa

SEQ ID NO: 1678 - DNA, 20 bp, Chlamydia pneumoniae
agcagcatggcctcaaatag

SEQ ID NO: 1679 - DNA, 20 bp, Chlamydia pneumoniae
ctccgctatgggattttcgt

SEQ ID NO: 1680 - DNA, 20 bp, Chlamydia pneumoniae
aaagtacgtcctgatgcctt

SEQ ID NO: 1681 - DNA, 20 bp, Chlamydia pneumoniae
tgggaaacccaccagggatt

SEQ ID NO: 1682 - DNA, 20 bp, Chlamydia pneumoniae
ccaggttcctcactaagaac

SEQ ID NO: 1683 - DNA, 20 bp, Chlamydia pneumoniae
ggtggcaagccaagtgttta

SEQ ID NO: 1684 - DNA, 20 bp, Chlamydia pneumoniae
acgaagcttgccaattaggg

SEQ ID NO: 1685 - DNA, 20 bp, Chlamydia pneumoniae
ggttgcacattccttatggg

SEQ ID NO: 1686 - DNA, 20 bp, Chlamydia pneumoniae
ccggtttcgagcttaaagag

SEQ ID NO: 1687 - DNA, 20 bp, Chlamydia pneumoniae
aggtggttagagcagcagaa

SEQ ID NO: 1688 - DNA, 20 bp, Chlamydia pneumoniae
ttcgggcagatgcctggaga

SEQ ID NO: 1689 - DNA, 20 bp, Chlamydia pneumoniae
gattgtggagttgcagctct

SEQ ID NO: 1690 - DNA, 20 bp, Chlamydia pneumoniae
cctcctgatagtaaaacccc

SEQ ID NO: 1691 - DNA, 20 bp, Chlamydia pneumoniae
ccagttctttaggcgtgtct

SEQ ID NO: 1692 - DNA, 20 bp, Chlamydia pneumoniae
ggtgcgctgctcatgctttt

SEQ ID NO: 1693 - DNA, 20 bp, Chlamydia pneumoniae
caagcagctcttctgtagca

SEQ ID NO: 1694 - DNA, 20 bp, Chlamydia pneumoniae
gaggggcaaattggaaacct

SEQ ID NO: 1695 - DNA, 20 bp, Chlamydia pneumoniae
taagaggcctgctgccccat

SEQ ID NO: 1696 - DNA, 20 bp, Chlamydia pneumoniae
gcacatactgaggagctctt

SEQ ID NO: 1697 - DNA, 20 bp, Chlamydia pneumoniae
gggagacgaagtttcttgga

SEQ ID NO: 1698 - DNA, 20 bp, Chlamydia pneumoniae
gttcgccgatttttccacct

SEQ ID NO: 1699 - DNA, 20 bp, Chlamydia pneumoniae
gcgagcctttcttggtctat

SEQ ID NO: 1700 - DNA, 20 bp, Chlamydia pneumoniae
gggctaatcttaggaagcgt

SEQ ID NO: 1701 - DNA, 20 bp, Chlamydia pneumoniae
gggttgataggaatcttccc

SEQ ID NO: 1702 - DNA, 20 bp, Chlamydia pneumoniae
gtcagtgtgtgtctatagag

SEQ ID NO: 1703 - DNA, 20 bp, Chlamydia pneumoniae
ggaataggcacatactgagg

SEQ ID NO: 1704 - DNA, 20 bp, Chlamydia pneumoniae
agtgggtgcgggagtcactc

SEQ ID NO: 1705 - DNA, 20 bp, Chlamydia pneumoniae
ccaaggtgtatctacatctg

SEQ ID NO: 1706 - DNA, 20 bp, Chlamydia pneumoniae
cggttgcagctaaacgttct

SEQ ID NO: 1707 - DNA, 20 bp, Chlamydia pneumoniae
gggggatttggtttggatct

SEQ ID NO: 1708 - DNA, 20 bp, Chlamydia pneumoniae
caaagccgtccttctcatct

SEQ ID NO: 1709 - DNA, 20 bp, Chlamydia pneumoniae
gattcgctatgctcaaggtc

SEQ ID NO: 1710 - DNA, 20 bp, Chlamydia pneumoniae
ggtctttcctcttgtttcca

SEQ ID NO: 1711 - DNA, 20 bp, Chlamydia pneumoniae
ccgtccttgtcttgcttttt

SEQ ID NO: 1712 - DNA, 20 bp, Chlamydia pneumoniae
gcgattgtattgagtcgtgg

SEQ ID NO: 1713 - DNA, 20 bp, Chlamydia pneumoniae
ccattgtttttggaacccag

SEQ ID NO: 1714 - DNA, 20 bp, Chlamydia pneumoniae
caggatctaaatgtggagcc

SEQ ID NO: 1715 - DNA, 20 bp, Chlamydia pneumoniae
cattgaacagcttcttgggc

SEQ ID NO: 1716 - DNA, 20 bp, Chlamydia pneumoniae
gcgtcaactccaatctcagc

SEQ ID NO: 1717 - DNA, 20 bp, Chlamydia pneumoniae
cgagtctttgatttacccct

SEQ ID NO: 1718 - DNA, 20 bp, Chlamydia pneumoniae
gcttcttccatgtatgctac

SEQ ID NO: 1719 - DNA, 20 bp, Chlamydia pneumoniae
acgtaagggctcgactaact

SEQ ID NO: 1720 - DNA, 20 bp, Chlamydia pneumoniae
ccggaaatacgctaaagtcc

SEQ ID NO: 1721 - DNA, 20 bp, Chlamydia pneumoniae
gatggatgggcgtatatcca

SEQ ID NO: 1722 - DNA, 20 bp, Chlamydia pneumoniae
ctctcaagccgaagaaagag

SEQ ID NO: 1723 - DNA, 20 bp, Chlamydia pneumoniae
ccatgccgcggtacctttta

SEQ ID NO: 1724 - DNA, 20 bp, Chlamydia pneumoniae
gcaatcacctcttgaagcag

SEQ ID NO: 1725 - DNA, 20 bp, Chlamydia pneumoniae
gcatgagctgtgtcaatgac

SEQ ID NO: 1726 - DNA, 20 bp, Chlamydia pneumoniae
ccgttctggagacgagatac

SEQ ID NO: 1727 - DNA, 20 bp, Chlamydia pneumoniae
tgaacttgctctcgacccca

SEQ ID NO: 1728 - DNA, 20 bp, Chlamydia pneumoniae
gaccctgccgttaccctagc

SEQ ID NO: 1729 - DNA, 20 bp, Chlamydia pneumoniae
ctgtagctgcagcaagttct

SEQ ID NO: 1730 - DNA, 20 bp, Chlamydia pneumoniae
cggtcttaccagctatatgg

SEQ ID NO: 1731 - DNA, 20 bp, Chlamydia pneumoniae
ggcccaaaaccagtccaaat

SEQ ID NO: 1732 - DNA, 20 bp, Chlamydia pneumoniae
gccggagagatctaaaagca

SEQ ID NO: 1733 - DNA, 20 bp, Chlamydia pneumoniae
acctcggtgaggttaggata

SEQ ID NO: 1734 - DNA, 20 bp, Chlamydia pneumoniae
gggcttgcacagctttttct

SEQ ID NO: 1735 - DNA, 20 bp, Chlamydia pneumoniae
gactcttcatcagtcttagc

SEQ ID NO: 1736 - DNA, 20 bp, Chlamydia pneumoniae
cagctcctgtgatctcacag

SEQ ID NO: 1737 - DNA, 20 bp, Chlamydia pneumoniae
caacaacccttggaacctca

SEQ ID NO: 1738 - DNA, 20 bp, Chlamydia pneumoniae
ttagggtccgttgggatagg

SEQ ID NO: 1739 - DNA, 20 bp, Chlamydia pneumoniae
gggcttgcacagctttttct

SEQ ID NO: 1740 - DNA, 20 bp, Chlamydia pneumoniae
gacagtcacacctgccttta

SEQ ID NO: 1741 - DNA, 20 bp, Chlamydia pneumoniae
gacctggagatggtgagaaa

SEQ ID NO: 1742 - DNA, 20 bp, Chlamydia pneumoniae
ggactactaccataatacag

SEQ ID NO: 1743 - DNA, 20 bp, Chlamydia pneumoniae
caggatccccattggtaatc

SEQ ID NO: 1744 - DNA, 20 bp, Chlamydia pneumoniae
ggactactaccataatacag

SEQ ID NO: 1745 - DNA, 20 bp, Chlamydia pneumoniae
caggatccccattggtaatc

SEQ ID NO: 1746 - DNA, 20 bp, Chlamydia pneumoniae
caaccatcttcacccgtaga

SEQ ID NO: 1747 - DNA, 20 bp, Chlamydia pneumoniae
ccgcttgaaccccacatttt

SEQ ID NO: 1748 - DNA, 20 bp, Chlamydia pneumoniae
gcgatcggtaaactctcatc

SEQ ID NO: 1749 - DNA, 20 bp, Chlamydia pneumoniae
ggactactaccataatacag

SEQ ID NO: 1750 - DNA, 20 bp, Chlamydia pneumoniae
cctctcctttcactttcctc

SEQ ID NO: 1751 - DNA, 20 bp, Chlamydia pneumoniae
cgactccaggtattcctaca

SEQ ID NO: 1752 - DNA, 20 bp, Chlamydia pneumoniae
ggtgaggtctctcaatgtct

SEQ ID NO: 1753 - DNA, 20 bp, Chlamydia pneumoniae
cactagaaccctacctatgc

SEQ ID NO: 1754 - DNA, 20 bp, Chlamydia pneumoniae
cctgatgtcagtatttccgc

SEQ ID NO: 1755 - DNA, 20 bp, Chlamydia pneumoniae
ggcagaaaacctttgtcgaa

SEQ ID NO: 1756 - DNA, 20 bp, Chlamydia pneumoniae
ccatgtctggagcatggaaa

SEQ ID NO: 1757 - DNA, 20 bp, Chlamydia pneumoniae
ttcacttatggcgccctcgt

SEQ ID NO: 1758 - DNA, 20 bp, Chlamydia pneumoniae
gttcctctggagacttgaac

SEQ ID NO: 1759 - DNA, 20 bp, Chlamydia pneumoniae
cagcattgtcttgggattcc

SEQ ID NO: 1760 - DNA, 20 bp, Chlamydia pneumoniae
gcttacgctagaatcgctct

SEQ ID NO: 1761 - DNA, 20 bp, Chlamydia pneumoniae
ccatgtctggagcatggaaa

SEQ ID NO: 1762 - DNA, 20 bp, Chlamydia pneumoniae
ggacaaacaatgcttgcagg

SEQ ID NO: 1763 - DNA, 20 bp, Chlamydia pneumoniae
taatcccctcttagcagggg

SEQ ID NO: 1764 - DNA, 20 bp, Chlamydia pneumoniae
gtggatgggtgcaatttcct

SEQ ID NO: 1765 - DNA, 20 bp, Chlamydia pneumoniae
ccttcccttgggaaaaatct

SEQ ID NO: 1766 - DNA, 20 bp, Chlamydia pneumoniae
ccgcggataacagtcacata

SEQ ID NO: 1767 - DNA, 20 bp, Chlamydia pneumoniae
aggtaggttccgtggtcata

SEQ ID NO: 1768 - DNA, 20 bp, Chlamydia pneumoniae
gccaacgagatacagacgac

SEQ ID NO: 1769 - DNA, 20 bp, Chlamydia pneumoniae
ggacaaacaatgcttgcagg

SEQ ID NO: 1770 - DNA, 20 bp, Chlamydia pneumoniae
gcctgcactactattgcaca

SEQ ID NO: 1771 - DNA, 20 bp, Chlamydia pneumoniae
gcccagcacaaataagatac

SEQ ID NO: 1772 - DNA, 20 bp, Chlamydia pneumoniae
ggacttccgttatgctaagg

SEQ ID NO: 1773 - DNA, 20 bp, Chlamydia pneumoniae
gctctcctgctccagagata

SEQ ID NO: 1774 - DNA, 20 bp, Chlamydia pneumoniae
ccctatcacctccaagattc

SEQ ID NO: 1775 - DNA, 20 bp, Chlamydia pneumoniae
cgctatccctattgtcggaa

SEQ ID NO: 1776 - DNA, 20 bp, Chlamydia pneumoniae
gagacctttcttcaccagta

SEQ ID NO: 1777 - DNA, 20 bp, Chlamydia pneumoniae
ctatcccgaacggaaaagac

SEQ ID NO: 1778 - DNA, 20 bp, Chlamydia pneumoniae
ggccacacagatctcaaaaa

SEQ ID NO: 1779 - DNA, 20 bp, Chlamydia pneumoniae
cttctggagctgtagatctc

SEQ ID NO: 1780 - DNA, 20 bp, Chlamydia pneumoniae
caggaacctttgctatcgaa

SEQ ID NO: 1781 - DNA, 20 bp, Chlamydia pneumoniae
tatcccagacgcctccacag

SEQ ID NO: 1782 - DNA, 20 bp, Chlamydia pneumoniae
ccctagctcccatcatatct

SEQ ID NO: 1783 - DNA, 20 bp, Chlamydia pneumoniae
ctaggccacacagatctcaa

SEQ ID NO: 1784 - DNA, 20 bp, Chlamydia pneumoniae
cacaagctcaagtccttagg

SEQ ID NO: 1785 - DNA, 20 bp, Chlamydia pneumoniae
actcccgactctcgcacttg

SEQ ID NO: 1786 - DNA, 20 bp, Chlamydia pneumoniae
ccgtccaatctagggttaga

SEQ ID NO: 1787 - DNA, 20 bp, Chlamydia pneumoniae
gtctcgaagagggatctcat

SEQ ID NO: 1788 - DNA, 20 bp, Chlamydia pneumoniae
cccctcagctattgctaaag

SEQ ID NO: 1789 - DNA, 20 bp, Chlamydia pneumoniae
cgctcaaccaatccctaatc

SEQ ID NO: 1790 - DNA, 20 bp, Chlamydia pneumoniae
cctttgacggaggacttgtt

SEQ ID NO: 1791 - DNA, 20 bp, Chlamydia pneumoniae
tggagggactcgtacacaaa

SEQ ID NO: 1792 - DNA, 20 bp, Chlamydia pneumoniae
aaagcctttgacggaggact

SEQ ID NO: 1793 - DNA, 20 bp, Chlamydia pneumoniae
tctttggagggactcgtaca

SEQ ID NO: 1794 - DNA, 20 bp, Chlamydia pneumoniae
gcgctatgttcctcactgct

SEQ ID NO: 1795 - DNA, 20 bp, Chlamydia pneumoniae
gcatgggctaccaaatcttc

SEQ ID NO: 1796 - DNA, 20 bp, Chlamydia pneumoniae
gccttctgtcataagctctc

SEQ ID NO: 1797 - DNA, 20 bp, Chlamydia pneumoniae
aggagccgggaaaattccta

SEQ ID NO: 1798 - DNA, 20 bp, Chlamydia pneumoniae
gccatgacgaatcaaaggga

SEQ ID NO: 1799 - DNA, 20 bp, Chlamydia pneumoniae
ctttagccttgggatgatgc

SEQ ID NO: 1800 - DNA, 20 bp, Chlamydia pneumoniae
gtttgtggtatcgcccttga

SEQ ID NO: 1801 - DNA, 20 bp, Chlamydia pneumoniae
ggaggcttcaactgtatagg

SEQ ID NO: 1802 - DNA, 20 bp, Chlamydia pneumoniae
aaatttgtcctggcccagcc

SEQ ID NO: 1803 - DNA, 20 bp, Chlamydia pneumoniae
gggcaattcccgtagtgaaa

SEQ ID NO: 1804 - DNA, 20 bp, Chlamydia pneumoniae
acctcttctgttgtatctgg

SEQ ID NO: 1805 - DNA, 20 bp, Chlamydia pneumoniae
cggtacgaatgccacgccat

SEQ ID NO: 1806 - DNA, 20 bp, Chlamydia pneumoniae
ccctcaactctcgaaaacag

SEQ ID NO: 1807 - DNA, 20 bp, Chlamydia pneumoniae
cttgtcggcttctggtcttt

SEQ ID NO: 1808 - DNA, 20 bp, Chlamydia pneumoniae
agacctatgcaaagtatggg

SEQ ID NO: 1809 - DNA, 20 bp, Chlamydia pneumoniae
gtgcagaaaacccacgaatc

SEQ ID NO: 1810 - DNA, 20 bp, Chlamydia pneumoniae
ctcttgttccgaagagaaag

SEQ ID NO: 1811 - DNA, 20 bp, Chlamydia pneumoniae
cgacagctctcagagagatt

SEQ ID NO: 1812 - DNA, 20 bp, Chlamydia pneumoniae
ggagaacacccaagacaatc

SEQ ID NO: 1813 - DNA, 20 bp, Chlamydia pneumoniae
cctgagctttcacatcaagc

SEQ ID NO: 1814 - DNA, 20 bp, Chlamydia pneumoniae
gtgcgtgccttgttctagat

SEQ ID NO: 1815 - DNA, 20 bp, Chlamydia pneumoniae
ggacgctcatagtcttcctt

SEQ ID NO: 1816 - DNA, 20 bp, Chlamydia pneumoniae
gtagcctctctggtcacttt

SEQ ID NO: 1817 - DNA, 20 bp, Chlamydia pneumoniae
gaggcccccagatattcttt

SEQ ID NO: 1818 - DNA, 20 bp, Chlamydia pneumoniae
caggaggaagctacatttgc

SEQ ID NO: 1819 - DNA, 20 bp, Chlamydia pneumoniae
ccgctatcctcagcttttct

SEQ ID NO: 1820 - DNA, 20 bp, Chlamydia pneumoniae
cgatattcagagaaacgccc

SEQ ID NO: 1821 - DNA, 20 bp, Chlamydia pneumoniae
ccctgaatgcgcttctatca

SEQ ID NO: 1822 - DNA, 20 bp, Chlamydia pneumoniae
cattgtcttccctcccacaa

SEQ ID NO: 1823 - DNA, 20 bp, Chlamydia pneumoniae
tcttcttcatccaggcccag

SEQ ID NO: 1824 - DNA, 20 bp, Chlamydia pneumoniae
caagcagttctccaagctct

SEQ ID NO: 1825 - DNA, 20 bp, Chlamydia pneumoniae
ggcatacctgagacaccttt

SEQ ID NO: 1826 - DNA, 20 bp, Chlamydia pneumoniae
tggttcgttggtaaagctgc

SEQ ID NO: 1827 - DNA, 20 bp, Chlamydia pneumoniae
gatcaccagctaaagactgc

SEQ ID NO: 1828 - DNA, 20 bp, Chlamydia pneumoniae
cgactttacagcacactctc

SEQ ID NO: 1829 - DNA, 20 bp, Chlamydia pneumoniae
ggtgcatctgaaaaccaaac

SEQ ID NO: 1830 - DNA, 20 bp, Chlamydia pneumoniae
gacgactctatagcgtttgg

SEQ ID NO: 1831 - DNA, 20 bp, Chlamydia pneumoniae
ctcctgtggagaatgaagtc

SEQ ID NO: 1832 - DNA, 20 bp, Chlamydia pneumoniae
ccctttagcaatctggtcca

SEQ ID NO: 1833 - DNA, 20 bp, Chlamydia pneumoniae
tggtgcgtatggaaccaaat

SEQ ID NO: 1834 - DNA, 20 bp, Chlamydia pneumoniae
aagcctaggactgcctgagg

SEQ ID NO: 1835 - DNA, 20 bp, Chlamydia pneumoniae
gcttagggattctcatcctc

SEQ ID NO: 1836 - DNA, 20 bp, Chlamydia pneumoniae
gcttgcagctgacgaatatg

SEQ ID NO: 1837 - DNA, 20 bp, Chlamydia pneumoniae
cattctgggagctatcccta

SEQ ID NO: 1838 - DNA, 20 bp, Chlamydia pneumoniae
cagaacaagaaggctcctca

SEQ ID NO: 1839 - DNA, 20 bp, Chlamydia pneumoniae
ctcggcctcggaatagtaag

SEQ ID NO: 1840 - DNA, 20 bp, Chlamydia pneumoniae
cctataacaccgcaaatctc

SEQ ID NO: 1841 - DNA, 20 bp, Chlamydia pneumoniae
ccgaagcagccttcttcaat

SEQ ID NO: 1842 - DNA, 20 bp, Chlamydia pneumoniae
actgcttccagcttgggaat

SEQ ID NO: 1843 - DNA, 20 bp, Chlamydia pneumoniae
gactcgggattgtagctctt

SEQ ID NO: 1844 - DNA, 20 bp, Chlamydia pneumoniae
ccgtggtctttgcttacgat

SEQ ID NO: 1845 - DNA, 20 bp, Chlamydia pneumoniae
gcatccctggaatttcttgc

SEQ ID NO: 1846 - DNA, 20 bp, Chlamydia pneumoniae
gggccttcctacctttccta

SEQ ID NO: 1847 - DNA, 20 bp, Chlamydia pneumoniae
gcttgcagctgacgaatatg

SEQ ID NO: 1848 - DNA, 20 bp, Chlamydia pneumoniae
gccagggaagaatcacatca

SEQ ID NO: 1849 - DNA, 20 bp, Chlamydia pneumoniae
cgcagtgcacagaactagga

SEQ ID NO: 1850 - DNA, 20 bp, Chlamydia pneumoniae
gaacttgggacctcgacatt

SEQ ID NO: 1851 - DNA, 20 bp, Chlamydia pneumoniae
gggccactttgcgctatatt

SEQ ID NO: 1852 - DNA, 20 bp, Chlamydia pneumoniae
caaatcgggagtctcaagat

SEQ ID NO: 1853 - DNA, 20 bp, Chlamydia pneumoniae
gtgacaagaagcaccgtctt

SEQ ID NO: 1854 - DNA, 20 bp, Chlamydia pneumoniae
ccagggatagggtgaaaagc

SEQ ID NO: 1855 - DNA, 20 bp, Chlamydia pneumoniae
cactcttgagcaaggtatcc

SEQ ID NO: 1856 - DNA, 20 bp, Chlamydia pneumoniae
gcaaccccagtatatctcca

SEQ ID NO: 1857 - DNA, 20 bp, Chlamydia pneumoniae
gagtaaccccaggtaaagca

SEQ ID NO: 1858 - DNA, 20 bp, Chlamydia pneumoniae
ccgccatcgctatgaagtaa

SEQ ID NO: 1859 - DNA, 20 bp, Chlamydia pneumoniae
gcagtgatgacttctcctac

SEQ ID NO: 1860 - DNA, 20 bp, Chlamydia pneumoniae
cagtacaagcggaacgtatg

SEQ ID NO: 1861 - DNA, 20 bp, Chlamydia pneumoniae
ggaggagttgtctcctcttt

SEQ ID NO: 1862 - DNA, 20 bp, Chlamydia pneumoniae
tcgggatatggtacagaacc

SEQ ID NO: 1863 - DNA, 20 bp, Chlamydia pneumoniae
atggaactctctcaatgcga

SEQ ID NO: 1864 - DNA, 20 bp, Chlamydia pneumoniae
ccagaagcatacgagcgttt

SEQ ID NO: 1865 - DNA, 20 bp, Chlamydia pneumoniae
caagccatgtctaagccatc

SEQ ID NO: 1866 - DNA, 20 bp, Chlamydia pneumoniae
gaccttaacctttccttgcg

SEQ ID NO: 1867 - DNA, 20 bp, Chlamydia pneumoniae
gatttccaacagcgcctctt

SEQ ID NO: 1868 - DNA, 20 bp, Chlamydia pneumoniae
cctccttgaactaactgagc

SEQ ID NO: 1869 - DNA, 20 bp, Chlamydia pneumoniae
ggcataggatctcgcggcaa

SEQ ID NO: 1870 - DNA, 20 bp, Chlamydia pneumoniae
gcagctcgatggaagacatt

SEQ ID NO: 1871 - DNA, 20 bp, Chlamydia pneumoniae
gccgaagaatgttcacgttg

SEQ ID NO: 1872 - DNA, 20 bp, Chlamydia pneumoniae
cttcaactctcgagactgat

SEQ ID NO: 1873 - DNA, 20 bp, Chlamydia pneumoniae
cggggagcattttatgtagc

SEQ ID NO: 1874 - DNA, 20 bp, Chlamydia pneumoniae
cctcatgaaacagagtctcg

SEQ ID NO: 1875 - DNA, 20 bp, Chlamydia pneumoniae
ggaggaaaatgaccttgtgg

SEQ ID NO: 1876 - DNA, 20 bp, Chlamydia pneumoniae
cttcaactctcgagactgat

SEQ ID NO: 1877 - DNA, 20 bp, Chlamydia pneumoniae
cggggagcattttatgtagc

SEQ ID NO: 1878 - DNA, 20 bp, Chlamydia pneumoniae
gaagaagagtttccttggtc

SEQ ID NO: 1879 - DNA, 20 bp, Chlamydia pneumoniae
gctcctaaaacgatcgctga

SEQ ID NO: 1880 - DNA, 20 bp, Chlamydia pneumoniae
cctcgggctaggaatacttt

SEQ ID NO: 1881 - DNA, 20 bp, Chlamydia pneumoniae
acctgcagctcgatggaaga

SEQ ID NO: 1882 - DNA, 20 bp, Chlamydia pneumoniae
ccgccataaaagggtagaga

SEQ ID NO: 1883 - DNA, 20 bp, Chlamydia pneumoniae
gcacgctatacacagaagca

SEQ ID NO: 1884 - DNA, 20 bp, Chlamydia pneumoniae
ccccatgtcgtacgaaaagt

SEQ ID NO: 1885 - DNA, 20 bp, Chlamydia pneumoniae
gtaggcccgaacacaatagc

SEQ ID NO: 1886 - DNA, 20 bp, Chlamydia pneumoniae
gacgataccccggaaatcat

SEQ ID NO: 1887 - DNA, 20 bp, Chlamydia pneumoniae
ctgccaattgaagaatcggg

SEQ ID NO: 1888 - DNA, 20 bp, Chlamydia pneumoniae
gctgcagatcaatatgcgga

SEQ ID NO: 1889 - DNA, 20 bp, Chlamydia pneumoniae
tacacgagggcagaggcctt

SEQ ID NO: 1890 - DNA, 20 bp, Chlamydia pneumoniae
ccaccgctcacacgaataat

SEQ ID NO: 1891 - DNA, 20 bp, Chlamydia pneumoniae
ccccatgtcgtacgaaaagt

SEQ ID NO: 1892 - DNA, 20 bp, Chlamydia pneumoniae
gtcttactagagagggcgat

SEQ ID NO: 1893 - DNA, 20 bp, Chlamydia pneumoniae
gggaagctatgtagggtttc

SEQ ID NO: 1894 - DNA, 20 bp, Chlamydia pneumoniae
cctgcatgcagtgataacga

SEQ ID NO: 1895 - DNA, 20 bp, Chlamydia pneumoniae
gtggagggaaaaaagtggag

SEQ ID NO: 1896 - DNA, 20 bp, Chlamydia pneumoniae
gacaaagccgatatgctggt

SEQ ID NO: 1897 - DNA, 20 bp, Chlamydia pneumoniae
cctagaaacgctgcagatca

SEQ ID NO: 1898 - DNA, 20 bp, Chlamydia pneumoniae
cttccccttcctggaatcaa

SEQ ID NO: 1899 - DNA, 20 bp, Chlamydia pneumoniae
cgagtccgtactttgtcttc

SEQ ID NO: 1900 - DNA, 20 bp, Chlamydia pneumoniae
cagaagctcattggggaaaa

SEQ ID NO: 1901 - DNA, 20 bp, Chlamydia pneumoniae
tttgctgccctcctagatca

SEQ ID NO: 1902 - DNA, 20 bp, Chlamydia pneumoniae
ccagaacacgtcgacatagc

SEQ ID NO: 1903 - DNA, 20 bp, Chlamydia pneumoniae
cttccccttcctggaatcaa

SEQ ID NO: 1904 - DNA, 20 bp, Chlamydia pneumoniae
cggaaagatcgttctggcat

SEQ ID NO: 1905 - DNA, 20 bp, Chlamydia pneumoniae
gcaggttacgagtctactaa

SEQ ID NO: 1906 - DNA, 20 bp, Chlamydia pneumoniae
gcagacacattacccttcac

SEQ ID NO: 1907 - DNA, 20 bp, Chlamydia pneumoniae
cccggcagcagaactccctg

SEQ ID NO: 1908 - DNA, 20 bp, Chlamydia pneumoniae
caccatctacagttgagtct

SEQ ID NO: 1909 - DNA, 20 bp, Chlamydia pneumoniae
gtcctccatctgcatcaaca

SEQ ID NO: 1910 - DNA, 20 bp, Chlamydia pneumoniae
gctattggtgcttgtaggtc

SEQ ID NO: 1911 - DNA, 20 bp, Chlamydia pneumoniae
catggagaagtcgtggtatc

SEQ ID NO: 1912 - DNA, 20 bp, Chlamydia pneumoniae
atccgcccccgacagtaaat

SEQ ID NO: 1913 - DNA, 20 bp, Chlamydia pneumoniae
cctgaagttaatccagttgc

SEQ ID NO: 1914 - DNA, 20 bp, Chlamydia pneumoniae
ctgtgatctccattgcgaac

SEQ ID NO: 1915 - DNA, 20 bp, Chlamydia pneumoniae
cgtaagaaatagaagccaag

SEQ ID NO: 1916 - DNA, 20 bp, Chlamydia pneumoniae
tggctggatttgaaccaacg

SEQ ID NO: 1917 - DNA, 20 bp, Chlamydia pneumoniae
actagtcctatgtcctcctg

SEQ ID NO: 1918 - DNA, 20 bp, Chlamydia pneumoniae
gtgatcctcttccacacaag

SEQ ID NO: 1919 - DNA, 20 bp, Chlamydia pneumoniae
ccgcgctgtgatctccattg

SEQ ID NO: 1920 - DNA, 20 bp, Chlamydia pneumoniae
gctaaggaaaacgcttcgca

SEQ ID NO: 1921 - DNA, 20 bp, Chlamydia pneumoniae
ccatctactgttgaatcgag

SEQ ID NO: 1922 - DNA, 20 bp, Chlamydia pneumoniae
cccctagtctttggtatcag

SEQ ID NO: 1923 - DNA, 20 bp, Chlamydia pneumoniae
gtgatcctcttccacacaag

SEQ ID NO: 1924 - DNA, 20 bp, Chlamydia pneumoniae
gctaggccatattctcatgg

SEQ ID NO: 1925 - DNA, 20 bp, Chlamydia pneumoniae
catgggtcatccaaatcaca

SEQ ID NO: 1926 - DNA, 20 bp, Chlamydia pneumoniae
ctgacgctaaagagctctct

SEQ ID NO: 1927 - DNA, 20 bp, Chlamydia pneumoniae
ctcttgtctcaaccctttcc

SEQ ID NO: 1928 - DNA, 20 bp, Chlamydia pneumoniae
gccaagacaacaagctgatt

SEQ ID NO: 1929 - DNA, 20 bp, Chlamydia pneumoniae
cggagaacctagaaaccttc

SEQ ID NO: 1930 - DNA, 20 bp, Chlamydia pneumoniae
caattcgcctaacaccagag

SEQ ID NO: 1931 - DNA, 20 bp, Chlamydia pneumoniae
caggaacactacgcaatcct

SEQ ID NO: 1932 - DNA, 20 bp, Chlamydia pneumoniae
ctctttgttgggggattggc

SEQ ID NO: 1933 - DNA, 20 bp, Chlamydia pneumoniae
cgtatagagggtagttcttg

SEQ ID NO: 1934 - DNA, 20 bp, Chlamydia pneumoniae
gggattggcagggttgcgga

SEQ ID NO: 1935 - DNA, 20 bp, Chlamydia pneumoniae
gggtagttcttgtgcatcag

SEQ ID NO: 1936 - DNA, 20 bp, Chlamydia pneumoniae
gactccctgaaactgaagag

SEQ ID NO: 1937 - DNA, 20 bp, Chlamydia pneumoniae
aggttccctaggactcagcg

SEQ ID NO: 1938 - DNA, 20 bp, Chlamydia pneumoniae
gaggatccgttctcttcttc

SEQ ID NO: 1939 - DNA, 20 bp, Chlamydia pneumoniae
ctctcctggattaagcgttc

SEQ ID NO: 1940 - DNA, 20 bp, Chlamydia pneumoniae
gggaacaagggccatcaaaa

SEQ ID NO: 1941 - DNA, 20 bp, Chlamydia pneumoniae
gtagcagtacatctacctgg

SEQ ID NO: 1942 - DNA, 20 bp, Chlamydia pneumoniae
ccgcacaaaaccgcttatac

SEQ ID NO: 1943 - DNA, 20 bp, Chlamydia pneumoniae
gactcttgcttctcctttga

SEQ ID NO: 1944 - DNA, 20 bp, Chlamydia pneumoniae
gccacggttatgaagacgaa

SEQ ID NO: 1945 - DNA, 20 bp, Chlamydia pneumoniae
atagcacacacctgctgacg

SEQ ID NO: 1946 - DNA, 20 bp, Chlamydia pneumoniae
gtcttccctttccttctgga

SEQ ID NO: 1947 - DNA, 20 bp, Chlamydia pneumoniae
gctcctgggaaaagttgagc

SEQ ID NO: 1948 - DNA, 20 bp, Chlamydia pneumoniae
gagcacgtgatccaagaaac

SEQ ID NO: 1949 - DNA, 20 bp, Chlamydia pneumoniae
ggttacggatcacttgctga

SEQ ID NO: 1950 - DNA, 20 bp, Chlamydia pneumoniae
ccagaggtatccccacaaat

SEQ ID NO: 1951 - DNA, 20 bp, Chlamydia pneumoniae
cgactggttctcagtcacaa

SEQ ID NO: 1952 - DNA, 20 bp, Chlamydia pneumoniae
acaatacccccgtcctctaa

SEQ ID NO: 1953 - DNA, 20 bp, Chlamydia pneumoniae
gctatagttacagcttgggg

SEQ ID NO: 1954 - DNA, 20 bp, Chlamydia pneumoniae
gaacttgagatcctcccctt

SEQ ID NO: 1955 - DNA, 20 bp, Chlamydia pneumoniae
tccacgtcagcatctgtcat

SEQ ID NO: 1956 - DNA, 20 bp, Chlamydia pneumoniae
cctcagcataagtgctacta

SEQ ID NO: 1957 - DNA, 20 bp, Chlamydia pneumoniae
ctccttggcgtgtaggaata

SEQ ID NO: 1958 - DNA, 20 bp, Chlamydia pneumoniae
gctcgcattcgtcatcaaga

SEQ ID NO: 1959 - DNA, 20 bp, Chlamydia pneumoniae
cagtaatagcggatgcatcg

SEQ ID NO: 1960 - DNA, 20 bp, Chlamydia pneumoniae
aatcgcaaatggaatcgcgg

SEQ ID NO: 1961 - DNA, 20 bp, Chlamydia pneumoniae
ggataaggcttatctggaga

SEQ ID NO: 1962 - DNA, 20 bp, Chlamydia pneumoniae
gacgaacttcttggtgacga

SEQ ID NO: 1963 - DNA, 20 bp, Chlamydia pneumoniae
cccccagaaatctcctagaa

SEQ ID NO: 1964 - DNA, 20 bp, Chlamydia pneumoniae
gtaggcctaattaactcggg

SEQ ID NO: 1965 - DNA, 20 bp, Chlamydia pneumoniae
catcgatctcatgcgacact

SEQ ID NO: 1966 - DNA, 20 bp, Chlamydia pneumoniae
gcctctattctgtaccagga

SEQ ID NO: 1967 - DNA, 20 bp, Chlamydia pneumoniae
ctacctatggaacactgagc

SEQ ID NO: 1968 - DNA, 20 bp, Chlamydia pneumoniae
gagctcgcaaaagctgtggt

SEQ ID NO: 1969 - DNA, 20 bp, Chlamydia pneumoniae
aagcggctagaacagcagtg

SEQ ID NO: 1970 - DNA, 20 bp, Chlamydia pneumoniae
ggtcgagtgtttcttcggat

SEQ ID NO: 1971 - DNA, 20 bp, Chlamydia pneumoniae
gtatcctgccgtgttagctt

SEQ ID NO: 1972 - DNA, 20 bp, Chlamydia pneumoniae
gagcagaccgatagagggat

SEQ ID NO: 1973 - DNA, 20 bp, Chlamydia pneumoniae
ccatagcaatagtgattccg

SEQ ID NO: 1974 - DNA, 20 bp, Chlamydia pneumoniae
atgacaccctaccaaagcga

SEQ ID NO: 1975 - DNA, 20 bp, Chlamydia pneumoniae
agggggtgattttcgaaagc

SEQ ID NO: 1976 - DNA, 20 bp, Chlamydia pneumoniae
ccgcgaagcagaatctgtat

SEQ ID NO: 1977 - DNA, 20 bp, Chlamydia pneumoniae
cgactcaagaaacgaggaag

SEQ ID NO: 1978 - DNA, 20 bp, Chlamydia pneumoniae
gaaggtgttcttacccacta

SEQ ID NO: 1979 - DNA, 20 bp, Chlamydia pneumoniae
gcaagcttacctaaacacac

SEQ ID NO: 1980 - DNA, 20 bp, Chlamydia pneumoniae
cagaaacggacagggtatca

SEQ ID NO: 1981 - DNA, 20 bp, Chlamydia pneumoniae
gcctgatacacagaagcact

SEQ ID NO: 1982 - DNA, 20 bp, Chlamydia pneumoniae
ataggaaatgcgggcgtacc

SEQ ID NO: 1983 - DNA, 20 bp, Chlamydia pneumoniae
gcaagagggtccaacaaact

SEQ ID NO: 1984 - DNA, 20 bp, Chlamydia pneumoniae
ctcttccaggagccgttcaa

SEQ ID NO: 1985 - DNA, 20 bp, Chlamydia pneumoniae
gggaaagatgccttaggact

SEQ ID NO: 1986 - DNA, 20 bp, Chlamydia pneumoniae
gcagtggtctttaggactca

SEQ ID NO: 1987 - DNA, 20 bp, Chlamydia pneumoniae
cctcgcccaaggttttattg

SEQ ID NO: 1988 - DNA, 20 bp, Chlamydia pneumoniae
ggaagtactgaaggatctgt

SEQ ID NO: 1989 - DNA, 20 bp, Chlamydia pneumoniae
cgccagtttttcatctcgac

SEQ ID NO: 1990 - DNA, 20 bp, Chlamydia pneumoniae
cgtcttgcctcaagtagctt

SEQ ID NO: 1991 - DNA, 20 bp, Chlamydia pneumoniae
agcaatggagctctaacagc

SEQ ID NO: 1992 - DNA, 20 bp, Chlamydia pneumoniae
cggttccttcttgaaactct

SEQ ID NO: 1993 - DNA, 20 bp, Chlamydia pneumoniae
tgaaggcgttacctacgctc

SEQ ID NO: 1994 - DNA, 20 bp, Chlamydia pneumoniae
ccgcatgctagttcttagca

SEQ ID NO: 1995 - DNA, 20 bp, Chlamydia pneumoniae
agtattttcccccatcctgc

SEQ ID NO: 1996 - DNA, 20 bp, Chlamydia pneumoniae
cttcttttggatccactcct

SEQ ID NO: 1997 - DNA, 20 bp, Chlamydia pneumoniae
gactacgacaatgctcgcat

SEQ ID NO: 1998 - DNA, 20 bp, Chlamydia pneumoniae
cgcaatctttcactccacca

SEQ ID NO: 1999 - DNA, 20 bp, Chlamydia pneumoniae
gcgatccagactttccaatc

SEQ ID NO: 2000 - DNA, 20 bp, Chlamydia pneumoniae
ggccgcagtatttccatact

SEQ ID NO: 2001 - DNA, 20 bp, Chlamydia pneumoniae
ctagggacaaagagaaagag

SEQ ID NO: 2002 - DNA, 20 bp, Chlamydia pneumoniae
ctggccgactctcccctatg

SEQ ID NO: 2003 - DNA, 20 bp, Chlamydia pneumoniae
cagctttagcagcagcatag

SEQ ID NO: 2004 - DNA, 20 bp, Chlamydia pneumoniae
gctatagctttctctgcagc

SEQ ID NO: 2005 - DNA, 20 bp, Chlamydia pneumoniae
ccacccaagcctgttaaact

SEQ ID NO: 2006 - DNA, 20 bp, Chlamydia pneumoniae
gagttatttgagcgacaagg

SEQ ID NO: 2007 - DNA, 20 bp, Chlamydia pneumoniae
acatattggctcccttgtcc

SEQ ID NO: 2008 - DNA, 20 bp, Chlamydia pneumoniae
cccttccgtccaaccgagac

SEQ ID NO: 2009 - DNA, 20 bp, Chlamydia pneumoniae
ggaaatcaagtcgttcctga

SEQ ID NO: 2010 - DNA, 20 bp, Chlamydia pneumoniae
gcgtaccagtctcagtacta

SEQ ID NO: 2011 - DNA, 20 bp, Chlamydia pneumoniae
gaggttttgccaaaacgcct

SEQ ID NO: 2012 - DNA, 20 bp, Chlamydia pneumoniae
acctctccaggcatttatgg

SEQ ID NO: 2013 - DNA, 20 bp, Chlamydia pneumoniae
gagactacagttcggggata

SEQ ID NO: 2014 - DNA, 20 bp, Chlamydia pneumoniae
ccgtctatcgaatccacgta

SEQ ID NO: 2015 - DNA, 20 bp, Chlamydia pneumoniae
gcaacatgcccacctaaaga

SEQ ID NO: 2016 - DNA, 20 bp, Chlamydia pneumoniae
ccgatttcgagggcattcta

SEQ ID NO: 2017 - DNA, 20 bp, Chlamydia pneumoniae
gtccgcaatagttgcatgac

SEQ ID NO: 2018 - DNA, 20 bp, Chlamydia pneumoniae
atgactggagggaagttttc

SEQ ID NO: 2019 - DNA, 20 bp, Chlamydia pneumoniae
cccctcccaaacctatagaa

SEQ ID NO: 2020 - DNA, 20 bp, Chlamydia pneumoniae
cggtacgaaaaacttcacgc

SEQ ID NO: 2021 - DNA, 20 bp, Chlamydia pneumoniae
cgtccatgtgatgtaatcct

SEQ ID NO: 2022 - DNA, 20 bp, Chlamydia pneumoniae
caggccactttgcctaatgt

SEQ ID NO: 2023 - DNA, 20 bp, Chlamydia pneumoniae
cgggcccgcttcctgtatta

SEQ ID NO: 2024 - DNA, 20 bp, Chlamydia pneumoniae
taacaagctgccagtctccc

SEQ ID NO: 2025 - DNA, 20 bp, Chlamydia pneumoniae
agactccaagtcagccaaga

SEQ ID NO: 2026 - DNA, 20 bp, Chlamydia pneumoniae
gctcttgttcttgacggaga

SEQ ID NO: 2027 - DNA, 20 bp, Chlamydia pneumoniae
gcctgcgccctattatagaa

SEQ ID NO: 2028 - DNA, 20 bp, Chlamydia pneumoniae
gcccgtttcatagagtcaac

SEQ ID NO: 2029 - DNA, 20 bp, Chlamydia pneumoniae
tgctcagccatagaaactcg

SEQ ID NO: 2030 - DNA, 20 bp, Chlamydia pneumoniae
ccttaggaatcggccattgt

SEQ ID NO: 2031 - DNA, 20 bp, Chlamydia pneumoniae
ggcaaaggaacggatcaatg

SEQ ID NO: 2032 - DNA, 20 bp, Chlamydia pneumoniae
gaacacgaatgggcttattg

SEQ ID NO: 2033 - DNA, 20 bp, Chlamydia pneumoniae
gcccgtttcatagagtcaac

SEQ ID NO: 2034 - DNA, 20 bp, Chlamydia pneumoniae
cagctagcgtctgttctgaa

SEQ ID NO: 2035 - DNA, 20 bp, Chlamydia pneumoniae
cgaggctcctcgtaataaga

SEQ ID NO: 2036 - DNA, 20 bp, Chlamydia pneumoniae
cgaccaagtaactgattccc

SEQ ID NO: 2037 - DNA, 20 bp, Chlamydia pneumoniae
gcaaggtctcatatccagga

SEQ ID NO: 2038 - DNA, 20 bp, Chlamydia pneumoniae
gcgtagctggcttttggaaa

SEQ ID NO: 2039 - DNA, 20 bp, Chlamydia pneumoniae
gggtataggaaagaactcgg

SEQ ID NO: 2040 - DNA, 20 bp, Chlamydia pneumoniae
cagctgagtctatcttctga

SEQ ID NO: 2041 - DNA, 20 bp, Chlamydia pneumoniae
ggaatatagtcgcttcctga

SEQ ID NO: 2042 - DNA, 20 bp, Chlamydia pneumoniae
ccttcatttgcaggtcgctt

SEQ ID NO: 2043 - DNA, 20 bp, Chlamydia pneumoniae
ccaacacgaactgcgtagtt

SEQ ID NO: 2044 - DNA, 20 bp, Chlamydia pneumoniae
gcgccaaatcctgtttctct

SEQ ID NO: 2045 - DNA, 20 bp, Chlamydia pneumoniae
gccttctctttagtccttcg

SEQ ID NO: 2046 - DNA, 20 bp, Chlamydia pneumoniae
ctgacaagccctttgcaaaa

SEQ ID NO: 2047 - DNA, 20 bp, Chlamydia pneumoniae
gacgagaatttatggggtgc

SEQ ID NO: 2048 - DNA, 20 bp, Chlamydia pneumoniae
tctgaaaatggtggagcgga

SEQ ID NO: 2049 - DNA, 20 bp, Chlamydia pneumoniae
ccttcctacctggatcacaa

SEQ ID NO: 2050 - DNA, 20 bp, Chlamydia pneumoniae
cgagctcgaagtacaacgta

SEQ ID NO: 2051 - DNA, 20 bp, Chlamydia pneumoniae
ccctacggagctttcattga

SEQ ID NO: 2052 - DNA, 20 bp, Chlamydia pneumoniae
cgatcctttcttcgtcgtga

SEQ ID NO: 2053 - DNA, 20 bp, Chlamydia pneumoniae
gatccttgagcaagtcagca

SEQ ID NO: 2054 - DNA, 20 bp, Chlamydia pneumoniae
gatgaaggttctgctgagat

SEQ ID NO: 2055 - DNA, 20 bp, Chlamydia pneumoniae
gctgaacctaaaagcgtcgt

SEQ ID NO: 2056 - DNA, 20 bp, Chlamydia pneumoniae
gcactctgcacgtgtttatg

SEQ ID NO: 2057 - DNA, 20 bp, Chlamydia pneumoniae
cgtcaaagatctggcaacag

SEQ ID NO: 2058 - DNA, 20 bp, Chlamydia pneumoniae
cagttcaagttcacttgcag

SEQ ID NO: 2059 - DNA, 20 bp, Chlamydia pneumoniae
cgcaaaaacaggagaaggtc

SEQ ID NO: 2060 - DNA, 20 bp, Chlamydia pneumoniae
ctacctgtcagggtgttatg

SEQ ID NO: 2061 - DNA, 20 bp, Chlamydia pneumoniae
gtcaaagaagttcgcaaagg

SEQ ID NO: 2062 - DNA, 20 bp, Chlamydia pneumoniae
gcagcacgcactaatctatg

SEQ ID NO: 2063 - DNA, 20 bp, Chlamydia pneumoniae
gactatggatcttgcagtag

SEQ ID NO: 2064 - DNA, 20 bp, Chlamydia pneumoniae
cgattgaagttttccctacc

SEQ ID NO: 2065 - DNA, 20 bp, Chlamydia pneumoniae
gactggttaggtgtccttac

SEQ ID NO: 2066 - DNA, 20 bp, Chlamydia pneumoniae
tttggatgatgggcgttgtc

SEQ ID NO: 2067 - DNA, 20 bp, Chlamydia pneumoniae
cgtgtgtaacgtctggatca

SEQ ID NO: 2068 - DNA, 20 bp, Chlamydia pneumoniae
gcaggttcttaccttgctct

SEQ ID NO: 2069 - DNA, 20 bp, Chlamydia pneumoniae
caatttcgtcagcagaacac

SEQ ID NO: 2070 - DNA, 20 bp, Chlamydia pneumoniae
gaagctggaaaggctgagaa

SEQ ID NO: 2071 - DNA, 20 bp, Chlamydia pneumoniae
gctggtatgattgatgccac

SEQ ID NO: 2072 - DNA, 20 bp, Chlamydia pneumoniae
tccgcaatctcataggagac

SEQ ID NO: 2073 - DNA, 20 bp, Chlamydia pneumoniae
ggcattcatgttcgcacaga

SEQ ID NO: 2074 - DNA, 20 bp, Chlamydia pneumoniae
ctctgtaaatggctcgttcc

SEQ ID NO: 2075 - DNA, 20 bp, Chlamydia pneumoniae
ccattgcaaaagcttacgga

SEQ ID NO: 2076 - DNA, 20 bp, Chlamydia pneumoniae
ccttccttagaagaactcgc

SEQ ID NO: 2077 - DNA, 20 bp, Chlamydia pneumoniae
ccatgtccctgtgcaaatag

SEQ ID NO: 2078 - DNA, 20 bp, Chlamydia pneumoniae
cgccgtggttatagctatac

SEQ ID NO: 2079 - DNA, 20 bp, Chlamydia pneumoniae
cctgaccttcatgttttggg

SEQ ID NO: 2080 - DNA, 20 bp, Chlamydia pneumoniae
tcccttcgttatcgatgccc

SEQ ID NO: 2081 - DNA, 20 bp, Chlamydia pneumoniae
acaggaaagagacctcgccg

SEQ ID NO: 2082 - DNA, 20 bp, Chlamydia pneumoniae
ggtctaaaggaagattctcc

SEQ ID NO: 2083 - DNA, 20 bp, Chlamydia pneumoniae
cagtctccaacatgacttcc

SEQ ID NO: 2084 - DNA, 20 bp, Chlamydia pneumoniae
cttgcttttgtccgagtagc

SEQ ID NO: 2085 - DNA, 20 bp, Chlamydia pneumoniae
cttccccatggatatcaggg

SEQ ID NO: 2086 - DNA, 20 bp, Chlamydia pneumoniae
ctcttcttaggcttccccat

SEQ ID NO: 2087 - DNA, 20 bp, Chlamydia pneumoniae
gttcctccctggaaacgatg

SEQ ID NO: 2088 - DNA, 20 bp, Chlamydia pneumoniae
agccgccttggtcattgtga

SEQ ID NO: 2089 - DNA, 20 bp, Chlamydia pneumoniae
tctatcatgccttcgttgcc

SEQ ID NO: 2090 - DNA, 20 bp, Chlamydia pneumoniae
cggaaaacctcccagaaatc

SEQ ID NO: 2091 - DNA, 20 bp, Chlamydia pneumoniae
gccacctgaaactgccataa

SEQ ID NO: 2092 - DNA, 20 bp, Chlamydia pneumoniae
gcagcaggtacgatcttaga

SEQ ID NO: 2093 - DNA, 20 bp, Chlamydia pneumoniae
taagggactggtactcgctc

SEQ ID NO: 2094 - DNA, 20 bp, Chlamydia pneumoniae
cccccataattggggacaaa

SEQ ID NO: 2095 - DNA, 20 bp, Chlamydia pneumoniae
atgtggacgggcttcaccct

SEQ ID NO: 2096 - DNA, 20 bp, Chlamydia pneumoniae
gagaggcgtagcccttcata

SEQ ID NO: 2097 - DNA, 20 bp, Chlamydia pneumoniae
gccctcatgatgcaaaagca

SEQ ID NO: 2098 - DNA, 20 bp, Chlamydia pneumoniae
ggaaaggtaagcatggctgt

SEQ ID NO: 2099 - DNA, 20 bp, Chlamydia pneumoniae
gaagcagcaggtacgatctt

SEQ ID NO: 2100 - DNA, 20 bp, Chlamydia pneumoniae
ccttcggatcttcccatttc

SEQ ID NO: 2101 - DNA, 20 bp, Chlamydia pneumoniae
gaggaatcaaagtcatgccc

SEQ ID NO: 2102 - DNA, 20 bp, Chlamydia pneumoniae
ctgggtcagactctgattac

SEQ ID NO: 2103 - DNA, 20 bp, Chlamydia pneumoniae
cgctatttccattccctcca

SEQ ID NO: 2104 - DNA, 20 bp, Chlamydia pneumoniae
gggggattaaaggaaacctc

SEQ ID NO: 2105 - DNA, 20 bp, Chlamydia pneumoniae
ctgacggaaagcgtttagca

SEQ ID NO: 2106 - DNA, 20 bp, Chlamydia pneumoniae
ccacacgagtcatacctaca

SEQ ID NO: 2107 - DNA, 20 bp, Chlamydia pneumoniae
ctcactggctcctaaactca

SEQ ID NO: 2108 - DNA, 20 bp, Chlamydia pneumoniae
ctgatacgaacatagcctcc

SEQ ID NO: 2109 - DNA, 20 bp, Chlamydia pneumoniae
ccacacgagtcatacctaca

SEQ ID NO: 2110 - DNA, 20 bp, Chlamydia pneumoniae
gctaacggagcaaactcctg

SEQ ID NO: 2111 - DNA, 20 bp, Chlamydia pneumoniae
ccctaggttgacgagaaaag

SEQ ID NO: 2112 - DNA, 20 bp, Chlamydia pneumoniae
ggacagtatgagagacagca

SEQ ID NO: 2113 - DNA, 20 bp, Chlamydia pneumoniae
gagtggcaggcataaacctt

SEQ ID NO: 2114 - DNA, 20 bp, Chlamydia pneumoniae
atttgtcgataccaccacca

SEQ ID NO: 2115 - DNA, 20 bp, Chlamydia pneumoniae
cgcaagtcgaggaattgtca

SEQ ID NO: 2116 - DNA, 20 bp, Chlamydia pneumoniae
cagcacacccaaacaacaca

SEQ ID NO: 2117 - DNA, 20 bp, Chlamydia pneumoniae
gaccaagccataagactcct

SEQ ID NO: 2118 - DNA, 20 bp, Chlamydia pneumoniae
atgcgctgacgcaccttctt

SEQ ID NO: 2119 - DNA, 20 bp, Chlamydia pneumoniae
cccaaagccattagacttcc

SEQ ID NO: 2120 - DNA, 20 bp, Chlamydia pneumoniae
tttactttacgatttttatg

SEQ ID NO: 2121 - DNA, 20 bp, Chlamydia pneumoniae
cagtagggccacaacaaatc

SEQ ID NO: 2122 - DNA, 20 bp, Chlamydia pneumoniae
gctgtaagctctcccaacct

SEQ ID NO: 2123 - DNA, 20 bp, Chlamydia pneumoniae
cccctcctaattcttctgtg

SEQ ID NO: 2124 - DNA, 20 bp, Chlamydia pneumoniae
ggagctatgaccccttatct

SEQ ID NO: 2125 - DNA, 20 bp, Chlamydia pneumoniae
agaatcggaaaccccacgca

SEQ ID NO: 2126 - DNA, 20 bp, Chlamydia pneumoniae
cgagtgctcttgttcagaag

SEQ ID NO: 2127 - DNA, 20 bp, Chlamydia pneumoniae
ctcttggttattgcctatgg

SEQ ID NO: 2128 - DNA, 20 bp, Chlamydia pneumoniae
aggggctcgcccttttttta

SEQ ID NO: 2129 - DNA, 20 bp, Chlamydia pneumoniae
ggttgtcggagctatacaga

SEQ ID NO: 2130 - DNA, 20 bp, Chlamydia pneumoniae
ccgtcgtcagtcaaccaata

SEQ ID NO: 2131 - DNA, 20 bp, Chlamydia pneumoniae
ggaacaggctcagatgattc

SEQ ID NO: 2132 - DNA, 20 bp, Chlamydia pneumoniae
gctctctcttacccttcaga

SEQ ID NO: 2133 - DNA, 20 bp, Chlamydia pneumoniae
ccctctcttcaagaggatga

SEQ ID NO: 2134 - DNA, 20 bp, Chlamydia pneumoniae
cccgtgttttgttggtttgc

SEQ ID NO: 2135 - DNA, 20 bp, Chlamydia pneumoniae
taaaacgatccgtcgtcagt

SEQ ID NO: 2136 - DNA, 20 bp, Chlamydia pneumoniae
ctagccactctggaactcta

SEQ ID NO: 2137 - DNA, 20 bp, Chlamydia pneumoniae
gtcatgctcatagccaactc

SEQ ID NO: 2138 - DNA, 20 bp, Chlamydia pneumoniae
gcaaagtgttatggcggaga

SEQ ID NO: 2139 - DNA, 20 bp, Chlamydia pneumoniae
cactctggaactctacctca

SEQ ID NO: 2140 - DNA, 20 bp, Chlamydia pneumoniae
ggaaaggggaactccagaat

SEQ ID NO: 2141 - DNA, 20 bp, Chlamydia pneumoniae
cccttacgttggcattatgg

SEQ ID NO: 2142 - DNA, 20 bp, Chlamydia pneumoniae
ctttcgtggtctctccaatg

SEQ ID NO: 2143 - DNA, 20 bp, Chlamydia pneumoniae
cccctcaagaatatctgagc

SEQ ID NO: 2144 - DNA, 20 bp, Chlamydia pneumoniae
ggattccaaacctgcggtaa

SEQ ID NO: 2145 - DNA, 20 bp, Chlamydia pneumoniae
ccggatctttcaatgctagg

SEQ ID NO: 2146 - DNA, 20 bp, Chlamydia pneumoniae
caaggcaccacctatctaac

SEQ ID NO: 2147 - DNA, 20 bp, Chlamydia pneumoniae
aagaacagcagggacggccc

SEQ ID NO: 2148 - DNA, 20 bp, Chlamydia pneumoniae
ggcatccctgaaatcaaacg

SEQ ID NO: 2149 - DNA, 20 bp, Chlamydia pneumoniae
cgtctgtacacgcctatcaa

SEQ ID NO: 2150 - DNA, 20 bp, Chlamydia pneumoniae
gagaatccctgccttttctc

SEQ ID NO: 2151 - DNA, 20 bp, Chlamydia pneumoniae
cagtagaagttccaaacctc

SEQ ID NO: 2152 - DNA, 20 bp, Chlamydia pneumoniae
ggtggctgtgtcaaagttac

SEQ ID NO: 2153 - DNA, 20 bp, Chlamydia pneumoniae
ttctctaacaaggaggcgag

SEQ ID NO: 2154 - DNA, 20 bp, Chlamydia pneumoniae
gtctccaccaacctacagta

SEQ ID NO: 2155 - DNA, 20 bp, Chlamydia pneumoniae
aataagagtggctgcagcac

SEQ ID NO: 2156 - DNA, 20 bp, Chlamydia pneumoniae
caagatctttccatgacgca

SEQ ID NO: 2157 - DNA, 20 bp, Chlamydia pneumoniae
cagcttggttagcgcggttg

SEQ ID NO: 2158 - DNA, 20 bp, Chlamydia pneumoniae
gggtagaatcgttccccata

SEQ ID NO: 2159 - DNA, 20 bp, Chlamydia pneumoniae
ccctctgcattactcacaga

SEQ ID NO: 2160 - DNA, 20 bp, Chlamydia pneumoniae
ctggactctccaagatccta

SEQ ID NO: 2161 - DNA, 20 bp, Chlamydia pneumoniae
gtacagtagattcgcgaacg

SEQ ID NO: 2162 - DNA, 20 bp, Chlamydia pneumoniae
ccgtacgtagtgggtaaatg

SEQ ID NO: 2163 - DNA, 20 bp, Chlamydia pneumoniae
ctgccattgcagtccttgct

SEQ ID NO: 2164 - DNA, 20 bp, Chlamydia pneumoniae
ccgccccgtttcgatctaac

SEQ ID NO: 2165 - DNA, 20 bp, Chlamydia pneumoniae
cctgaaaacctcaggaagag

SEQ ID NO: 2166 - DNA, 20 bp, Chlamydia pneumoniae
cccctggttaagcaaaagag

SEQ ID NO: 2167 - DNA, 20 bp, Chlamydia pneumoniae
ctcccgagaaggagggggaa

SEQ ID NO: 2168 - DNA, 20 bp, Chlamydia pneumoniae
gaacaactgctgaacagcag

SEQ ID NO: 2169 - DNA, 20 bp, Chlamydia pneumoniae
tatgtcggaaagcgtccgtg

SEQ ID NO: 2170 - DNA, 20 bp, Chlamydia pneumoniae
gttccttacgaatcgtcctc

SEQ ID NO: 2171 - DNA, 20 bp, Chlamydia pneumoniae
caggctaacacagatatgcc

SEQ ID NO: 2172 - DNA, 20 bp, Chlamydia pneumoniae
cctaccaggacttaagatcg

SEQ ID NO: 2173 - DNA, 20 bp, Chlamydia pneumoniae
gggattcgttctacgaacac

SEQ ID NO: 2174 - DNA, 20 bp, Chlamydia pneumoniae
cccaatctcacaggccaaca

SEQ ID NO: 2175 - DNA, 20 bp, Chlamydia pneumoniae
ggaatggtagcctcagcaat

SEQ ID NO: 2176 - DNA, 20 bp, Chlamydia pneumoniae
gaggaagcagatgcactttc

SEQ ID NO: 2177 - DNA, 20 bp, Chlamydia pneumoniae
ccatcaagtgccttgcctat

SEQ ID NO: 2178 - DNA, 20 bp, Chlamydia pneumoniae
cttgatcataccgggaaacc

SEQ ID NO: 2179 - DNA, 20 bp, Chlamydia pneumoniae
tatccttccacactcaccct

SEQ ID NO: 2180 - DNA, 20 bp, Chlamydia pneumoniae
ccaaaatccccacttgcggg

SEQ ID NO: 2181 - DNA, 20 bp, Chlamydia pneumoniae
ctgtcaccgtaggtactatg

SEQ ID NO: 2182 - DNA, 20 bp, Chlamydia pneumoniae
ccccccctacaggaacaaca

SEQ ID NO: 2183 - DNA, 20 bp, Chlamydia pneumoniae
cgaagctttaggcttccctc

SEQ ID NO: 2184 - DNA, 20 bp, Chlamydia pneumoniae
ccgagctgatacccttcaaa

SEQ ID NO: 2185 - DNA, 20 bp, Chlamydia pneumoniae
gcaccattagcaaaatcccc

SEQ ID NO: 2186 - DNA, 20 bp, Chlamydia pneumoniae
ggcaccaagaagaaatccga

SEQ ID NO: 2187 - DNA, 20 bp, Chlamydia pneumoniae
agagtctcgcgatccaaaga

SEQ ID NO: 2188 - DNA, 20 bp, Chlamydia pneumoniae
gcgatgcatccccatagaaa

SEQ ID NO: 2189 - DNA, 20 bp, Chlamydia pneumoniae
ttctagctgagatgagcctc

SEQ ID NO: 2190 - DNA, 20 bp, Chlamydia pneumoniae
taaatagacagggccgtctc

SEQ ID NO: 2191 - DNA, 20 bp, Chlamydia pneumoniae
ggggcaagcgttgaaatttg

SEQ ID NO: 2192 - DNA, 20 bp, Chlamydia pneumoniae
ctgacaatgataccggggat

SEQ ID NO: 2193 - DNA, 20 bp, Chlamydia pneumoniae
ggcgtaatacggacttcaca

SEQ ID NO: 2194 - DNA, 20 bp, Chlamydia pneumoniae
gtgctgtcatcaacgctcta

SEQ ID NO: 2195 - DNA, 20 bp, Chlamydia pneumoniae
ttcggactcctgatgctccg

SEQ ID NO: 2196 - DNA, 20 bp, Chlamydia pneumoniae
ccgtgttttacgataggctc

SEQ ID NO: 2197 - DNA, 20 bp, Chlamydia pneumoniae
cggaatctctctctagactg

SEQ ID NO: 2198 - DNA, 20 bp, Chlamydia pneumoniae
cgcctgggaaaagtcatcaa

SEQ ID NO: 2199 - DNA, 20 bp, Chlamydia pneumoniae
tgttggtggtgaagatcgag

SEQ ID NO: 2200 - DNA, 20 bp, Chlamydia pneumoniae
cgcctgggaaaagtcatcaa

SEQ ID NO: 2201 - DNA, 20 bp, Chlamydia pneumoniae
ttggggatagaggttccgtt

SEQ ID NO: 2202 - DNA, 20 bp, Chlamydia pneumoniae
ccgcaacttttttagcaggc

SEQ ID NO: 2203 - DNA, 20 bp, Chlamydia pneumoniae
ctgaaaaagcctgcacagga

SEQ ID NO: 2204 - DNA, 20 bp, Chlamydia pneumoniae
ggctgacgcctctaaaagat

SEQ ID NO: 2205 - DNA, 20 bp, Chlamydia pneumoniae
gatccctcttcaatactacg

SEQ ID NO: 2206 - DNA, 20 bp, Chlamydia pneumoniae
gcctaagaggacaatgcgtt

SEQ ID NO: 2207 - DNA, 20 bp, Chlamydia pneumoniae
gccatgctttctcgtagctg

SEQ ID NO: 2208 - DNA, 20 bp, Chlamydia pneumoniae
ccagaggcttgagcatgaaa

SEQ ID NO: 2209 - DNA, 20 bp, Chlamydia pneumoniae
cgctctcttagctgtagtct

SEQ ID NO: 2210 - DNA, 20 bp, Chlamydia pneumoniae
cgctcttcaggatctgcccc

SEQ ID NO: 2211 - DNA, 20 bp, Chlamydia pneumoniae
cgaacaccaaaacctgaagc

SEQ ID NO: 2212 - DNA, 20 bp, Chlamydia pneumoniae
ggtgaagagagaactcacca

SEQ ID NO: 2213 - DNA, 20 bp, Chlamydia pneumoniae
ggtctaaacctccagagtca

SEQ ID NO: 2214 - DNA, 20 bp, Chlamydia pneumoniae
cgccctggaaatttcttagc

SEQ ID NO: 2215 - DNA, 20 bp, Chlamydia pneumoniae
gacatgagggaatctccttg

SEQ ID NO: 2216 - DNA, 20 bp, Chlamydia pneumoniae
ggccttgaatcgctgtgtct

SEQ ID NO: 2217 - DNA, 20 bp, Chlamydia pneumoniae
ttatgcctctgatccttgcg

SEQ ID NO: 2218 - DNA, 20 bp, Chlamydia pneumoniae
cctacctgaagttctcccta

SEQ ID NO: 2219 - DNA, 20 bp, Chlamydia pneumoniae
gcaagcagatagagcttctt

SEQ ID NO: 2220 - DNA, 20 bp, Chlamydia pneumoniae
ccgcctatctcgagaattca

SEQ ID NO: 2221 - DNA, 20 bp, Chlamydia pneumoniae
ctgagaatcctgagatactc

SEQ ID NO: 2222 - DNA, 20 bp, Chlamydia pneumoniae
ggagttacgtacagaagagc

SEQ ID NO: 2223 - DNA, 20 bp, Chlamydia pneumoniae
gaggagcggactaaaatctc

SEQ ID NO: 2224 - DNA, 20 bp, Chlamydia pneumoniae
cacctcaggagctgatgtta

SEQ ID NO: 2225 - DNA, 20 bp, Chlamydia pneumoniae
agatggccctaaatgccgat

SEQ ID NO: 2226 - DNA, 20 bp, Chlamydia pneumoniae
cctggcaactctcgcataaa

SEQ ID NO: 2227 - DNA, 20 bp, Chlamydia pneumoniae
ccgtagcccctcttattctt

SEQ ID NO: 2228 - DNA, 20 bp, Chlamydia pneumoniae
gaggacacggccctgaaacg

SEQ ID NO: 2229 - DNA, 20 bp, Chlamydia pneumoniae
ccagattacgctcctttcac

SEQ ID NO: 2230 - DNA, 20 bp, Chlamydia pneumoniae
cgaagaactgcctatgcaaa

SEQ ID NO: 2231 - DNA, 20 bp, Chlamydia pneumoniae
aagcagagaggcgattcccc

SEQ ID NO: 2232 - DNA, 20 bp, Chlamydia pneumoniae
gtctgtacgtgttcgcgttt

SEQ ID NO: 2233 - DNA, 20 bp, Chlamydia pneumoniae
catcgcctccacgagtattg

SEQ ID NO: 2234 - DNA, 20 bp, Chlamydia pneumoniae
gggttgtttaacctcacctc

SEQ ID NO: 2235 - DNA, 20 bp, Chlamydia pneumoniae
gttagctcttagtggttgcg

SEQ ID NO: 2236 - DNA, 20 bp, Chlamydia pneumoniae
gccctctcgttctaacagaa

SEQ ID NO: 2237 - DNA, 20 bp, Chlamydia pneumoniae
gagacggtctctttgcttgt

SEQ ID NO: 2238 - DNA, 20 bp, Chlamydia pneumoniae
cccaatccctcccataactt

SEQ ID NO: 2239 - DNA, 20 bp, Chlamydia pneumoniae
gtggatcatcatcatcccag

SEQ ID NO: 2240 - DNA, 20 bp, Chlamydia pneumoniae
ttctcaaaacatcgtgcagc

SEQ ID NO: 2241 - DNA, 20 bp, Chlamydia pneumoniae
atgacgtaccggcaatacga

SEQ ID NO: 2242 - DNA, 20 bp, Chlamydia pneumoniae
cgactacggacctaaagaac

SEQ ID NO: 2243 - DNA, 20 bp, Chlamydia pneumoniae
cctcgtgaaattcctgacac

SEQ ID NO: 2244 - DNA, 20 bp, Chlamydia pneumoniae
cacacaactcgccgcatccg

SEQ ID NO: 2245 - DNA, 20 bp, Chlamydia pneumoniae
cgcgtttgctgtagcataac

SEQ ID NO: 2246 - DNA, 20 bp, Chlamydia pneumoniae
ggattcgtcaaacaacctcc

SEQ ID NO: 2247 - DNA, 20 bp, Chlamydia pneumoniae
gctcggcacttacttcaaga

SEQ ID NO: 2248 - DNA, 20 bp, Chlamydia pneumoniae
caggacctttagcaagccga

SEQ ID NO: 2249 - DNA, 20 bp, Chlamydia pneumoniae
aaaccatccacacaactcgc

SEQ ID NO: 2250 - DNA, 20 bp, Chlamydia pneumoniae
agcacaccctagaagggtat

SEQ ID NO: 2251 - DNA, 20 bp, Chlamydia pneumoniae
ggcggattcatgctaaagat

SEQ ID NO: 2252 - DNA, 20 bp, Chlamydia pneumoniae
ccctaacgccgaaaacttct

SEQ ID NO: 2253 - DNA, 20 bp, Chlamydia pneumoniae
tggatacggagggggcatga

SEQ ID NO: 2254 - DNA, 20 bp, Chlamydia pneumoniae
cagctcgtttactccatctc

SEQ ID NO: 2255 - DNA, 20 bp, Chlamydia pneumoniae
ggtgcggaactcatcacaat

SEQ ID NO: 2256 - DNA, 20 bp, Chlamydia pneumoniae
gagctctagatgacgtagtg

SEQ ID NO: 2257 - DNA, 20 bp, Chlamydia pneumoniae
gagccgctcatacacctttt

SEQ ID NO: 2258 - DNA, 20 bp, Chlamydia pneumoniae
gggcagactttggagagcta

SEQ ID NO: 2259 - DNA, 20 bp, Chlamydia pneumoniae
ccctaacgccgaaaacttct

SEQ ID NO: 2260 - DNA, 20 bp, Chlamydia pneumoniae
ctctggttacctctccagta

SEQ ID NO: 2261 - DNA, 20 bp, Chlamydia pneumoniae
ggctcttcaagagcaacaag

SEQ ID NO: 2262 - DNA, 20 bp, Chlamydia pneumoniae
ggcatcagagactgtaagtg

SEQ ID NO: 2263 - DNA, 20 bp, Chlamydia pneumoniae
gctaatagcctcacaagcag

SEQ ID NO: 2264 - DNA, 20 bp, Chlamydia pneumoniae
ggctacaaaagcggatgaag

SEQ ID NO: 2265 - DNA, 20 bp, Chlamydia pneumoniae
ggcatcagagactgtaagtg

SEQ ID NO: 2266 - DNA, 20 bp, Chlamydia pneumoniae
cccaaggagtcaaatccgaa

SEQ ID NO: 2267 - DNA, 20 bp, Chlamydia pneumoniae
cagcacatcccctcatgatg

SEQ ID NO: 2268 - DNA, 20 bp, Chlamydia pneumoniae
cttatcttggcacgcataga

SEQ ID NO: 2269 - DNA, 20 bp, Chlamydia pneumoniae
catggaagctgcttcgctat

SEQ ID NO: 2270 - DNA, 20 bp, Chlamydia pneumoniae
gcgcaatcactataaaccat

SEQ ID NO: 2271 - DNA, 20 bp, Chlamydia pneumoniae
tttcgtgtggaagaagttcc

SEQ ID NO: 2272 - DNA, 20 bp, Chlamydia pneumoniae
gaggtttataacccatccgc

SEQ ID NO: 2273 - DNA, 20 bp, Chlamydia pneumoniae
gaagcggctacaaaagcgga

SEQ ID NO: 2274 - DNA, 20 bp, Chlamydia pneumoniae
acacagccttacctccccct

SEQ ID NO: 2275 - DNA, 20 bp, Chlamydia pneumoniae
accgtcaaagcaagagacag

SEQ ID NO: 2276 - DNA, 20 bp, Chlamydia pneumoniae
atatcgacagcgaaaggctg

SEQ ID NO: 2277 - DNA, 20 bp, Chlamydia pneumoniae
ccgtctcatcaagactttgg

SEQ ID NO: 2278 - DNA, 20 bp, Chlamydia pneumoniae
cgggaagagctgctatttcc

SEQ ID NO: 2279 - DNA, 20 bp, Chlamydia pneumoniae
agaggagtgtgcggtcagca

SEQ ID NO: 2280 - DNA, 20 bp, Chlamydia pneumoniae
cgcacgttcggacataagaa

SEQ ID NO: 2281 - DNA, 20 bp, Chlamydia pneumoniae
ctggatcacaggattgatcg

SEQ ID NO: 2282 - DNA, 20 bp, Chlamydia pneumoniae
ctcactcgagggaagttttc

SEQ ID NO: 2283 - DNA, 20 bp, Chlamydia pneumoniae
tgccccttcgaaaaggatca

SEQ ID NO: 2284 - DNA, 20 bp, Chlamydia pneumoniae
cctaacgaaaccaacgatcc

SEQ ID NO: 2285 - DNA, 20 bp, Chlamydia pneumoniae
gggaaaacgccaagaagagc

SEQ ID NO: 2286 - DNA, 20 bp, Chlamydia pneumoniae
gggaaactcacgctctaaag

SEQ ID NO: 2287 - DNA, 20 bp, Chlamydia pneumoniae
ctggggagatgatgagttag

SEQ ID NO: 2288 - DNA, 20 bp, Chlamydia pneumoniae
ctcctacgtattgacggaac

SEQ ID NO: 2289 - DNA, 20 bp, Chlamydia pneumoniae
gcgtttacctgcggaggaag

SEQ ID NO: 2290 - DNA, 20 bp, Chlamydia pneumoniae
ggctacatagacgtgtttcg

SEQ ID NO: 2291 - DNA, 20 bp, Chlamydia pneumoniae
tggccgctcctacaaccctt

SEQ ID NO: 2292 - DNA, 20 bp, Chlamydia pneumoniae
cggaggacttgcttttggtt

SEQ ID NO: 2293 - DNA, 20 bp, Chlamydia pneumoniae
tccctccaacgatagtttgc

SEQ ID NO: 2294 - DNA, 20 bp, Chlamydia pneumoniae
ggcaagagcaattctatggg

SEQ ID NO: 2295 - DNA, 20 bp, Chlamydia pneumoniae
cctatcctttgggaaggact

SEQ ID NO: 2296 - DNA, 20 bp, Chlamydia pneumoniae
ggctgggtcttacttgtcat

SEQ ID NO: 2297 - DNA, 20 bp, Chlamydia pneumoniae
cagttcgattctgcctatgc

SEQ ID NO: 2298 - DNA, 20 bp, Chlamydia pneumoniae
ggcctcattgctatggcttt

SEQ ID NO: 2299 - DNA, 20 bp, Chlamydia pneumoniae
ctctgaggtttcctatcctg

SEQ ID NO: 2300 - DNA, 20 bp, Chlamydia pneumoniae
cagagtctcagttgagaacc

SEQ ID NO: 2301 - DNA, 20 bp, Chlamydia pneumoniae
gaaactccaggtttaggagc

SEQ ID NO: 2302 - DNA, 20 bp, Chlamydia pneumoniae
ggactagctggatccataga

SEQ ID NO: 2303 - DNA, 20 bp, Chlamydia pneumoniae
ctcctgacagtgtgagaatg

SEQ ID NO: 2304 - DNA, 20 bp, Chlamydia pneumoniae
caccttctggagcttcgtta

SEQ ID NO: 2305 - DNA, 20 bp, Chlamydia pneumoniae
gaactccttatggggtttcg

SEQ ID NO: 2306 - DNA, 20 bp, Chlamydia pneumoniae
gctatactccttagggagtc

SEQ ID NO: 2307 - DNA, 20 bp, Chlamydia pneumoniae
cggggaacgtacttaggtaa

SEQ ID NO: 2308 - DNA, 20 bp, Chlamydia pneumoniae
ggagaagagctcttttgcac

SEQ ID NO: 2309 - DNA, 20 bp, Chlamydia pneumoniae
gctttcatgcgctaccttag

SEQ ID NO: 2310 - DNA, 20 bp, Chlamydia pneumoniae
agagaatcgtccccaaccca

SEQ ID NO: 2311 - DNA, 20 bp, Chlamydia pneumoniae
ccccctgttctataaagcgt

SEQ ID NO: 2312 - DNA, 20 bp, Chlamydia pneumoniae
gataccgtttcccatagagc

SEQ ID NO: 2313 - DNA, 20 bp, Chlamydia pneumoniae
gctctgcttaggaacttgct

SEQ ID NO: 2314 - DNA, 20 bp, Chlamydia pneumoniae
cctggagtgcacataaactc

SEQ ID NO: 2315 - DNA, 20 bp, Chlamydia pneumoniae
cggactcagagatctctaaa

SEQ ID NO: 2316 - DNA, 20 bp, Chlamydia pneumoniae
agcgttcggcctcctgtcat

SEQ ID NO: 2317 - DNA, 20 bp, Chlamydia pneumoniae
atttgctgcggtactccaac

SEQ ID NO: 2318 - DNA, 20 bp, Chlamydia pneumoniae
gccgctgaagattttcctga

SEQ ID NO: 2319 - DNA, 20 bp, Chlamydia pneumoniae
cgacttctggagattcgata

SEQ ID NO: 2320 - DNA, 20 bp, Chlamydia pneumoniae
tcccagactctgtgatttcc

SEQ ID NO: 2321 - DNA, 20 bp, Chlamydia pneumoniae
ccaagagaggttcgtaagga

SEQ ID NO: 2322 - DNA, 20 bp, Chlamydia pneumoniae
cgctatcctcttcccaattc

SEQ ID NO: 2323 - DNA, 20 bp, Chlamydia pneumoniae
gctcacagaagctgaaagtg

SEQ ID NO: 2324 - DNA, 20 bp, Chlamydia pneumoniae
cagcagctccatacgacagt

SEQ ID NO: 2325 - DNA, 20 bp, Chlamydia pneumoniae
gcttgaagtcccatatggac

SEQ ID NO: 2326 - DNA, 20 bp, Chlamydia pneumoniae
cagaaacagccgaaacggaa

SEQ ID NO: 2327 - DNA, 20 bp, Chlamydia pneumoniae
ccctgatgttgccctacaat

SEQ ID NO: 2328 - DNA, 20 bp, Chlamydia pneumoniae
ctctgctcaggtacaatacc

SEQ ID NO: 2329 - DNA, 20 bp, Chlamydia pneumoniae
aggaaacgagcgaacactct

SEQ ID NO: 2330 - DNA, 20 bp, Chlamydia pneumoniae
cggttggtctattgggaatg

SEQ ID NO: 2331 - DNA, 20 bp, Chlamydia pneumoniae
gggagaagattcgacctgaa

SEQ ID NO: 2332 - DNA, 20 bp, Chlamydia pneumoniae
ccctctcataagcgagtctt

SEQ ID NO: 2333 - DNA, 20 bp, Chlamydia pneumoniae
gcgaaaaaggaatcgatcca

SEQ ID NO: 2334 - DNA, 20 bp, Chlamydia pneumoniae
cagccaagcgtggtaaaacg

SEQ ID NO: 2335 - DNA, 20 bp, Chlamydia pneumoniae
tcgctgcatttgcgggacac

SEQ ID NO: 2336 - DNA, 20 bp, Chlamydia pneumoniae
ctgctatcgtcgttcctatc

SEQ ID NO: 2337 - DNA, 20 bp, Chlamydia pneumoniae
ctggctatataggtgcggat

SEQ ID NO: 2338 - DNA, 20 bp, Chlamydia pneumoniae
ctcccctacccttaagcatt

SEQ ID NO: 2339 - DNA, 20 bp, Chlamydia pneumoniae
ggtcttaggagctcttaagg

SEQ ID NO: 2340 - DNA, 20 bp, Chlamydia pneumoniae
cattcagccaactctttggc

SEQ ID NO: 2341 - DNA, 20 bp, Chlamydia pneumoniae
gcccgagtaattcttcagca

SEQ ID NO: 2342 - DNA, 20 bp, Chlamydia pneumoniae
gcaaactgtggaactcgtta

SEQ ID NO: 2343 - DNA, 20 bp, Chlamydia pneumoniae
cttagaggctattgatgggg

SEQ ID NO: 2344 - DNA, 20 bp, Chlamydia pneumoniae
tgaaacccactacgggtatc

SEQ ID NO: 2345 - DNA, 20 bp, Chlamydia pneumoniae
agggtatcagagggggaggg

SEQ ID NO: 2346 - DNA, 20 bp, Chlamydia pneumoniae
agcgatgctaactggatggc

SEQ ID NO: 2347 - DNA, 20 bp, Chlamydia pneumoniae
acagcactgacaactgttcg

SEQ ID NO: 2348 - DNA, 20 bp, Chlamydia pneumoniae
gaagtacgaagttcttcacg

SEQ ID NO: 2349 - DNA, 20 bp, Chlamydia pneumoniae
gctggaggtcctactctatt

SEQ ID NO: 2350 - DNA, 20 bp, Chlamydia pneumoniae
agctgcttatgagcttcgtg

SEQ ID NO: 2351 - DNA, 20 bp, Chlamydia pneumoniae
ggagagactcctactcttac

SEQ ID NO: 2352 - DNA, 20 bp, Chlamydia pneumoniae
gacgaggagaagtcgaaaga

SEQ ID NO: 2353 - DNA, 20 bp, Chlamydia pneumoniae
ctcttggtggagacatcact

SEQ ID NO: 2354 - DNA, 20 bp, Chlamydia pneumoniae
cgagagtgacaccacgttta

SEQ ID NO: 2355 - DNA, 20 bp, Chlamydia pneumoniae
ggatctctcttctcgatggt

SEQ ID NO: 2356 - DNA, 20 bp, Chlamydia pneumoniae
gcaactctaatctttgcagc

SEQ ID NO: 2357 - DNA, 20 bp, Chlamydia pneumoniae
cgtggaaaactacaggaacg

SEQ ID NO: 2358 - DNA, 20 bp, Chlamydia pneumoniae
gccgtattagcagtaatcgg

SEQ ID NO: 2359 - DNA, 20 bp, Chlamydia pneumoniae
ccgtctctgcaactctaatc

SEQ ID NO: 2360 - DNA, 20 bp, Chlamydia pneumoniae
gcgctcgatttattcccttc

SEQ ID NO: 2361 - DNA, 20 bp, Chlamydia pneumoniae
cttcacccctataggcaaag

SEQ ID NO: 2362 - DNA, 20 bp, Chlamydia pneumoniae
cctgtgttagtacttccgtc

SEQ ID NO: 2363 - DNA, 20 bp, Chlamydia pneumoniae
tgcacctccgatagcatatc

SEQ ID NO: 2364 - DNA, 20 bp, Chlamydia pneumoniae
ccctagttcttctagggagt

SEQ ID NO: 2365 - DNA, 20 bp, Chlamydia pneumoniae
ctctggaggctttacagagt

SEQ ID NO: 2366 - DNA, 20 bp, Chlamydia pneumoniae
aggtccctctatgcacacat

SEQ ID NO: 2367 - DNA, 20 bp, Chlamydia pneumoniae
gatgttggtaccaaactccg

SEQ ID NO: 2368 - DNA, 20 bp, Chlamydia pneumoniae
cgaggcacaagcatcacaat

SEQ ID NO: 2369 - DNA, 20 bp, Chlamydia pneumoniae
cggcgccatatctacccaca

SEQ ID NO: 2370 - DNA, 20 bp, Chlamydia pneumoniae
gagccctctatggcaaaaag

SEQ ID NO: 2371 - DNA, 20 bp, Chlamydia pneumoniae
ctccaggaaccactctgctc

SEQ ID NO: 2372 - DNA, 20 bp, Chlamydia pneumoniae
cgtcacaatcctgattgcga

SEQ ID NO: 2373 - DNA, 20 bp, Chlamydia pneumoniae
gcgctatctatgctaacgga

SEQ ID NO: 2374 - DNA, 20 bp, Chlamydia pneumoniae
ccttattagggaagggcctt

SEQ ID NO: 2375 - DNA, 20 bp, Chlamydia pneumoniae
ccaagtttgccactctagga

SEQ ID NO: 2376 - DNA, 20 bp, Chlamydia pneumoniae
aggagcctctgctctccaac

SEQ ID NO: 2377 - DNA, 20 bp, Chlamydia pneumoniae
ctcgctttaagaaacggtgc

SEQ ID NO: 2378 - DNA, 20 bp, Chlamydia pneumoniae
ctcctagcgcaaatactctc

SEQ ID NO: 2379 - DNA, 20 bp, Chlamydia pneumoniae
gaggcatgcctctttctttc

SEQ ID NO: 2380 - DNA, 20 bp, Chlamydia pneumoniae
ccccctctctcaagtctatt

SEQ ID NO: 2381 - DNA, 20 bp, Chlamydia pneumoniae
cgttccaaggaaacatgctc

SEQ ID NO: 2382 - DNA, 20 bp, Chlamydia pneumoniae
cgacaactacgtctttctcc

SEQ ID NO: 2383 - DNA, 20 bp, Chlamydia pneumoniae
ctttcgggcagctttatgga

SEQ ID NO: 2384 - DNA, 20 bp, Chlamydia pneumoniae
gcctgtaaagcagagtatcc

SEQ ID NO: 2385 - DNA, 20 bp, Chlamydia pneumoniae
aggagtgctcctaactgctc

SEQ ID NO: 2386 - DNA, 20 bp, Chlamydia pneumoniae
ggagacctgagaaaggttgt

SEQ ID NO: 2387 - DNA, 20 bp, Chlamydia pneumoniae
gcggattgcagcatctaaag

SEQ ID NO: 2388 - DNA, 20 bp, Chlamydia pneumoniae
cgaacggtagaaatccaaga

SEQ ID NO: 2389 - DNA, 20 bp, Chlamydia pneumoniae
cgaacggaatctccagatcg

SEQ ID NO: 2390 - DNA, 20 bp, Chlamydia pneumoniae
ctctgagatcccaaaatccc

SEQ ID NO: 2391 - DNA, 20 bp, Chlamydia pneumoniae
cgatctccaaagaactgacg

SEQ ID NO: 2392 - DNA, 20 bp, Chlamydia pneumoniae
ccctgacagggaattctgaa

SEQ ID NO: 2393 - DNA, 20 bp, Chlamydia pneumoniae
tgcgtttcattcgcgagact

SEQ ID NO: 2394 - DNA, 20 bp, Chlamydia pneumoniae
catctgccaagttcttcgct

SEQ ID NO: 2395 - DNA, 20 bp, Chlamydia pneumoniae
taaccactccatccccatga

SEQ ID NO: 2396 - DNA, 20 bp, Chlamydia pneumoniae
cgtgggatacctaagagaaa

SEQ ID NO: 2397 - DNA, 20 bp, Chlamydia pneumoniae
cggcctgtttaattacagcg

SEQ ID NO: 2398 - DNA, 20 bp, Chlamydia pneumoniae
cctgttggattaccgcattg

SEQ ID NO: 2399 - DNA, 20 bp, Chlamydia pneumoniae
gggacaatccttcttccaga

SEQ ID NO: 2400 - DNA, 20 bp, Chlamydia pneumoniae
gagaaccaagaggacgtgta

SEQ ID NO: 2401 - DNA, 20 bp, Chlamydia pneumoniae
ttgagctgagtcacaagctg

SEQ ID NO: 2402 - DNA, 20 bp, Chlamydia pneumoniae
cctgctgagatattctgagg

SEQ ID NO: 2403 - DNA, 20 bp, Chlamydia pneumoniae
tccacgtctctgacggactg

SEQ ID NO: 2404 - DNA, 20 bp, Chlamydia pneumoniae
cggatgtgcagattttctac

SEQ ID NO: 2405 - DNA, 20 bp, Chlamydia pneumoniae
gaagtcgaaccctaagctgt

SEQ ID NO: 2406 - DNA, 20 bp, Chlamydia pneumoniae
gcaaagagcttgatcctctg

SEQ ID NO: 2407 - DNA, 20 bp, Chlamydia pneumoniae
gattcgcctgcgtaatcagt

SEQ ID NO: 2408 - DNA, 20 bp, Chlamydia pneumoniae
cctagtctggctcacagaaa

SEQ ID NO: 2409 - DNA, 20 bp, Chlamydia pneumoniae
gggaggcatattttctaccc

SEQ ID NO: 2410 - DNA, 20 bp, Chlamydia pneumoniae
ggatgactcctgcagtgtat

SEQ ID NO: 2411 - DNA, 20 bp, Chlamydia pneumoniae
atcctccatacagaaacgcc

SEQ ID NO: 2412 - DNA, 20 bp, Chlamydia pneumoniae
ctcgacatctacgcaccatc

SEQ ID NO: 2413 - DNA, 20 bp, Chlamydia pneumoniae
ccatagacgataaccctgga

SEQ ID NO: 2414 - DNA, 20 bp, Chlamydia pneumoniae
ggggctatacatgcactaga

SEQ ID NO: 2415 - DNA, 20 bp, Chlamydia pneumoniae
cgatccctacgacagtatag

SEQ ID NO: 2416 - DNA, 20 bp, Chlamydia pneumoniae
cgcagcattaatcaggacga

SEQ ID NO: 2417 - DNA, 20 bp, Chlamydia pneumoniae
caaatcggtgtcacgctact

SEQ ID NO: 2418 - DNA, 20 bp, Chlamydia pneumoniae
tcacgacactactcatcagc

SEQ ID NO: 2419 - DNA, 20 bp, Chlamydia pneumoniae
gccctaggagtcattatctc

SEQ ID NO: 2420 - DNA, 20 bp, Chlamydia pneumoniae
ggaacaacctcaaacactgc

SEQ ID NO: 2421 - DNA, 20 bp, Chlamydia pneumoniae
cctcgatcaccagaattcca

SEQ ID NO: 2422 - DNA, 20 bp, Chlamydia pneumoniae
cctcatcaacgacgacacat

SEQ ID NO: 2423 - DNA, 20 bp, Chlamydia pneumoniae
caggaattgcagccttcgat

SEQ ID NO: 2424 - DNA, 20 bp, Chlamydia pneumoniae
ctccgattcctgatgccata

SEQ ID NO: 2425 - DNA, 20 bp, Chlamydia pneumoniae
agggggaacggctcatatct

SEQ ID NO: 2426 - DNA, 20 bp, Chlamydia pneumoniae
cgatcgacttctatccccat

SEQ ID NO: 2427 - DNA, 20 bp, Chlamydia pneumoniae
gcctgacctctcctgtaaaa

SEQ ID NO: 2428 - DNA, 20 bp, Chlamydia pneumoniae
acgagacccccataccctcc

SEQ ID NO: 2429 - DNA, 20 bp, Chlamydia pneumoniae
ggatacgatctctaaagccc

SEQ ID NO: 2430 - DNA, 20 bp, Chlamydia pneumoniae
gccaccaactgccataattg

SEQ ID NO: 2431 - DNA, 20 bp, Chlamydia pneumoniae
gccgaagaagagctctgaga

SEQ ID NO: 2432 - DNA, 20 bp, Chlamydia pneumoniae
ggaatttggtactggcgaga

SEQ ID NO: 2433 - DNA, 20 bp, Chlamydia pneumoniae
atcttgagccgcctacgcca

SEQ ID NO: 2434 - DNA, 20 bp, Chlamydia pneumoniae
ggataagaaaaagagccccg

SEQ ID NO: 2435 - DNA, 20 bp, Chlamydia pneumoniae
caaaccccaagcgacccctt

SEQ ID NO: 2436 - DNA, 20 bp, Chlamydia pneumoniae
cagaagtcactgcaagcccc

SEQ ID NO: 2437 - DNA, 20 bp, Chlamydia pneumoniae
ggtcacttcatgacgactgt

SEQ ID NO: 2438 - DNA, 20 bp, Chlamydia pneumoniae
caggacctcttggtaaccta

SEQ ID NO: 2439 - DNA, 20 bp, Chlamydia pneumoniae
gggcaacatgaatcaagcgg

SEQ ID NO: 2440 - DNA, 20 bp, Chlamydia pneumoniae
gtggaagctgagggtgtttt

SEQ ID NO: 2441 - DNA, 20 bp, Chlamydia pneumoniae
ctggtccacctgttcaatca

SEQ ID NO: 2442 - DNA, 20 bp, Chlamydia pneumoniae
cgggatttcctgtgcctaaa

SEQ ID NO: 2443 - DNA, 20 bp, Chlamydia pneumoniae
ggaagaggagagagcaaacg

SEQ ID NO: 2444 - DNA, 20 bp, Chlamydia pneumoniae
gtacgggtaggccttgaaat

SEQ ID NO: 2445 - DNA, 20 bp, Chlamydia pneumoniae
cacggctggaaaagatttcc

SEQ ID NO: 2446 - DNA, 20 bp, Chlamydia pneumoniae
cgacctgtgggaaaatgaca

SEQ ID NO: 2447 - DNA, 20 bp, Chlamydia pneumoniae
atcccgcaatcaaaggggct

SEQ ID NO: 2448 - DNA, 20 bp, Chlamydia pneumoniae
cctgagcatccacatactca

SEQ ID NO: 2449 - DNA, 20 bp, Chlamydia pneumoniae
gcagaggaaccctgactcat

SEQ ID NO: 2450 - DNA, 20 bp, Chlamydia pneumoniae
gcccgcccaataacaagaat

SEQ ID NO: 2451 - DNA, 20 bp, Chlamydia pneumoniae
tgtgcttcatagcgggcgac

SEQ ID NO: 2452 - DNA, 20 bp, Chlamydia pneumoniae
gcgctctatacgctaaattc

SEQ ID NO: 2453 - DNA, 20 bp, Chlamydia pneumoniae
ctcagcacagttatatcccc

SEQ ID NO: 2454 - DNA, 20 bp, Chlamydia pneumoniae
tgacggggtgattctttctc

SEQ ID NO: 2455 - DNA, 20 bp, Chlamydia pneumoniae
ggaacagaggttgccataag

SEQ ID NO: 2456 - DNA, 20 bp, Chlamydia pneumoniae
ggctaacgacgtcgctgcta

SEQ ID NO: 2457 - DNA, 20 bp, Chlamydia pneumoniae
gcagaaatggctgaactcct

SEQ ID NO: 2458 - DNA, 20 bp, Chlamydia pneumoniae
ctctcttatcgacctgctct

SEQ ID NO: 2459 - DNA, 20 bp, Chlamydia pneumoniae
ctttaggaatgggtggaacg

SEQ ID NO: 2460 - DNA, 20 bp, Chlamydia pneumoniae
gtgatggagataacgtccag

SEQ ID NO: 2461 - DNA, 20 bp, Chlamydia pneumoniae
taacagccaattggaagaac

SEQ ID NO: 2462 - DNA, 20 bp, Chlamydia pneumoniae
agcttcctaccaatctcacg

SEQ ID NO: 2463 - DNA, 20 bp, Chlamydia pneumoniae
gacaacacactgacaggcta

SEQ ID NO: 2464 - DNA, 20 bp, Chlamydia pneumoniae
cctatgccctcttctgaaac

SEQ ID NO: 2465 - DNA, 20 bp, Chlamydia pneumoniae
ctacggtgctgagcttaaag

SEQ ID NO: 2466 - DNA, 20 bp, Chlamydia pneumoniae
cgatcatgagctaactctgg

SEQ ID NO: 2467 - DNA, 20 bp, Chlamydia pneumoniae
ctctcgcgatcttctacctt

SEQ ID NO: 2468 - DNA, 20 bp, Chlamydia pneumoniae
gatacccatcggcaattcca

SEQ ID NO: 2469 - DNA, 20 bp, Chlamydia pneumoniae
ctctgagcttacgctcttca

SEQ ID NO: 2470 - DNA, 20 bp, Chlamydia pneumoniae
cctccattgtaaccagagag

SEQ ID NO: 2471 - DNA, 20 bp, Chlamydia pneumoniae
ttccacgcctctcgacgttc

SEQ ID NO: 2472 - DNA, 20 bp, Chlamydia pneumoniae
cgaaggagaggtcctcattg

SEQ ID NO: 2473 - DNA, 20 bp, Chlamydia pneumoniae
cggtcacggaaggattttcg

SEQ ID NO: 2474 - DNA, 20 bp, Chlamydia pneumoniae
cctaccacacaagaatctgg

SEQ ID NO: 2475 - DNA, 20 bp, Chlamydia pneumoniae
gcacgttggcaactttctct

SEQ ID NO: 2476 - DNA, 20 bp, Chlamydia pneumoniae
cttcctaatcggacctgtag

SEQ ID NO: 2477 - DNA, 20 bp, Chlamydia pneumoniae
cgctagtcttagaagcgcaa

SEQ ID NO: 2478 - DNA, 20 bp, Chlamydia pneumoniae
gctgtcttcatcgtaaagac

SEQ ID NO: 2479 - DNA, 20 bp, Chlamydia pneumoniae
cctaatcgctggggattatg

SEQ ID NO: 2480 - DNA, 20 bp, Chlamydia pneumoniae
tctggagaaggattcctacc

SEQ ID NO: 2481 - DNA, 20 bp, Chlamydia pneumoniae
cggttcacgaatgaattggc

SEQ ID NO: 2482 - DNA, 20 bp, Chlamydia pneumoniae
acctcccgccatctctttat

SEQ ID NO: 2483 - DNA, 20 bp, Chlamydia pneumoniae
gctgtcttcatcgtaaagac

SEQ ID NO: 2484 - DNA, 20 bp, Chlamydia pneumoniae
gcctgtagcgtggattacaa

SEQ ID NO: 2485 - DNA, 20 bp, Chlamydia pneumoniae
gtttcgcaaggagaatccag

SEQ ID NO: 2486 - DNA, 20 bp, Chlamydia pneumoniae
gctgtgagttaggctatacg

SEQ ID NO: 2487 - DNA, 20 bp, Chlamydia pneumoniae
ctaggtctacaggatcctgt

SEQ ID NO: 2488 - DNA, 20 bp, Chlamydia pneumoniae
gcgccgtcattgcgaacaat

SEQ ID NO: 2489 - DNA, 20 bp, Chlamydia pneumoniae
gcgattgtcaccttaggaac

SEQ ID NO: 2490 - DNA, 20 bp, Chlamydia pneumoniae
ctgacgacatagtactacaa

SEQ ID NO: 2491 - DNA, 20 bp, Chlamydia pneumoniae
gggaaaggattgtaccgaga

SEQ ID NO: 2492 - DNA, 20 bp, Chlamydia pneumoniae
gatcgagatgaaagactcgg

SEQ ID NO: 2493 - DNA, 20 bp, Chlamydia pneumoniae
ttacctcttctggattcggg

SEQ ID NO: 2494 - DNA, 20 bp, Chlamydia pneumoniae
cgagatggctagatccaaag

SEQ ID NO: 2495 - DNA, 20 bp, Chlamydia pneumoniae
ctcttgacgatcaatcactg

SEQ ID NO: 2496 - DNA, 20 bp, Chlamydia pneumoniae
gagctttaggtatcctaggc

SEQ ID NO: 2497 - DNA, 20 bp, Chlamydia pneumoniae
cccttgtcgtaaaactctcc

SEQ ID NO: 2498 - DNA, 20 bp, Chlamydia pneumoniae
gccctcggattcaacatgat

SEQ ID NO: 2499 - DNA, 20 bp, Chlamydia pneumoniae
gtatctcaagagcttgcgga

SEQ ID NO: 2500 - DNA, 20 bp, Chlamydia pneumoniae
gtcccatggccaaagataac

SEQ ID NO: 2501 - DNA, 20 bp, Chlamydia pneumoniae
cccacctgaaaatgaggaac

SEQ ID NO: 2502 - DNA, 20 bp, Chlamydia pneumoniae
cagtacgaagcctccttcaa

SEQ ID NO: 2503 - DNA, 20 bp, Chlamydia pneumoniae
ctcctgcgtatctgttatgg

SEQ ID NO: 2504 - DNA, 20 bp, Chlamydia pneumoniae
cgcacttacaaaatcggcga

SEQ ID NO: 2505 - DNA, 20 bp, Chlamydia pneumoniae
ggtggagacgactttgatga

SEQ ID NO: 2506 - DNA, 20 bp, Chlamydia pneumoniae
tccgtagcgtcattcgaagc

SEQ ID NO: 2507 - DNA, 20 bp, Chlamydia pneumoniae
catcgtagttctccaaggag

SEQ ID NO: 2508 - DNA, 20 bp, Chlamydia pneumoniae
ggttcattgcagcagcagaa

SEQ ID NO: 2509 - DNA, 20 bp, Chlamydia pneumoniae
ggctttgaatttgagactgc

SEQ ID NO: 2510 - DNA, 20 bp, Chlamydia pneumoniae
gtcccatggagatttctcct

SEQ ID NO: 2511 - DNA, 20 bp, Chlamydia pneumoniae
gagacttcgacgatgccatc

SEQ ID NO: 2512 - DNA, 20 bp, Chlamydia pneumoniae
cacaggtttacctaagaccc

SEQ ID NO: 2513 - DNA, 20 bp, Chlamydia pneumoniae
gctcttccagaatctatccc

SEQ ID NO: 2514 - DNA, 20 bp, Chlamydia pneumoniae
gatcccgcttatcctcatgt

SEQ ID NO: 2515 - DNA, 20 bp, Chlamydia pneumoniae
ccacgcctacaactacagaa

SEQ ID NO: 2516 - DNA, 20 bp, Chlamydia pneumoniae
gcacagaacgaaatgtcgga

SEQ ID NO: 2517 - DNA, 20 bp, Chlamydia pneumoniae
cgcagagcgaaaagtcctaa

SEQ ID NO: 2518 - DNA, 20 bp, Chlamydia pneumoniae
gagtcctactgcaaagctac

SEQ ID NO: 2519 - DNA, 20 bp, Chlamydia pneumoniae
ggttcttacgctcttagagc

SEQ ID NO: 2520 - DNA, 20 bp, Chlamydia pneumoniae
gtttactctcccctacgaac

SEQ ID NO: 2521 - DNA, 20 bp, Chlamydia pneumoniae
ccctaaaccaacgcttcttc

SEQ ID NO: 2522 - DNA, 20 bp, Chlamydia pneumoniae
ccctaagttcagtgacccta

SEQ ID NO: 2523 - DNA, 20 bp, Chlamydia pneumoniae
gtcctgactacagtcccaaa

SEQ ID NO: 2524 - DNA, 20 bp, Chlamydia pneumoniae
atcaggccagggtcatgcca

SEQ ID NO: 2525 - DNA, 20 bp, Chlamydia pneumoniae
gagaacctcatctcgaggga

SEQ ID NO: 2526 - DNA, 20 bp, Chlamydia pneumoniae
cggggtggtatgatcttaca

SEQ ID NO: 2527 - DNA, 20 bp, Chlamydia pneumoniae
cagggtcactcaggcagaca

SEQ ID NO: 2528 - DNA, 20 bp, Chlamydia pneumoniae
ccgacgcctatagctatctc

SEQ ID NO: 2529 - DNA, 20 bp, Chlamydia pneumoniae
gagtacgatcctcagatcca

SEQ ID NO: 2530 - DNA, 20 bp, Chlamydia pneumoniae
gcgggcccagcctcctcata

SEQ ID NO: 2531 - DNA, 20 bp, Chlamydia pneumoniae
cgaagcgttatattgccgca

SEQ ID NO: 2532 - DNA, 20 bp, Chlamydia pneumoniae
cgcagctcagtagtgatgac

SEQ ID NO: 2533 - DNA, 20 bp, Chlamydia pneumoniae
ggcttagactcgaattccga

SEQ ID NO: 2534 - DNA, 20 bp, Chlamydia pneumoniae
gctcggcattctcttctaat

SEQ ID NO: 2535 - DNA, 20 bp, Chlamydia pneumoniae
agtagggaagtcacagagcc

SEQ ID NO: 2536 - DNA, 20 bp, Chlamydia pneumoniae
gctaagtgagcaatcgcaca

SEQ ID NO: 2537 - DNA, 20 bp, Chlamydia pneumoniae
gaactagacgtgtgctcaac

SEQ ID NO: 2538 - DNA, 20 bp, Chlamydia pneumoniae
cctgcgtccacagatccccc

SEQ ID NO: 2539 - DNA, 20 bp, Chlamydia pneumoniae
cagcctgagggacttttgta

SEQ ID NO: 2540 - DNA, 20 bp, Chlamydia pneumoniae
caacgaaaccaccgcaacca

SEQ ID NO: 2541 - DNA, 20 bp, Chlamydia pneumoniae
gtcgcctctacatagacatc

SEQ ID NO: 2542 - DNA, 20 bp, Chlamydia pneumoniae
caactgtaagagctttcgcc

SEQ ID NO: 2543 - DNA, 20 bp, Chlamydia pneumoniae
caccatcatgtggttgtctg

SEQ ID NO: 2544 - DNA, 20 bp, Chlamydia pneumoniae
taccaccatagctattgggc

SEQ ID NO: 2545 - DNA, 20 bp, Chlamydia pneumoniae
gccatatctacccacaagac

SEQ ID NO: 2546 - DNA, 20 bp, Chlamydia pneumoniae
ggaagtgttcttacaggaac

SEQ ID NO: 2547 - DNA, 20 bp, Chlamydia pneumoniae
gcaagacctgtgatcagaga

SEQ ID NO: 2548 - DNA, 20 bp, Chlamydia pneumoniae
gtaggagccattaaggtgac

SEQ ID NO: 2549 - DNA, 20 bp, Chlamydia pneumoniae
ccctaagttcaaggtagcga

SEQ ID NO: 2550 - DNA, 20 bp, Chlamydia pneumoniae
gcgtgaggaacctcatctga

SEQ ID NO: 2551 - DNA, 20 bp, Chlamydia pneumoniae
gcaacagaaaacactccgct

SEQ ID NO: 2552 - DNA, 20 bp, Chlamydia pneumoniae
ggagaaaagaacagagcacg

SEQ ID NO: 2553 - DNA, 20 bp, Chlamydia pneumoniae
cgccttatgcgcgtaaagaa

SEQ ID NO: 2554 - DNA, 20 bp, Chlamydia pneumoniae
gaagcaacctcgtctccctc

SEQ ID NO: 2555 - DNA, 20 bp, Chlamydia pneumoniae
ggaagaacagctacaggact

SEQ ID NO: 2556 - DNA, 20 bp, Chlamydia pneumoniae
ggccgacacttttaatgcca

SEQ ID NO: 2557 - DNA, 20 bp, Chlamydia pneumoniae
gccaaggcctttgcaatact

SEQ ID NO: 2558 - DNA, 20 bp, Chlamydia pneumoniae
gagtgtggaaggaaaccgtt

SEQ ID NO: 2559 - DNA, 20 bp, Chlamydia pneumoniae
ctcagcggacactcccaaat

SEQ ID NO: 2560 - DNA, 20 bp, Chlamydia pneumoniae
gccaaagtcgagtctaagca

SEQ ID NO: 2561 - DNA, 20 bp, Chlamydia pneumoniae
ctaaggtaaccccgacaaac

SEQ ID NO: 2562 - DNA, 20 bp, Chlamydia pneumoniae
gcacatcagaaaatgcgacc

SEQ ID NO: 2563 - DNA, 20 bp, Chlamydia pneumoniae
gactggcttttatagccacg

SEQ ID NO: 2564 - DNA, 20 bp, Chlamydia pneumoniae
cccaccccatttaacaacag

SEQ ID NO: 2565 - DNA, 20 bp, Chlamydia pneumoniae
gcgcaccacattaggattgt

SEQ ID NO: 2566 - DNA, 20 bp, Chlamydia pneumoniae
ggtcaagaccaagttcatgc

SEQ ID NO: 2567 - DNA, 20 bp, Chlamydia pneumoniae
agaaggcaaggctcccacac

SEQ ID NO: 2568 - DNA, 20 bp, Chlamydia pneumoniae
cgacacctttgatcggacta

SEQ ID NO: 2569 - DNA, 20 bp, Chlamydia pneumoniae
atgggtcacacgagctccac

SEQ ID NO: 2570 - DNA, 20 bp, Chlamydia pneumoniae
ctataggaaacgtcggggat

SEQ ID NO: 2571 - DNA, 20 bp, Chlamydia pneumoniae
ctcaggaatcaatcccacag

SEQ ID NO: 2572 - DNA, 20 bp, Chlamydia pneumoniae
gagccctactcctttgcttt

SEQ ID NO: 2573 - DNA, 20 bp, Chlamydia pneumoniae
ggagaagaaattcctctcgc

SEQ ID NO: 2574 - DNA, 20 bp, Chlamydia pneumoniae
gcgaagttgctagctaagaa

SEQ ID NO: 2575 - DNA, 20 bp, Chlamydia pneumoniae
tattttttgcctccgcaggc

SEQ ID NO: 2576 - DNA, 20 bp, Chlamydia pneumoniae
ccttcgctgacaaccaagaa

SEQ ID NO: 2577 - DNA, 20 bp, Chlamydia pneumoniae
ctacttcctggttgggaaga

SEQ ID NO: 2578 - DNA, 20 bp, Chlamydia pneumoniae
cctctagggaaagaagctct

SEQ ID NO: 2579 - DNA, 20 bp, Chlamydia pneumoniae
tctattcacagtggggcgat

SEQ ID NO: 2580 - DNA, 20 bp, Chlamydia pneumoniae
ttgctgtaggtggcatcact

SEQ ID NO: 2581 - DNA, 20 bp, Chlamydia pneumoniae
caagtcagcacctcgtacat

SEQ ID NO: 2582 - DNA, 20 bp, Chlamydia pneumoniae
cgaacccacggtacgcgtta

SEQ ID NO: 2583 - DNA, 20 bp, Chlamydia pneumoniae
ggaaaccacagccactacaa

SEQ ID NO: 2584 - DNA, 20 bp, Chlamydia pneumoniae
ggcagatcgtttccacatgc

SEQ ID NO: 2585 - DNA, 20 bp, Chlamydia pneumoniae
ggcttcggctataggatctt

SEQ ID NO: 2586 - DNA, 20 bp, Chlamydia pneumoniae
ccgacgacaaacattgatcc

SEQ ID NO: 2587 - DNA, 20 bp, Chlamydia pneumoniae
gcattagcttggcgtgagat

SEQ ID NO: 2588 - DNA, 20 bp, Chlamydia pneumoniae
ccgtgattcatttccccttc

SEQ ID NO: 2589 - DNA, 20 bp, Chlamydia pneumoniae
gagggatccggtttgtattc

SEQ ID NO: 2590 - DNA, 20 bp, Chlamydia pneumoniae
gaggtacacggctttaaacc

SEQ ID NO: 2591 - DNA, 20 bp, Chlamydia pneumoniae
caaggagttacgacaaggag

SEQ ID NO: 2592 - DNA, 20 bp, Chlamydia pneumoniae
ttgccaccattgcctccgta

SEQ ID NO: 2593 - DNA, 20 bp, Chlamydia pneumoniae
ccgacgacaaacattgatcc

SEQ ID NO: 2594 - DNA, 20 bp, Chlamydia pneumoniae
gttgctcaggaacaacagag

SEQ ID NO: 2595 - DNA, 20 bp, Chlamydia pneumoniae
ttaggagcctccgtagctgg

SEQ ID NO: 2596 - DNA, 20 bp, Chlamydia pneumoniae
tggccagagccgggatcgaa

SEQ ID NO: 2597 - DNA, 20 bp, Chlamydia pneumoniae
ggaatttgcatcgcctactg

SEQ ID NO: 2598 - DNA, 20 bp, Chlamydia pneumoniae
gggatttatcttgaggaggc

SEQ ID NO: 2599 - DNA, 20 bp, Chlamydia pneumoniae
gttctaactctacctgacgg

SEQ ID NO: 2600 - DNA, 20 bp, Chlamydia pneumoniae
gagcaaactccgaagcgttt

SEQ ID NO: 2601 - DNA, 20 bp, Chlamydia pneumoniae
gccccttgtcctttcttatg

SEQ ID NO: 2602 - DNA, 20 bp, Chlamydia pneumoniae
gaacgtgttcggagacctct

SEQ ID NO: 2603 - DNA, 20 bp, Chlamydia pneumoniae
cgaagcaacttcccctagta

SEQ ID NO: 2604 - DNA, 20 bp, Chlamydia pneumoniae
caagacgtttgtgagtacga

SEQ ID NO: 2605 - DNA, 20 bp, Chlamydia pneumoniae
ccatctgagctatctagcca

SEQ ID NO: 2606 - DNA, 20 bp, Chlamydia pneumoniae
cagcaaaatagtctgctccc

SEQ ID NO: 2607 - DNA, 20 bp, Chlamydia pneumoniae
cctgcaggaagtgctaacat

SEQ ID NO: 2608 - DNA, 20 bp, Chlamydia pneumoniae
gttgcagcagaggtaatcgt

SEQ ID NO: 2609 - DNA, 20 bp, Chlamydia pneumoniae
ccctgatcgaatcctttcag

SEQ ID NO: 2610 - DNA, 20 bp, Chlamydia pneumoniae
cgacgggaacgaacttctaa

SEQ ID NO: 2611 - DNA, 20 bp, Chlamydia pneumoniae
cccaggttcgttaggttcta

SEQ ID NO: 2612 - DNA, 20 bp, Chlamydia pneumoniae
gggaacgtatcctgcttgaa

SEQ ID NO: 2613 - DNA, 20 bp, Chlamydia pneumoniae
ggcaaccacttgacaatcac

SEQ ID NO: 2614 - DNA, 20 bp, Chlamydia pneumoniae
ggcaacaaagtcctcattcg

SEQ ID NO: 2615 - DNA, 20 bp, Chlamydia pneumoniae
gccgatgtttctaattgcac

SEQ ID NO: 2616 - DNA, 20 bp, Chlamydia pneumoniae
ccccttttcaggagcgtatt

SEQ ID NO: 2617 - DNA, 20 bp, Chlamydia pneumoniae
gtgccgccttgacatataca

SEQ ID NO: 2618 - DNA, 20 bp, Chlamydia pneumoniae
gtgagcaaaggctttctgag

SEQ ID NO: 2619 - DNA, 20 bp, Chlamydia pneumoniae
caacctcgcaaagcttcttt

SEQ ID NO: 2620 - DNA, 20 bp, Chlamydia pneumoniae
cgttctcctagtgtagttcc

SEQ ID NO: 2621 - DNA, 20 bp, Chlamydia pneumoniae
ggcatgtgtggaattggtgt

SEQ ID NO: 2622 - DNA, 20 bp, Chlamydia pneumoniae
gccatactcgttagcgcaag

SEQ ID NO: 2623 - DNA, 20 bp, Chlamydia pneumoniae
gacataccgttctcctagtg

SEQ ID NO: 2624 - DNA, 20 bp, Chlamydia pneumoniae
ccctcgtcaataaagcgcat

SEQ ID NO: 2625 - DNA, 20 bp, Chlamydia pneumoniae
cttctttgagggcagaactc

SEQ ID NO: 2626 - DNA, 20 bp, Chlamydia pneumoniae
cttcataccctgaaaacggc

SEQ ID NO: 2627 - DNA, 20 bp, Chlamydia pneumoniae
cgagggggaaatgaaattat

SEQ ID NO: 2628 - DNA, 20 bp, Chlamydia pneumoniae
cgccagggacgtttttctaa

SEQ ID NO: 2629 - DNA, 20 bp, Chlamydia pneumoniae
cataacctgagtcgcggtaa

SEQ ID NO: 2630 - DNA, 20 bp, Chlamydia pneumoniae
gtgacgaccctcatctagaa

SEQ ID NO: 2631 - DNA, 20 bp, Chlamydia pneumoniae
gcttgagtgatcgaaaccca

SEQ ID NO: 2632 - DNA, 20 bp, Chlamydia pneumoniae
ggctcgacagatggctgtat

SEQ ID NO: 2633 - DNA, 20 bp, Chlamydia pneumoniae
gcgtgttgttcccttgcaat

SEQ ID NO: 2634 - DNA, 20 bp, Chlamydia pneumoniae
aggcacagccctctttccct

SEQ ID NO: 2635 - DNA, 20 bp, Chlamydia pneumoniae
cgcatttgagcaacatcgct

SEQ ID NO: 2636 - DNA, 20 bp, Chlamydia pneumoniae
caaagccaaagcaaacacgc

SEQ ID NO: 2637 - DNA, 20 bp, Chlamydia pneumoniae
gatcgtagaagatcctggca

SEQ ID NO: 2638 - DNA, 20 bp, Chlamydia pneumoniae
cgtcatgagtaagccgagta

SEQ ID NO: 2639 - DNA, 20 bp, Chlamydia pneumoniae
cacatggagtcttgcagact

SEQ ID NO: 2640 - DNA, 20 bp, Chlamydia pneumoniae
ctgacgacctttcagaatct

SEQ ID NO: 2641 - DNA, 20 bp, Chlamydia pneumoniae
agtgcatcaggaactccaag

SEQ ID NO: 2642 - DNA, 20 bp, Chlamydia pneumoniae
tgcgagttacttcccgatgc

SEQ ID NO: 2643 - DNA, 20 bp, Chlamydia pneumoniae
ctgaaatggatatgcgagga

SEQ ID NO: 2644 - DNA, 20 bp, Chlamydia pneumoniae
ctcagcttggcaactgtgta

SEQ ID NO: 2645 - DNA, 20 bp, Chlamydia pneumoniae
cacacacacgtcaggtcatt

SEQ ID NO: 2646 - DNA, 20 bp, Chlamydia pneumoniae
ggtattggtatgatggctgc

SEQ ID NO: 2647 - DNA, 20 bp, Chlamydia pneumoniae
ccggtgcatacggtgattta

SEQ ID NO: 2648 - DNA, 20 bp, Chlamydia pneumoniae
ggctaaagactttggagagg

SEQ ID NO: 2649 - DNA, 20 bp, Chlamydia pneumoniae
gttccgatcatccctgtcta

SEQ ID NO: 2650 - DNA, 20 bp, Chlamydia pneumoniae
ggagattcaagaacctgctg

SEQ ID NO: 2651 - DNA, 20 bp, Chlamydia pneumoniae
cacatgtgtgtccatgagtg

SEQ ID NO: 2652 - DNA, 20 bp, Chlamydia pneumoniae
cgttcccctttggcatcaaa

SEQ ID NO: 2653 - DNA, 20 bp, Chlamydia pneumoniae
acgtaaagctccgagagctt

SEQ ID NO: 2654 - DNA, 20 bp, Chlamydia pneumoniae
ggagaaacaagcagagctga

SEQ ID NO: 2655 - DNA, 20 bp, Chlamydia pneumoniae
gagcttgcctacccaatttg

SEQ ID NO: 2656 - DNA, 20 bp, Chlamydia pneumoniae
cgatacagatccatccggtc

SEQ ID NO: 2657 - DNA, 20 bp, Chlamydia pneumoniae
caagcagcttagttgcagca

SEQ ID NO: 2658 - DNA, 20 bp, Chlamydia pneumoniae
cagggactggaacacagaat

SEQ ID NO: 2659 - DNA, 20 bp, Chlamydia pneumoniae
gcactctttttctaccctcc

SEQ ID NO: 2660 - DNA, 20 bp, Chlamydia pneumoniae
cccatgaccatacagctcat

SEQ ID NO: 2661 - DNA, 20 bp, Chlamydia pneumoniae
accctctgcatggcgtcgtg

SEQ ID NO: 2662 - DNA, 20 bp, Chlamydia pneumoniae
gtaaacgcagtgcaccttga

SEQ ID NO: 2663 - DNA, 20 bp, Chlamydia pneumoniae
cgacaacatctgaatacggc

SEQ ID NO: 2664 - DNA, 20 bp, Chlamydia pneumoniae
ctccagcaacattcccattg

SEQ ID NO: 2665 - DNA, 20 bp, Chlamydia pneumoniae
ggcatgttgctacaatctcc

SEQ ID NO: 2666 - DNA, 20 bp, Chlamydia pneumoniae
gagatccccaagcaatttcc

SEQ ID NO: 2667 - DNA, 20 bp, Chlamydia pneumoniae
ctactagacgcaagggaaga

SEQ ID NO: 2668 - DNA, 20 bp, Chlamydia pneumoniae
caaggacttcctagagcttc

SEQ ID NO: 2669 - DNA, 20 bp, Chlamydia pneumoniae
gtaaacgcagtgcaccttga

SEQ ID NO: 2670 - DNA, 20 bp, Chlamydia pneumoniae
gttcgctgttgacttaggct

SEQ ID NO: 2671 - DNA, 20 bp, Chlamydia pneumoniae
ctccagcaacattcccattg

SEQ ID NO: 2672 - DNA, 20 bp, Chlamydia pneumoniae
ctgcaacaataccctggaga

SEQ ID NO: 2673 - DNA, 20 bp, Chlamydia pneumoniae
caagagttcttgtctgcctc

SEQ ID NO: 2674 - DNA, 20 bp, Chlamydia pneumoniae
gcactctggaccgagacaat

SEQ ID NO: 2675 - DNA, 20 bp, Chlamydia pneumoniae
cacctttactaggagtcacc

SEQ ID NO: 2676 - DNA, 20 bp, Chlamydia pneumoniae
ggcatctcttggagagttag

SEQ ID NO: 2677 - DNA, 20 bp, Chlamydia pneumoniae
ggccgaagtttgctcgaaaa

SEQ ID NO: 2678 - DNA, 20 bp, Chlamydia pneumoniae
cgaacgatctataccctgga

SEQ ID NO: 2679 - DNA, 20 bp, Chlamydia pneumoniae
ccataagagagttcctgaga

SEQ ID NO: 2680 - DNA, 20 bp, Chlamydia pneumoniae
ctcggctcgcatacagaaat

SEQ ID NO: 2681 - DNA, 20 bp, Chlamydia pneumoniae
ccctctatttgcaaacgcga

SEQ ID NO: 2682 - DNA, 20 bp, Chlamydia pneumoniae
gaagggccttttccttgcta

SEQ ID NO: 2683 - DNA, 20 bp, Chlamydia pneumoniae
cgaacgatctataccctgga

SEQ ID NO: 2684 - DNA, 20 bp, Chlamydia pneumoniae
ggacaagctcttcactccat

SEQ ID NO: 2685 - DNA, 20 bp, Chlamydia pneumoniae
ccgaaggggttctctatgat

SEQ ID NO: 2686 - DNA, 20 bp, Chlamydia pneumoniae
acgagttcgcggatcttctt

SEQ ID NO: 2687 - DNA, 20 bp, Chlamydia pneumoniae
ccgatcaccggcataattct

SEQ ID NO: 2688 - DNA, 20 bp, Chlamydia pneumoniae
ccagtaagtctcagatcctc

SEQ ID NO: 2689 - DNA, 20 bp, Chlamydia pneumoniae
gcgattcctgatggtatcct

SEQ ID NO: 2690 - DNA, 20 bp, Chlamydia pneumoniae
ggcctaaggattttacgtct

SEQ ID NO: 2691 - DNA, 20 bp, Chlamydia pneumoniae
gatcgcttgtgcatgcatct

SEQ ID NO: 2692 - DNA, 20 bp, Chlamydia pneumoniae
caccgaagacatgctcgctt

SEQ ID NO: 2693 - DNA, 20 bp, Chlamydia pneumoniae
gtctttaagatgggccgtcg

SEQ ID NO: 2694 - DNA, 20 bp, Chlamydia pneumoniae
caaccgagtggcttcctgtc

SEQ ID NO: 2695 - DNA, 20 bp, Chlamydia pneumoniae
ggcctaaggattttacgtct

SEQ ID NO: 2696 - DNA, 20 bp, Chlamydia pneumoniae
cccctgctacttatcgaatg

SEQ ID NO: 2697 - DNA, 20 bp, Chlamydia pneumoniae
gcagcttcaagctcagcaaa

SEQ ID NO: 2698 - DNA, 20 bp, Chlamydia pneumoniae
cccgattgctatagctgaaa

SEQ ID NO: 2699 - DNA, 20 bp, Chlamydia pneumoniae
ctcttcggtgcgttaaattc

SEQ ID NO: 2700 - DNA, 20 bp, Chlamydia pneumoniae
tcgacaagcgaatcccaaat

SEQ ID NO: 2701 - DNA, 20 bp, Chlamydia pneumoniae
gttgctctccttcctaatgc

SEQ ID NO: 2702 - DNA, 20 bp, Chlamydia pneumoniae
cgtttcttgcaacagatccc

SEQ ID NO: 2703 - DNA, 20 bp, Chlamydia pneumoniae
cccgattgctatagctgaaa

SEQ ID NO: 2704 - DNA, 20 bp, Chlamydia pneumoniae
cgcaatcaaaggtccggaaa

SEQ ID NO: 2705 - DNA, 20 bp, Chlamydia pneumoniae
cccgctatcctaccatctta

SEQ ID NO: 2706 - DNA, 20 bp, Chlamydia pneumoniae
cctgaagacatccctgcaaa

SEQ ID NO: 2707 - DNA, 20 bp, Chlamydia pneumoniae
ccaactgcgaagcaggattg

SEQ ID NO: 2708 - DNA, 20 bp, Chlamydia pneumoniae
gacggaacgaccatcgtatt

SEQ ID NO: 2709 - DNA, 20 bp, Chlamydia pneumoniae
gccctaaaaccctacagaga

SEQ ID NO: 2710 - DNA, 20 bp, Chlamydia pneumoniae
attccctttggagagcagca

SEQ ID NO: 2711 - DNA, 20 bp, Chlamydia pneumoniae
aatccaggtcctggctcccc

SEQ ID NO: 2712 - DNA, 20 bp, Chlamydia pneumoniae
accaccccctagtcaactta

SEQ ID NO: 2713 - DNA, 20 bp, Chlamydia pneumoniae
cactccaggttatcgttcac

SEQ ID NO: 2714 - DNA, 20 bp, Chlamydia pneumoniae
gtgatcttagggcgagtgtt

SEQ ID NO: 2715 - DNA, 20 bp, Chlamydia pneumoniae
gcatcttgtcgactctttgc

SEQ ID NO: 2716 - DNA, 20 bp, Chlamydia pneumoniae
gggataaggagcaaagactc

SEQ ID NO: 2717 - DNA, 20 bp, Chlamydia pneumoniae
gccacccttcgatctgttta

SEQ ID NO: 2718 - DNA, 20 bp, Chlamydia pneumoniae
caagaggggttcgcagtaaa

SEQ ID NO: 2719 - DNA, 20 bp, Chlamydia pneumoniae
cgctcttcctttccttcttc

SEQ ID NO: 2720 - DNA, 20 bp, Chlamydia pneumoniae
cgcaagacagaatgctggaa

SEQ ID NO: 2721 - DNA, 20 bp, Chlamydia pneumoniae
ccgtatgccaatctgtcttg

SEQ ID NO: 2722 - DNA, 20 bp, Chlamydia pneumoniae
ccactgcgcaactatgtcaa

SEQ ID NO: 2723 - DNA, 20 bp, Chlamydia pneumoniae
cgtcggcatgtattctagga

SEQ ID NO: 2724 - DNA, 20 bp, Chlamydia pneumoniae
gtcccacagccagtaaacat

SEQ ID NO: 2725 - DNA, 20 bp, Chlamydia pneumoniae
ggctccacaaacaaagagga

SEQ ID NO: 2726 - DNA, 20 bp, Chlamydia pneumoniae
caggaagttgttctccgagt

SEQ ID NO: 2727 - DNA, 20 bp, Chlamydia pneumoniae
cctattctgttacgggaagc

SEQ ID NO: 2728 - DNA, 20 bp, Chlamydia pneumoniae
gatggtatcctatccagggg

SEQ ID NO: 2729 - DNA, 20 bp, Chlamydia pneumoniae
ggaacatgttggtagaggct

SEQ ID NO: 2730 - DNA, 20 bp, Chlamydia pneumoniae
ggcgatcttcagaagaaagc

SEQ ID NO: 2731 - DNA, 20 bp, Chlamydia pneumoniae
ggatgtttcccgaaacaatc

SEQ ID NO: 2732 - DNA, 20 bp, Chlamydia pneumoniae
ccttttgccctcccctccac

SEQ ID NO: 2733 - DNA, 20 bp, Chlamydia pneumoniae
tggggggtagtgtgtcatca

SEQ ID NO: 2734 - DNA, 20 bp, Chlamydia pneumoniae
tctggagaacttctggagag

SEQ ID NO: 2735 - DNA, 20 bp, Chlamydia pneumoniae
gtcaggaatgtgcgtgcctt

SEQ ID NO: 2736 - DNA, 20 bp, Chlamydia pneumoniae
gtgggaacttatagtgaggc

SEQ ID NO: 2737 - DNA, 20 bp, Chlamydia pneumoniae
ctccgagatacatgactcgt

SEQ ID NO: 2738 - DNA, 20 bp, Chlamydia pneumoniae
ctcaaagacgacctgagact

SEQ ID NO: 2739 - DNA, 20 bp, Chlamydia pneumoniae
cctggagtaaataacccttc

SEQ ID NO: 2740 - DNA, 20 bp, Chlamydia pneumoniae
gaatggcttccagaccttgt

SEQ ID NO: 2741 - DNA, 20 bp, Chlamydia pneumoniae
ctttataaagcagtcccgtg

SEQ ID NO: 2742 - DNA, 20 bp, Chlamydia pneumoniae
cgcctgacggctttgtttat

SEQ ID NO: 2743 - DNA, 20 bp, Chlamydia pneumoniae
gcctgttgtccatacacgat

SEQ ID NO: 2744 - DNA, 20 bp, Chlamydia pneumoniae
gaggaagctatgagtgcgaa

SEQ ID NO: 2745 - DNA, 20 bp, Chlamydia pneumoniae
ccctgtgtcaaagctaaacc

SEQ ID NO: 2746 - DNA, 20 bp, Chlamydia pneumoniae
ccttcccaactttatggcgt

SEQ ID NO: 2747 - DNA, 20 bp, Chlamydia pneumoniae
caggcaagctaacgaaggta

SEQ ID NO: 2748 - DNA, 20 bp, Chlamydia pneumoniae
ctctcctcctcattcgaaag

SEQ ID NO: 2749 - DNA, 20 bp, Chlamydia pneumoniae
tagtccccagaacaacatcg

SEQ ID NO: 2750 - DNA, 20 bp, Chlamydia pneumoniae
cgtctgcatcctattgaacc

SEQ ID NO: 2751 - DNA, 20 bp, Chlamydia pneumoniae
tcgaaccctcggtacccttt

SEQ ID NO: 2752 - DNA, 20 bp, Chlamydia pneumoniae
ggttctcaatgcctccttag

SEQ ID NO: 2753 - DNA, 20 bp, Chlamydia pneumoniae
cgcaatgcgaatcagagtca

SEQ ID NO: 2754 - DNA, 20 bp, Chlamydia pneumoniae
ctactacctgccaattcctc

SEQ ID NO: 2755 - DNA, 20 bp, Chlamydia pneumoniae
ggtgtgatttctggagtcac

SEQ ID NO: 2756 - DNA, 20 bp, Chlamydia pneumoniae
ggacgctctctatgcacaaa

SEQ ID NO: 2757 - DNA, 20 bp, Chlamydia pneumoniae
gggctgcatacccaagagat

SEQ ID NO: 2758 - DNA, 20 bp, Chlamydia pneumoniae
aaacactctcgctcttctcg

SEQ ID NO: 2759 - DNA, 20 bp, Chlamydia pneumoniae
gcactatctcgtcctgaagt

SEQ ID NO: 2760 - DNA, 20 bp, Chlamydia pneumoniae
tagcgctgttccactgcaat

SEQ ID NO: 2761 - DNA, 20 bp, Chlamydia pneumoniae
gtccactacttcctaatacc

SEQ ID NO: 2762 - DNA, 20 bp, Chlamydia pneumoniae
tccctagtgtctaccattcc

SEQ ID NO: 2763 - DNA, 20 bp, Chlamydia pneumoniae
gcccaacgttctgtaatagc

SEQ ID NO: 2764 - DNA, 20 bp, Chlamydia pneumoniae
aacctcatagtctccggcag

SEQ ID NO: 2765 - DNA, 20 bp, Chlamydia pneumoniae
ggcatagccatacctttctc

SEQ ID NO: 2766 - DNA, 20 bp, Chlamydia pneumoniae
cgtccatgtgtagagtcgaa

SEQ ID NO: 2767 - DNA, 20 bp, Chlamydia pneumoniae
gacagtctgttcagagaagc

SEQ ID NO: 2768 - DNA, 20 bp, Chlamydia pneumoniae
accataagccgtccaatagc

SEQ ID NO: 2769 - DNA, 20 bp, Chlamydia pneumoniae
ccgcagaagtaactactgga

SEQ ID NO: 2770 - DNA, 20 bp, Chlamydia pneumoniae
cttcaaagtccccttcttgc

SEQ ID NO: 2771 - DNA, 20 bp, Chlamydia pneumoniae
gtcttcgataggaacccgaa

SEQ ID NO: 2772 - DNA, 20 bp, Chlamydia pneumoniae
gcctgtcatagcaaacgaga

SEQ ID NO: 2773 - DNA, 20 bp, Chlamydia pneumoniae
gcagtagcagcatgaactgt

SEQ ID NO: 2774 - DNA, 20 bp, Chlamydia pneumoniae
ggcagcaaaggctgaagatt

SEQ ID NO: 2775 - DNA, 20 bp, Chlamydia pneumoniae
cgaggacttctactgaagag

SEQ ID NO: 2776 - DNA, 20 bp, Chlamydia pneumoniae
gagttcagtcgtcctacttc

SEQ ID NO: 2777 - DNA, 20 bp, Chlamydia pneumoniae
tgtcggcgtagttctttagc

SEQ ID NO: 2778 - DNA, 20 bp, Chlamydia pneumoniae
gcaaaagcgcctccagaaaa

SEQ ID NO: 2779 - DNA, 20 bp, Chlamydia pneumoniae
gctccagtacccttcaaaca

SEQ ID NO: 2780 - DNA, 20 bp, Chlamydia pneumoniae
cggctaaacgtcctgtagta

SEQ ID NO: 2781 - DNA, 20 bp, Chlamydia pneumoniae
ctcgataagaatggatggcg

SEQ ID NO: 2782 - DNA, 20 bp, Chlamydia pneumoniae
caactcgatcaagttgaagg

SEQ ID NO: 2783 - DNA, 20 bp, Chlamydia pneumoniae
ggatttttctcactccctcg

SEQ ID NO: 2784 - DNA, 20 bp, Chlamydia pneumoniae
ctcgcaaagctcttcgtctt

SEQ ID NO: 2785 - DNA, 20 bp, Chlamydia pneumoniae
ggatagaattccaagggcga

SEQ ID NO: 2786 - DNA, 20 bp, Chlamydia pneumoniae
gcatacagctaggtctatcg

SEQ ID NO: 2787 - DNA, 20 bp, Chlamydia pneumoniae
gcaaaagcgcctccagaaaa

SEQ ID NO: 2788 - DNA, 20 bp, Chlamydia pneumoniae
gatacccgtttcagttggtg

SEQ ID NO: 2789 - DNA, 20 bp, Chlamydia pneumoniae
cggctaaacgtcctgtagta

SEQ ID NO: 2790 - DNA, 20 bp, Chlamydia pneumoniae
ccggcaatagaatttcgagc

SEQ ID NO: 2791 - DNA, 20 bp, Chlamydia pneumoniae
gcatctgtgagttcattggc

SEQ ID NO: 2792 - DNA, 20 bp, Chlamydia pneumoniae
cgaacgtttacaccttcgac

SEQ ID NO: 2793 - DNA, 20 bp, Chlamydia pneumoniae
ggctttgtaggggaaccttt

SEQ ID NO: 2794 - DNA, 20 bp, Chlamydia pneumoniae
cgtgtgcgcacgatcacagc

SEQ ID NO: 2795 - DNA, 20 bp, Chlamydia pneumoniae
ccaactgcttatcaagccct

SEQ ID NO: 2796 - DNA, 20 bp, Chlamydia pneumoniae
cactagccatggactttacc

SEQ ID NO: 2797 - DNA, 20 bp, Chlamydia pneumoniae
cataactccctgagaagtgg

SEQ ID NO: 2798 - DNA, 20 bp, Chlamydia pneumoniae
catacgagtttctgcaggct

SEQ ID NO: 2799 - DNA, 20 bp, Chlamydia pneumoniae
atattcaatccctgggtgcg

SEQ ID NO: 2800 - DNA, 20 bp, Chlamydia pneumoniae
cggtttggatggtcacttca

SEQ ID NO: 2801 - DNA, 20 bp, Chlamydia pneumoniae
cgaacgtttacaccttcgac

SEQ ID NO: 2802 - DNA, 20 bp, Chlamydia pneumoniae
ctcgaacttcggtaacgctt

SEQ ID NO: 2803 - DNA, 20 bp, Chlamydia pneumoniae
cagctttgataacgtctccc

SEQ ID NO: 2804 - DNA, 20 bp, Chlamydia pneumoniae
cctttcttcacaggatggct

SEQ ID NO: 2805 - DNA, 20 bp, Chlamydia pneumoniae
cttttagttcagtgtgagcg

SEQ ID NO: 2806 - DNA, 20 bp, Chlamydia pneumoniae
gccacgatgacggcaggata

SEQ ID NO: 2807 - DNA, 20 bp, Chlamydia pneumoniae
gaagaggagttctctccaag

SEQ ID NO: 2808 - DNA, 20 bp, Chlamydia pneumoniae
ggcgggttgaggttttacat

SEQ ID NO: 2809 - DNA, 20 bp, Chlamydia pneumoniae
cagatcaacttcagcgcctt

SEQ ID NO: 2810 - DNA, 20 bp, Chlamydia pneumoniae
cgggaattacccgtaccttt

SEQ ID NO: 2811 - DNA, 20 bp, Chlamydia pneumoniae
cccaccatagtttctgaaac

SEQ ID NO: 2812 - DNA, 20 bp, Chlamydia pneumoniae
gagaccgcataaacttatcc

SEQ ID NO: 2813 - DNA, 20 bp, Chlamydia pneumoniae
ctcttccaccagaactcttc

SEQ ID NO: 2814 - DNA, 20 bp, Chlamydia pneumoniae
gctttcctcttggaggaaca

SEQ ID NO: 2815 - DNA, 20 bp, Chlamydia pneumoniae
gcgcaactcaccacgcgttg

SEQ ID NO: 2816 - DNA, 20 bp, Chlamydia pneumoniae
gttgcccctacaaactttgc

SEQ ID NO: 2817 - DNA, 20 bp, Chlamydia pneumoniae
ctgctacttcaacttcgcct

SEQ ID NO: 2818 - DNA, 20 bp, Chlamydia pneumoniae
gctccataggcaaccacaat

SEQ ID NO: 2819 - DNA, 20 bp, Chlamydia pneumoniae
cagagggggaagatttttac

SEQ ID NO: 2820 - DNA, 20 bp, Chlamydia pneumoniae
gcgaactctcgaatttcgca

SEQ ID NO: 2821 - DNA, 20 bp, Chlamydia pneumoniae
cagaaaccgccttacttagc

SEQ ID NO: 2822 - DNA, 20 bp, Chlamydia pneumoniae
gcttgggccaaagcttctaa

SEQ ID NO: 2823 - DNA, 20 bp, Chlamydia pneumoniae
acagtcccgggggctccata

SEQ ID NO: 2824 - DNA, 20 bp, Chlamydia pneumoniae
cgtactggttcatcggcaaa

SEQ ID NO: 2825 - DNA, 20 bp, Chlamydia pneumoniae
gcatccatacggatgacagt

SEQ ID NO: 2826 - DNA, 20 bp, Chlamydia pneumoniae
cgattacagcactaccccta

SEQ ID NO: 2827 - DNA, 20 bp, Chlamydia pneumoniae
cgcttacttgggctttgaca

SEQ ID NO: 2828 - DNA, 20 bp, Chlamydia pneumoniae
gatccgagagcatccaagaa

SEQ ID NO: 2829 - DNA, 20 bp, Chlamydia pneumoniae
catcagagggaaaagctgct

SEQ ID NO: 2830 - DNA, 20 bp, Chlamydia pneumoniae
ggctaaacgatcgagcaaac

SEQ ID NO: 2831 - DNA, 20 bp, Chlamydia pneumoniae
gggtaatctccacaataccc

SEQ ID NO: 2832 - DNA, 20 bp, Chlamydia pneumoniae
cgaacagcggcaatttcaat

SEQ ID NO: 2833 - DNA, 20 bp, Chlamydia pneumoniae
gaagagtgagcacccataac

SEQ ID NO: 2834 - DNA, 20 bp, Chlamydia pneumoniae
ggcacaaccgcttaggttca

SEQ ID NO: 2835 - DNA, 20 bp, Chlamydia pneumoniae
gtccttagaggtaatgaggg

SEQ ID NO: 2836 - DNA, 20 bp, Chlamydia pneumoniae
cagagccgagaattatgttg

SEQ ID NO: 2837 - DNA, 20 bp, Chlamydia pneumoniae
cgatgattcccatcataggg

SEQ ID NO: 2838 - DNA, 20 bp, Chlamydia pneumoniae
cggatgctcactcctatctt

SEQ ID NO: 2839 - DNA, 20 bp, Chlamydia pneumoniae
cgaaagtaaagcgaacagcg

SEQ ID NO: 2840 - DNA, 20 bp, Chlamydia pneumoniae
gcctgaagatggcaaggaaa

SEQ ID NO: 2841 - DNA, 20 bp, Chlamydia pneumoniae
aggacatcgtcttcttctgc

SEQ ID NO: 2842 - DNA, 20 bp, Chlamydia pneumoniae
cttgcgtaattggcgtgcta

SEQ ID NO: 2843 - DNA, 20 bp, Chlamydia pneumoniae
acaggacgaaggcttagagc

SEQ ID NO: 2844 - DNA, 20 bp, Chlamydia pneumoniae
agacgtggacatactttccc

SEQ ID NO: 2845 - DNA, 20 bp, Chlamydia pneumoniae
ccaacttctgtacttcagcc

SEQ ID NO: 2846 - DNA, 20 bp, Chlamydia pneumoniae
gcatgcgcctcccaaagtta

SEQ ID NO: 2847 - DNA, 20 bp, Chlamydia pneumoniae
cccatcctgccaattgaaca

SEQ ID NO: 2848 - DNA, 20 bp, Chlamydia pneumoniae
gcgagctatccactagagaa

SEQ ID NO: 2849 - DNA, 20 bp, Chlamydia pneumoniae
ggccccgtgttcaagaaaag

SEQ ID NO: 2850 - DNA, 20 bp, Chlamydia pneumoniae
cagcagcagaactctctcat

SEQ ID NO: 2851 - DNA, 20 bp, Chlamydia pneumoniae
cctgcctaagcctaagtcat

SEQ ID NO: 2852 - DNA, 20 bp, Chlamydia pneumoniae
cctggctcacggacattagt

SEQ ID NO: 2853 - DNA, 20 bp, Chlamydia pneumoniae
tacaggggttcatgctgctg

SEQ ID NO: 2854 - DNA, 20 bp, Chlamydia pneumoniae
tcagcagcaagccgcataat

SEQ ID NO: 2855 - DNA, 20 bp, Chlamydia pneumoniae
gagagagatcatcatggtcc

SEQ ID NO: 2856 - DNA, 20 bp, Chlamydia pneumoniae
cctagggacatcttgcgtaa

SEQ ID NO: 2857 - DNA, 20 bp, Chlamydia pneumoniae
gaagtttgctgtccttcgtg

SEQ ID NO: 2858 - DNA, 20 bp, Chlamydia pneumoniae
gcaagctaagaaagagcctc

SEQ ID NO: 2859 - DNA, 20 bp, Chlamydia pneumoniae
gacgacgcgtatttcgtttg

SEQ ID NO: 2860 - DNA, 20 bp, Chlamydia pneumoniae
ggagataagactcacaggca

SEQ ID NO: 2861 - DNA, 20 bp, Chlamydia pneumoniae
caaaaggaggcactctcgaa

SEQ ID NO: 2862 - DNA, 20 bp, Chlamydia pneumoniae
ctcccatagaggagacttag

SEQ ID NO: 2863 - DNA, 20 bp, Chlamydia pneumoniae
gagaagcaacaaaagcagca

SEQ ID NO: 2864 - DNA, 20 bp, Chlamydia pneumoniae
gtcagtgttagcatcagtgc

SEQ ID NO: 2865 - DNA, 20 bp, Chlamydia pneumoniae
gtcgattagagggcttccca

SEQ ID NO: 2866 - DNA, 20 bp, Chlamydia pneumoniae
gggataatccccatcactta

SEQ ID NO: 2867 - DNA, 20 bp, Chlamydia pneumoniae
caggaacgagccaaatagca

SEQ ID NO: 2868 - DNA, 20 bp, Chlamydia pneumoniae
cgatccttagaccccaaaga

SEQ ID NO: 2869 - DNA, 20 bp, Chlamydia pneumoniae
cggtatttaacgagccgcta

SEQ ID NO: 2870 - DNA, 20 bp, Chlamydia pneumoniae
gtggtacttagagcttttct

SEQ ID NO: 2871 - DNA, 20 bp, Chlamydia pneumoniae
gttagggaaatgccctgaga

SEQ ID NO: 2872 - DNA, 20 bp, Chlamydia pneumoniae
ctgaggcgtgctcttctgac

SEQ ID NO: 2873 - DNA, 20 bp, Chlamydia pneumoniae
ctcctcggcctgttcttctc

SEQ ID NO: 2874 - DNA, 20 bp, Chlamydia pneumoniae
ccgcgagcttcatattctac

SEQ ID NO: 2875 - DNA, 20 bp, Chlamydia pneumoniae
gctggttcccaataagagag

SEQ ID NO: 2876 - DNA, 20 bp, Chlamydia pneumoniae
gaaggattgattcccattgc

SEQ ID NO: 2877 - DNA, 20 bp, Chlamydia pneumoniae
gagagccttttggagacttc

SEQ ID NO: 2878 - DNA, 20 bp, Chlamydia pneumoniae
gaggagtcctctggtgaaaa

SEQ ID NO: 2879 - DNA, 20 bp, Chlamydia pneumoniae
ctgggtctaatgtaggtcct

SEQ ID NO: 2880 - DNA, 20 bp, Chlamydia pneumoniae
ggtcgccctaaatgactcat

SEQ ID NO: 2881 - DNA, 20 bp, Chlamydia pneumoniae
tgccggacgttttgcattag

SEQ ID NO: 2882 - DNA, 20 bp, Chlamydia pneumoniae
ggtcgccctaaatgactcat

SEQ ID NO: 2883 - DNA, 20 bp, Chlamydia pneumoniae
tgcgttgccggacgttttgc

SEQ ID NO: 2884 - DNA, 20 bp, Chlamydia pneumoniae
gctcgagatatcggcatgaa

SEQ ID NO: 2885 - DNA, 20 bp, Chlamydia pneumoniae
aggcatcgcactgcgaatac

SEQ ID NO: 2886 - DNA, 20 bp, Chlamydia pneumoniae
cccagaggcaatcataggat

SEQ ID NO: 2887 - DNA, 20 bp, Chlamydia pneumoniae
gctttcacatcgctaggcaa

SEQ ID NO: 2888 - DNA, 20 bp, Chlamydia pneumoniae
ccccaaatgaactttcaagc

SEQ ID NO: 2889 - DNA, 20 bp, Chlamydia pneumoniae
gaggcacatgatgtcctaag

SEQ ID NO: 2890 - DNA, 20 bp, Chlamydia pneumoniae
ctcatccctatacccgagat

SEQ ID NO: 2891 - DNA, 20 bp, Chlamydia pneumoniae
ggggagagaatccagctaat

SEQ ID NO: 2892 - DNA, 20 bp, Chlamydia pneumoniae
cactgagtgtcccatggctg

SEQ ID NO: 2893 - DNA, 20 bp, Chlamydia pneumoniae
gcatctctaaaccccgtgtt

SEQ ID NO: 2894 - DNA, 20 bp, Chlamydia pneumoniae
gctttcctggatcgtcttag

SEQ ID NO: 2895 - DNA, 20 bp, Chlamydia pneumoniae
gacgtgctcgtgctctatgc

SEQ ID NO: 2896 - DNA, 20 bp, Chlamydia pneumoniae
gtcttctttgctcgcagaca

SEQ ID NO: 2897 - DNA, 20 bp, Chlamydia pneumoniae
gtactagcaacggtaaggga

SEQ ID NO: 2898 - DNA, 20 bp, Chlamydia pneumoniae
cgcatgtatagcgatggaga

SEQ ID NO: 2899 - DNA, 20 bp, Chlamydia pneumoniae
ggaaagccaagcttccaact

SEQ ID NO: 2900 - DNA, 20 bp, Chlamydia pneumoniae
gcagatcactacccctattc

SEQ ID NO: 2901 - DNA, 20 bp, Chlamydia pneumoniae
ctcagtcacaatatctcctg

SEQ ID NO: 2902 - DNA, 20 bp, Chlamydia pneumoniae
catcccaaagctgaacgtct

SEQ ID NO: 2903 - DNA, 20 bp, Chlamydia pneumoniae
gagcctactacgcaggactc

SEQ ID NO: 2904 - DNA, 20 bp, Chlamydia pneumoniae
tccgtgacgttcctagagga

SEQ ID NO: 2905 - DNA, 20 bp, Chlamydia pneumoniae
cccctaaagtaatcacaggg

SEQ ID NO: 2906 - DNA, 20 bp, Chlamydia pneumoniae
ctgggataacgaaggttcgt

SEQ ID NO: 2907 - DNA, 20 bp, Chlamydia pneumoniae
cctaagcctaaaactccagc

SEQ ID NO: 2908 - DNA, 20 bp, Chlamydia pneumoniae
cgctcttctggcaacataga

SEQ ID NO: 2909 - DNA, 20 bp, Chlamydia pneumoniae
gagtcgttgcagctgaatct

SEQ ID NO: 2910 - DNA, 20 bp, Chlamydia pneumoniae
cttgaaagacgaacctaccc

SEQ ID NO: 2911 - DNA, 20 bp, Chlamydia pneumoniae
tcttgattcgcacgacggcg

SEQ ID NO: 2912 - DNA, 20 bp, Chlamydia pneumoniae
ggagactcttccagtctcta

SEQ ID NO: 2913 - DNA, 20 bp, Chlamydia pneumoniae
cgcatagccgccatcctcca

SEQ ID NO: 2914 - DNA, 20 bp, Chlamydia pneumoniae
cgtcccctcttcataaggaa

SEQ ID NO: 2915 - DNA, 20 bp, Chlamydia pneumoniae
cccagcacatgattcgttga

SEQ ID NO: 2916 - DNA, 20 bp, Chlamydia pneumoniae
caagggaacaaaggaggaag

SEQ ID NO: 2917 - DNA, 20 bp, Chlamydia pneumoniae
ccagtcttaagcacctctac

SEQ ID NO: 2918 - DNA, 20 bp, Chlamydia pneumoniae
cttggttgaaatatgcggct

SEQ ID NO: 2919 - DNA, 20 bp, Chlamydia pneumoniae
ggattaagatatgcccctct

SEQ ID NO: 2920 - DNA, 20 bp, Chlamydia pneumoniae
cccctacttcacatcacatc

SEQ ID NO: 2921 - DNA, 20 bp, Chlamydia pneumoniae
cggtcgtttcatgctatgga

SEQ ID NO: 2922 - DNA, 20 bp, Chlamydia pneumoniae
cccctgtaatgatgactctc

SEQ ID NO: 2923 - DNA, 20 bp, Chlamydia pneumoniae
actggatccgctgctgcaaa

SEQ ID NO: 2924 - DNA, 20 bp, Chlamydia pneumoniae
gttcctgctgaagctattgc

SEQ ID NO: 2925 - DNA, 20 bp, Chlamydia pneumoniae
cacttactgcagaagctcgt

SEQ ID NO: 2926 - DNA, 20 bp, Chlamydia pneumoniae
gcatgtagacggtgtctatg

SEQ ID NO: 2927 - DNA, 20 bp, Chlamydia pneumoniae
cgttggctaggcggaatgtt

SEQ ID NO: 2928 - DNA, 20 bp, Chlamydia pneumoniae
ggttcgaatccccttggggt

SEQ ID NO: 2929 - DNA, 20 bp, Chlamydia pneumoniae
cgaactcagagcagtgacta

SEQ ID NO: 2930 - DNA, 20 bp, Chlamydia pneumoniae
ggctgccaccaatgttatac

SEQ ID NO: 2931 - DNA, 20 bp, Chlamydia pneumoniae
ggctaagcaaactagacgag

SEQ ID NO: 2932 - DNA, 20 bp, Chlamydia pneumoniae
tgcccaaagccgggatcgaa

SEQ ID NO: 2933 - DNA, 20 bp, Chlamydia pneumoniae
catttattcgtcttggcccc

SEQ ID NO: 2934 - DNA, 20 bp, Chlamydia pneumoniae
gccagagtaccaagaacatc

SEQ ID NO: 2935 - DNA, 20 bp, Chlamydia pneumoniae
gccaacttgagctgaaagag

SEQ ID NO: 2936 - DNA, 20 bp, Chlamydia pneumoniae
ccgctttgtcaatcgctctt

SEQ ID NO: 2937 - DNA, 20 bp, Chlamydia pneumoniae
gatccttcatcagcttccca

SEQ ID NO: 2938 - DNA, 20 bp, Chlamydia pneumoniae
cctggagtggttttcttggt

SEQ ID NO: 2939 - DNA, 20 bp, Chlamydia pneumoniae
cctgagccatgattctagga

SEQ ID NO: 2940 - DNA, 20 bp, Chlamydia pneumoniae
ggctctgtgcttccttaaga

SEQ ID NO: 2941 - DNA, 20 bp, Chlamydia pneumoniae
ggttggacgtctttctctgt

SEQ ID NO: 2942 - DNA, 20 bp, Chlamydia pneumoniae
acgccgaattctttcgtagc

SEQ ID NO: 2943 - DNA, 20 bp, Chlamydia pneumoniae
ggactgtaacctaaccacag

SEQ ID NO: 2944 - DNA, 20 bp, Chlamydia pneumoniae
gctcttcctctttggatcct

SEQ ID NO: 2945 - DNA, 20 bp, Chlamydia pneumoniae
gagggggaaggagaaaaaac

SEQ ID NO: 2946 - DNA, 20 bp, Chlamydia pneumoniae
gcttgttgtaccttcgtcca

SEQ ID NO: 2947 - DNA, 20 bp, Chlamydia pneumoniae
cgctttcttcggtttcagga

SEQ ID NO: 2948 - DNA, 20 bp, Chlamydia pneumoniae
cctaaaggagagagaaaggc

SEQ ID NO: 2949 - DNA, 20 bp, Chlamydia pneumoniae
gcgttctcagcaaggcaaaa

SEQ ID NO: 2950 - DNA, 20 bp, Chlamydia pneumoniae
ctgcatcattgccatcggat

SEQ ID NO: 2951 - DNA, 20 bp, Chlamydia pneumoniae
cgttcagcttctttctctcg

SEQ ID NO: 2952 - DNA, 20 bp, Chlamydia pneumoniae
ggcgttcttcagcatcgaaa

SEQ ID NO: 2953 - DNA, 20 bp, Chlamydia pneumoniae
tcctgctaccaagacggtat

SEQ ID NO: 2954 - DNA, 20 bp, Chlamydia pneumoniae
gatgttggacaccgattcca

SEQ ID NO: 2955 - DNA, 20 bp, Chlamydia pneumoniae
cgacgattggtcagaagtag

SEQ ID NO: 2956 - DNA, 20 bp, Chlamydia pneumoniae
cgactgttgttgcccaaaag

SEQ ID NO: 2957 - DNA, 20 bp, Chlamydia pneumoniae
ggggtgcacgaaaaatagga

SEQ ID NO: 2958 - DNA, 20 bp, Chlamydia pneumoniae
actatagtatcagcgggggc

SEQ ID NO: 2959 - DNA, 20 bp, Chlamydia pneumoniae
cttgatgcaagacgatgagc

SEQ ID NO: 2960 - DNA, 20 bp, Chlamydia pneumoniae
cggcactgtcagaatcttct

SEQ ID NO: 2961 - DNA, 20 bp, Chlamydia pneumoniae
catacgccgtctagcatctt

SEQ ID NO: 2962 - DNA, 20 bp, Chlamydia pneumoniae
ggatcgctacgccatttaca

SEQ ID NO: 2963 - DNA, 20 bp, Chlamydia pneumoniae
gaagatggcctgcaattgct

SEQ ID NO: 2964 - DNA, 20 bp, Chlamydia pneumoniae
tgcagaaacagcattgagcg

SEQ ID NO: 2965 - DNA, 20 bp, Chlamydia pneumoniae
cccgtcattaccgacagtaa

SEQ ID NO: 2966 - DNA, 20 bp, Chlamydia pneumoniae
gagttccaaggattctgtcc

SEQ ID NO: 2967 - DNA, 20 bp, Chlamydia pneumoniae
gtatcagcagatggaggcaa

SEQ ID NO: 2968 - DNA, 20 bp, Chlamydia pneumoniae
cctgatcctagtatcttccc

SEQ ID NO: 2969 - DNA, 20 bp, Chlamydia pneumoniae
ccttctttggtgcattgcag

SEQ ID NO: 2970 - DNA, 20 bp, Chlamydia pneumoniae
gggaatacacagattcggtc

SEQ ID NO: 2971 - DNA, 20 bp, Chlamydia pneumoniae
tccttcccttcctttagagc

SEQ ID NO: 2972 - DNA, 20 bp, Chlamydia pneumoniae
ggcgttacagcaatttggga

SEQ ID NO: 2973 - DNA, 20 bp, Chlamydia pneumoniae
gcaggcctatgttttgcagt

SEQ ID NO: 2974 - DNA, 20 bp, Chlamydia pneumoniae
gtgtacctgagtacatgacg

SEQ ID NO: 2975 - DNA, 20 bp, Chlamydia pneumoniae
cactcttgcctcttgtagaa

SEQ ID NO: 2976 - DNA, 20 bp, Chlamydia pneumoniae
tgcttgtcaaactgccatcg

SEQ ID NO: 2977 - DNA, 20 bp, Chlamydia pneumoniae
cgactcagtcctttagctcg

SEQ ID NO: 2978 - DNA, 20 bp, Chlamydia pneumoniae
ccagaaacccggcaattttg

SEQ ID NO: 2979 - DNA, 20 bp, Chlamydia pneumoniae
catggacacttaggagagag

SEQ ID NO: 2980 - DNA, 20 bp, Chlamydia pneumoniae
cgagcaaaggaaatccctca

SEQ ID NO: 2981 - DNA, 20 bp, Chlamydia pneumoniae
ctttaaggttgctggcctgt

SEQ ID NO: 2982 - DNA, 20 bp, Chlamydia pneumoniae
gctctatctacagaaagcgg

SEQ ID NO: 2983 - DNA, 20 bp, Chlamydia pneumoniae
actgcaaaaacgcggcaggc

SEQ ID NO: 2984 - DNA, 20 bp, Chlamydia pneumoniae
cacccggatctcagggcata

SEQ ID NO: 2985 - DNA, 20 bp, Chlamydia pneumoniae
gaggatatgcgttccctctt

SEQ ID NO: 2986 - DNA, 20 bp, Chlamydia pneumoniae
cgaatgtagatcctctcgtc

SEQ ID NO: 2987 - DNA, 20 bp, Chlamydia pneumoniae
gaattccacctccttacctg

SEQ ID NO: 2988 - DNA, 20 bp, Chlamydia pneumoniae
aagcaagcgtcttcatacgc

SEQ ID NO: 2989 - DNA, 20 bp, Chlamydia pneumoniae
ccccacctgggatcaattat

SEQ ID NO: 2990 - DNA, 20 bp, Chlamydia pneumoniae
gagaccttcagggaaaccta

SEQ ID NO: 2991 - DNA, 20 bp, Chlamydia pneumoniae
atacctcacccggatctcag

SEQ ID NO: 2992 - DNA, 20 bp, Chlamydia pneumoniae
ggcaaaaatcctgtagatcc

SEQ ID NO: 2993 - DNA, 20 bp, Chlamydia pneumoniae
gatatccagggtagcgcttt

SEQ ID NO: 2994 - DNA, 20 bp, Chlamydia pneumoniae
gattccctgtgtctttgtgc

SEQ ID NO: 2995 - DNA, 20 bp, Chlamydia pneumoniae
ttcgctcccccagcacctac

SEQ ID NO: 2996 - DNA, 20 bp, Chlamydia pneumoniae
gctaatgagactgtctttgg

SEQ ID NO: 2997 - DNA, 20 bp, Chlamydia pneumoniae
ccctctgatccaaaacttcg

SEQ ID NO: 2998 - DNA, 20 bp, Chlamydia pneumoniae
gaacatctcctaagctgctg

SEQ ID NO: 2999 - DNA, 20 bp, Chlamydia pneumoniae
gaatgaacaccctcagcact

SEQ ID NO: 3000 - DNA, 20 bp, Chlamydia pneumoniae
gacatctccaagagttctgc

SEQ ID NO: 3001 - DNA, 20 bp, Chlamydia pneumoniae
gttgttggtggttcatgggt

SEQ ID NO: 3002 - DNA, 20 bp, Chlamydia pneumoniae
gcttccgcactcttatttgc

SEQ ID NO: 3003 - DNA, 20 bp, Chlamydia pneumoniae
caaaggccttaccaaagcac

SEQ ID NO: 3004 - DNA, 20 bp, Chlamydia pneumoniae
gcgtttctacaaaaccccgt

SEQ ID NO: 3005 - DNA, 20 bp, Chlamydia pneumoniae
ggactactgggttatcttgc

SEQ ID NO: 3006 - DNA, 20 bp, Chlamydia pneumoniae
ctctcatgatcttctcgctg

SEQ ID NO: 3007 - DNA, 20 bp, Chlamydia pneumoniae
gcttgggcgaaccaaaactt

SEQ ID NO: 3008 - DNA, 20 bp, Chlamydia pneumoniae
cgatacctgtcagcagcttt

SEQ ID NO: 3009 - DNA, 20 bp, Chlamydia pneumoniae
gcatcacgtgttgtctttgc

SEQ ID NO: 3010 - DNA, 20 bp, Chlamydia pneumoniae
cccgaagcaatccagtagat

SEQ ID NO: 3011 - DNA, 20 bp, Chlamydia pneumoniae
tgaagcaaagcgccgtttac

SEQ ID NO: 3012 - DNA, 20 bp, Chlamydia pneumoniae
cgagccatgtatttcagtcc

SEQ ID NO: 3013 - DNA, 20 bp, Chlamydia pneumoniae
cgatacctgtcagcagcttt

SEQ ID NO: 3014 - DNA, 20 bp, Chlamydia pneumoniae
ggatgttgtggtgaagagtg

SEQ ID NO: 3015 - DNA, 20 bp, Chlamydia pneumoniae
cttggagagggctatatagg

SEQ ID NO: 3016 - DNA, 20 bp, Chlamydia pneumoniae
caaaatgcgggtcctttgag

SEQ ID NO: 3017 - DNA, 20 bp, Chlamydia pneumoniae
gctcaaggtgcggagtaaaa

SEQ ID NO: 3018 - DNA, 20 bp, Chlamydia pneumoniae
gattgtggtgtgacatgcca

SEQ ID NO: 3019 - DNA, 20 bp, Chlamydia pneumoniae
ggggcttggacaatctcatt

SEQ ID NO: 3020 - DNA, 20 bp, Chlamydia pneumoniae
ccacgtctcctcaagatttc

SEQ ID NO: 3021 - DNA, 20 bp, Chlamydia pneumoniae
caagaaatcccagtgcgagt

SEQ ID NO: 3022 - DNA, 20 bp, Chlamydia pneumoniae
ctgatgtcttcgcaacccat

SEQ ID NO: 3023 - DNA, 20 bp, Chlamydia pneumoniae
ccacgtctcctcaagatttc

SEQ ID NO: 3024 - DNA, 20 bp, Chlamydia pneumoniae
ccttgtgctgcctttactgt

SEQ ID NO: 3025 - DNA, 20 bp, Chlamydia pneumoniae
cctacctctctgctttcttc

SEQ ID NO: 3026 - DNA, 20 bp, Chlamydia pneumoniae
tcactcttctaaaggtctcg

SEQ ID NO: 3027 - DNA, 20 bp, Chlamydia pneumoniae
tcagccggcttctttaccca

SEQ ID NO: 3028 - DNA, 20 bp, Chlamydia pneumoniae
gagagacaaactccgattac

SEQ ID NO: 3029 - DNA, 20 bp, Chlamydia pneumoniae
gtcgatctccaagagtatct

SEQ ID NO: 3030 - DNA, 20 bp, Chlamydia pneumoniae
tctaaagaagccaccctctc

SEQ ID NO: 3031 - DNA, 20 bp, Chlamydia pneumoniae
ccaccaacttcttcacctga

SEQ ID NO: 3032 - DNA, 20 bp, Chlamydia pneumoniae
tcgggacgcttatctgcaaa

SEQ ID NO: 3033 - DNA, 20 bp, Chlamydia pneumoniae
ccccatctaatcctgttgtc

SEQ ID NO: 3034 - DNA, 20 bp, Chlamydia pneumoniae
gaacgacggtatccacaatc

SEQ ID NO: 3035 - DNA, 20 bp, Chlamydia pneumoniae
atcggcatcccaaggtccta

SEQ ID NO: 3036 - DNA, 20 bp, Chlamydia pneumoniae
ccgttcttcttgcgatgagt

SEQ ID NO: 3037 - DNA, 20 bp, Chlamydia pneumoniae
ccaccaagtagtggtgtaac

SEQ ID NO: 3038 - DNA, 20 bp, Chlamydia pneumoniae
gggtttttagaggtttgtgg

SEQ ID NO: 3039 - DNA, 20 bp, Chlamydia pneumoniae
cgcagattggccttcttcta

SEQ ID NO: 3040 - DNA, 20 bp, Chlamydia pneumoniae
ctgtgatcttttggctttga

SEQ ID NO: 3041 - DNA, 20 bp, Chlamydia pneumoniae
cacttgctggtactgcacta

SEQ ID NO: 3042 - DNA, 20 bp, Chlamydia pneumoniae
ctgacgtccgatgtatttgc

SEQ ID NO: 3043 - DNA, 20 bp, Chlamydia pneumoniae
gccgatgagaattcctgtag

SEQ ID NO: 3044 - DNA, 20 bp, Chlamydia pneumoniae
gattggcgttgctgaattcc

SEQ ID NO: 3045 - DNA, 20 bp, Chlamydia pneumoniae
gggaagatgtccgttcagtt

SEQ ID NO: 3046 - DNA, 20 bp, Chlamydia pneumoniae
ctacagctaaagctgagtcc

SEQ ID NO: 3047 - DNA, 20 bp, Chlamydia pneumoniae
ggagatgtcttcttcaccga

SEQ ID NO: 3048 - DNA, 20 bp, Chlamydia pneumoniae
caccagactctacagtacca

SEQ ID NO: 3049 - DNA, 20 bp, Chlamydia pneumoniae
gaaccaacgacctaagtctc

SEQ ID NO: 3050 - DNA, 20 bp, Chlamydia pneumoniae
gcgaagataaactgagatcc

SEQ ID NO: 3051 - DNA, 20 bp, Chlamydia pneumoniae
gtgttcttgacctcggttag

SEQ ID NO: 3052 - DNA, 20 bp, Chlamydia pneumoniae
agacgcagaaggcattagca

SEQ ID NO: 3053 - DNA, 20 bp, Chlamydia pneumoniae
gagatcctcagtaacaaaca

SEQ ID NO: 3054 - DNA, 20 bp, Chlamydia pneumoniae
ttcaggagtatgcgtaccgt

SEQ ID NO: 3055 - DNA, 20 bp, Chlamydia pneumoniae
cgattcttcttagccggagt

SEQ ID NO: 3056 - DNA, 20 bp, Chlamydia pneumoniae
gggagtgaatacgatgaggt

SEQ ID NO: 3057 - DNA, 20 bp, Chlamydia pneumoniae
cagctggtcttgaggtttac

SEQ ID NO: 3058 - DNA, 20 bp, Chlamydia pneumoniae
ggagcttcctaaagcatgtc

SEQ ID NO: 3059 - DNA, 20 bp, Chlamydia pneumoniae
cggtctctgtatacgatacg

SEQ ID NO: 3060 - DNA, 20 bp, Chlamydia pneumoniae
ctccagacaagacaagaact

SEQ ID NO: 3061 - DNA, 20 bp, Chlamydia pneumoniae
ccccttcaagatctcatagg

SEQ ID NO: 3062 - DNA, 20 bp, Chlamydia pneumoniae
ggatggaggatcttcattcc

SEQ ID NO: 3063 - DNA, 20 bp, Chlamydia pneumoniae
cacccagaaacccttcagtt

SEQ ID NO: 3064 - DNA, 20 bp, Chlamydia pneumoniae
gccttcttgatggcaaacct

SEQ ID NO: 3065 - DNA, 20 bp, Chlamydia pneumoniae
cggggtattgtgcagaagat

SEQ ID NO: 3066 - DNA, 20 bp, Chlamydia pneumoniae
ccgacaagctttcagatgct

SEQ ID NO: 3067 - DNA, 20 bp, Chlamydia pneumoniae
ctctaaggctagaaatcccc

SEQ ID NO: 3068 - DNA, 20 bp, Chlamydia pneumoniae
ctgcgcaatctttggctact

SEQ ID NO: 3069 - DNA, 20 bp, Chlamydia pneumoniae
gagagggtagtgaaagttcc

SEQ ID NO: 3070 - DNA, 20 bp, Chlamydia pneumoniae
gcagtcgtcgtgttttctca

SEQ ID NO: 3071 - DNA, 20 bp, Chlamydia pneumoniae
ccaagtttcgtatgtggttg

SEQ ID NO: 3072 - DNA, 20 bp, Chlamydia pneumoniae
ggtcgtgctttgaagatgac

SEQ ID NO: 3073 - DNA, 20 bp, Chlamydia pneumoniae
cgtcgattttgcactcaagg

SEQ ID NO: 3074 - DNA, 20 bp, Chlamydia pneumoniae
cctgatgctgttttgcaagg

SEQ ID NO: 3075 - DNA, 20 bp, Chlamydia pneumoniae
cgagtgcataatgttgctgc

SEQ ID NO: 3076 - DNA, 20 bp, Chlamydia pneumoniae
ggggtggaaggttttagatg

SEQ ID NO: 3077 - DNA, 20 bp, Chlamydia pneumoniae
cgttggtctgaaggaaagtt

SEQ ID NO: 3078 - DNA, 20 bp, Chlamydia pneumoniae
gagctagggtacatttctgg

SEQ ID NO: 3079 - DNA, 20 bp, Chlamydia pneumoniae
cggagccttgttcttgtaag

SEQ ID NO: 3080 - DNA, 20 bp, Chlamydia pneumoniae
ccataaatgggactcatggc

SEQ ID NO: 3081 - DNA, 20 bp, Chlamydia pneumoniae
gcactagaatacaaggacct

SEQ ID NO: 3082 - DNA, 20 bp, Chlamydia pneumoniae
cgtaattgcttgcaagaggc

SEQ ID NO: 3083 - DNA, 20 bp, Chlamydia pneumoniae
cgaggggataagaacaggat

SEQ ID NO: 3084 - DNA, 20 bp, Chlamydia pneumoniae
gcctatatctttgcttcttg

SEQ ID NO: 3085 - DNA, 20 bp, Chlamydia pneumoniae
cagacgagctggtgatttga

SEQ ID NO: 3086 - DNA, 20 bp, Chlamydia pneumoniae
cctaccgttgcatgtccgca

SEQ ID NO: 3087 - DNA, 20 bp, Chlamydia pneumoniae
ctaggacgggaagtatactc

SEQ ID NO: 3088 - DNA, 20 bp, Chlamydia pneumoniae
ctaatttccgcggctaaggt

SEQ ID NO: 3089 - DNA, 20 bp, Chlamydia pneumoniae
ggaagcacagtttgtgggaa

SEQ ID NO: 3090 - DNA, 20 bp, Chlamydia pneumoniae
ggtctatatgaaggctagca

SEQ ID NO: 3091 - DNA, 20 bp, Chlamydia pneumoniae
ctgtaggacgtaaccgttga

SEQ ID NO: 3092 - DNA, 20 bp, Chlamydia pneumoniae
cgattgtgcatggcgcagag

SEQ ID NO: 3093 - DNA, 20 bp, Chlamydia pneumoniae
cgggctttctcttcagagtt

SEQ ID NO: 3094 - DNA, 20 bp, Chlamydia pneumoniae
ggtccaggagtctgattcaa

SEQ ID NO: 3095 - DNA, 20 bp, Chlamydia pneumoniae
ctaggacacgaaacgtggaa

SEQ ID NO: 3096 - DNA, 20 bp, Chlamydia pneumoniae
ggcgcgatgccttggttaat

SEQ ID NO: 3097 - DNA, 20 bp, Chlamydia pneumoniae
aactcagtaagtggcgattg

SEQ ID NO: 3098 - DNA, 20 bp, Chlamydia pneumoniae
ggagctgtttacagatgcca

SEQ ID NO: 3099 - DNA, 20 bp, Chlamydia pneumoniae
gtatccaaggcttgttggca

SEQ ID NO: 3100 - DNA, 20 bp, Chlamydia pneumoniae
gaagctcccatgaatgaagg

SEQ ID NO: 3101 - DNA, 20 bp, Chlamydia pneumoniae
ctgcgaagtagagcgtcttc

SEQ ID NO: 3102 - DNA, 20 bp, Chlamydia pneumoniae
ggggaagtttatagtcagga

SEQ ID NO: 3103 - DNA, 20 bp, Chlamydia pneumoniae
gcttttccgcgtcactttga

SEQ ID NO: 3104 - DNA, 20 bp, Chlamydia pneumoniae
agcatatcgcacaaagagcg

SEQ ID NO: 3105 - DNA, 20 bp, Chlamydia pneumoniae
gcctttgctctgtgagaaac

SEQ ID NO: 3106 - DNA, 20 bp, Chlamydia pneumoniae
gcgttgttgattgaggactc

SEQ ID NO: 3107 - DNA, 20 bp, Chlamydia pneumoniae
cacgtcgatcttccatatgc

SEQ ID NO: 3108 - DNA, 20 bp, Chlamydia pneumoniae
ctttcagaggagttttcctg

SEQ ID NO: 3109 - DNA, 20 bp, Chlamydia pneumoniae
ggagatggtctaccagcaat

SEQ ID NO: 3110 - DNA, 20 bp, Chlamydia pneumoniae
ggactgctgacatctccaag

SEQ ID NO: 3111 - DNA, 20 bp, Chlamydia pneumoniae
gcgacaagtcgttttggaag

SEQ ID NO: 3112 - DNA, 20 bp, Chlamydia pneumoniae
ggtttctggttttgctgctg

SEQ ID NO: 3113 - DNA, 20 bp, Chlamydia pneumoniae
tgcgatcccctcattgtaac

SEQ ID NO: 3114 - DNA, 20 bp, Chlamydia pneumoniae
ctgcaacttggcttgacttg

SEQ ID NO: 3115 - DNA, 20 bp, Chlamydia pneumoniae
cctacggaattgcacgcatt

SEQ ID NO: 3116 - DNA, 20 bp, Chlamydia pneumoniae
gcgagctgaggtatttctgt

SEQ ID NO: 3117 - DNA, 20 bp, Chlamydia pneumoniae
ctggttttgctgctgtccat

SEQ ID NO: 3118 - DNA, 20 bp, Chlamydia pneumoniae
attgggctgtagatggccag

SEQ ID NO: 3119 - DNA, 20 bp, Chlamydia pneumoniae
cgcaaggttctcttcacctt

SEQ ID NO: 3120 - DNA, 20 bp, Chlamydia pneumoniae
tttgtggctgcgtagtacag

SEQ ID NO: 3121 - DNA, 20 bp, Chlamydia pneumoniae
ctggcaatgcaagtaaagcc

SEQ ID NO: 3122 - DNA, 20 bp, Chlamydia pneumoniae
ccaggagcaagagctataga

SEQ ID NO: 3123 - DNA, 20 bp, Chlamydia pneumoniae
cctgaagttagtgagaacgg

SEQ ID NO: 3124 - DNA, 20 bp, Chlamydia pneumoniae
gatcggatgctcgttcaaag

SEQ ID NO: 3125 - DNA, 20 bp, Chlamydia pneumoniae
acggccgtctttgttcgata

SEQ ID NO: 3126 - DNA, 20 bp, Chlamydia pneumoniae
gtccaagtacacacagaaag

SEQ ID NO: 3127 - DNA, 20 bp, Chlamydia pneumoniae
ctagcgatgcgaagcaaaag

SEQ ID NO: 3128 - DNA, 20 bp, Chlamydia pneumoniae
gagagaagtgtaccatggaa

SEQ ID NO: 3129 - DNA, 20 bp, Chlamydia pneumoniae
gggatagagcgttaggattc

SEQ ID NO: 3130 - DNA, 20 bp, Chlamydia pneumoniae
gcagcatatgctgccctttt

SEQ ID NO: 3131 - DNA, 20 bp, Chlamydia pneumoniae
gaggaagagggcactacatt

SEQ ID NO: 3132 - DNA, 20 bp, Chlamydia pneumoniae
ccgttgccaatgtaaaaggg

SEQ ID NO: 3133 - DNA, 20 bp, Chlamydia pneumoniae
gcaaacctaggagggaagtt

SEQ ID NO: 3134 - DNA, 20 bp, Chlamydia pneumoniae
gtgatgccttgggatcacta

SEQ ID NO: 3135 - DNA, 20 bp, Chlamydia pneumoniae
cacaagcattcgtaggtgga

SEQ ID NO: 3136 - DNA, 20 bp, Chlamydia pneumoniae
gcgattactaagggagctct

SEQ ID NO: 3137 - DNA, 20 bp, Chlamydia pneumoniae
gtcggagaggaactcctatt

SEQ ID NO: 3138 - DNA, 20 bp, Chlamydia pneumoniae
gcaatttcccaagcgcgtta

SEQ ID NO: 3139 - DNA, 20 bp, Chlamydia pneumoniae
ggacgtgcttgcggcattat

SEQ ID NO: 3140 - DNA, 20 bp, Chlamydia pneumoniae
ccgtagtacggtaggcttta

SEQ ID NO: 3141 - DNA, 20 bp, Chlamydia pneumoniae
gagagtgggatccttcttct

SEQ ID NO: 3142 - DNA, 20 bp, Chlamydia pneumoniae
gcagaaggagatgcatagga

SEQ ID NO: 3143 - DNA, 20 bp, Chlamydia pneumoniae
tcgatttccccattgtcagc

SEQ ID NO: 3144 - DNA, 20 bp, Chlamydia pneumoniae
ggaacgtctttcctctagtg

SEQ ID NO: 3145 - DNA, 20 bp, Chlamydia pneumoniae
cctgtggacggcatcagcag

SEQ ID NO: 3146 - DNA, 20 bp, Chlamydia pneumoniae
ccgtagaaacggcaaatcag

SEQ ID NO: 3147 - DNA, 20 bp, Chlamydia pneumoniae
caccacctacagtaatggca

SEQ ID NO: 3148 - DNA, 20 bp, Chlamydia pneumoniae
gggtctatggagagcacgat

SEQ ID NO: 3149 - DNA, 20 bp, Chlamydia pneumoniae
ggctccctaagagaatgcaa

SEQ ID NO: 3150 - DNA, 20 bp, Chlamydia pneumoniae
gcagttggcacgcatttatg

SEQ ID NO: 3151 - DNA, 20 bp, Chlamydia pneumoniae
gatcccttggagttcttgag

SEQ ID NO: 3152 - DNA, 20 bp, Chlamydia pneumoniae
agggcatttgcggaaatgcg

SEQ ID NO: 3153 - DNA, 20 bp, Chlamydia pneumoniae
cggagggaatcaagtgagtc

SEQ ID NO: 3154 - DNA, 20 bp, Chlamydia pneumoniae
ccttaacaggcacactaagc

SEQ ID NO: 3155 - DNA, 20 bp, Chlamydia pneumoniae
gtttaagcagatccgaaacc

SEQ ID NO: 3156 - DNA, 20 bp, Chlamydia pneumoniae
cgttgggtggtcagatacta

SEQ ID NO: 3157 - DNA, 20 bp, Chlamydia pneumoniae
gggactttaggaggaactac

SEQ ID NO: 3158 - DNA, 20 bp, Chlamydia pneumoniae
aagaagctcgagtgttcgac

SEQ ID NO: 3159 - DNA, 20 bp, Chlamydia pneumoniae
ccgttcccaagttcatggaa

SEQ ID NO: 3160 - DNA, 20 bp, Chlamydia pneumoniae
acagatggtgaataccgtgc

SEQ ID NO: 3161 - DNA, 20 bp, Chlamydia pneumoniae
ggcagtagaattgtaggagc

SEQ ID NO: 3162 - DNA, 20 bp, Chlamydia pneumoniae
gctgccatattttcctctcg

SEQ ID NO: 3163 - DNA, 20 bp, Chlamydia pneumoniae
gatccgaggccttggtattt

SEQ ID NO: 3164 - DNA, 20 bp, Chlamydia pneumoniae
ggaccatccataagctactc

SEQ ID NO: 3165 - DNA, 20 bp, Chlamydia pneumoniae
ggttatgaaggtggcaatgc

SEQ ID NO: 3166 - DNA, 20 bp, Chlamydia pneumoniae
tggatatcggcaatgacagc

SEQ ID NO: 3167 - DNA, 20 bp, Chlamydia pneumoniae
tcgacaatccccgcgattat

SEQ ID NO: 3168 - DNA, 20 bp, Chlamydia pneumoniae
gtttctgagacagccgcaaa

SEQ ID NO: 3169 - DNA, 20 bp, Chlamydia pneumoniae
cagccatttgcgcaacttga

SEQ ID NO: 3170 - DNA, 20 bp, Chlamydia pneumoniae
gctgagcagctagcgttttg

SEQ ID NO: 3171 - DNA, 20 bp, Chlamydia pneumoniae
ctgatcctgctctgcttctt

SEQ ID NO: 3172 - DNA, 20 bp, Chlamydia pneumoniae
cctacacttagccaatcagc

SEQ ID NO: 3173 - DNA, 20 bp, Chlamydia pneumoniae
gaggggaaacggaatccata

SEQ ID NO: 3174 - DNA, 20 bp, Chlamydia pneumoniae
ctgaggagcaagttcttgtg

SEQ ID NO: 3175 - DNA, 20 bp, Chlamydia pneumoniae
ctgtcaggatattcctaggg

SEQ ID NO: 3176 - DNA, 20 bp, Chlamydia pneumoniae
gctgggtaagatcaggttct

SEQ ID NO: 3177 - DNA, 20 bp, Chlamydia pneumoniae
ccttgacgatagcgtgcttt

SEQ ID NO: 3178 - DNA, 20 bp, Chlamydia pneumoniae
gcaccaagatgaagggttgt

SEQ ID NO: 3179 - DNA, 20 bp, Chlamydia pneumoniae
gcaggtattctgcacatcag

SEQ ID NO: 3180 - DNA, 20 bp, Chlamydia pneumoniae
acacaacagcaaggctgtca

SEQ ID NO: 3181 - DNA, 20 bp, Chlamydia pneumoniae
cgtccgctattgaagtgctt

SEQ ID NO: 3182 - DNA, 20 bp, Chlamydia pneumoniae
gctcacgaatcaactctgtc

SEQ ID NO: 3183 - DNA, 20 bp, Chlamydia pneumoniae
ggcagattctgtaagccaac

SEQ ID NO: 3184 - DNA, 20 bp, Chlamydia pneumoniae
ctgctgtagtaccttcgagt

SEQ ID NO: 3185 - DNA, 20 bp, Chlamydia pneumoniae
gctgtttacagcgatggtct

SEQ ID NO: 3186 - DNA, 20 bp, Chlamydia pneumoniae
gctacaacctgtacgccaaa

SEQ ID NO: 3187 - DNA, 20 bp, Chlamydia pneumoniae
catcgtcgatttgcagtgtg

SEQ ID NO: 3188 - DNA, 20 bp, Chlamydia pneumoniae
gtttgtgtttgagagtccgc

SEQ ID NO: 3189 - DNA, 20 bp, Chlamydia pneumoniae
ggtcccgtttttttgcttcc

SEQ ID NO: 3190 - DNA, 20 bp, Chlamydia pneumoniae
gctaccgaagttgaggattt

SEQ ID NO: 3191 - DNA, 20 bp, Chlamydia pneumoniae
cgaggcggttttgttggtat

SEQ ID NO: 3192 - DNA, 20 bp, Chlamydia pneumoniae
agcaccagcaatagtggcat

SEQ ID NO: 3193 - DNA, 20 bp, Chlamydia pneumoniae
agctgatgcttgatggttcg

SEQ ID NO: 3194 - DNA, 20 bp, Chlamydia pneumoniae
gagccgcgatgatgctatta

SEQ ID NO: 3195 - DNA, 20 bp, Chlamydia pneumoniae
gctaccgaagttgaggattt

SEQ ID NO: 3196 - DNA, 20 bp, Chlamydia pneumoniae
gggcttgctcatcgatctaa

SEQ ID NO: 3197 - DNA, 20 bp, Chlamydia pneumoniae
agaaaccgcgatcatcacag

SEQ ID NO: 3198 - DNA, 20 bp, Chlamydia pneumoniae
tgctattggcagcaaggggc

SEQ ID NO: 3199 - DNA, 20 bp, Chlamydia pneumoniae
cttccgtaggtacgggatgg

SEQ ID NO: 3200 - DNA, 20 bp, Chlamydia pneumoniae
ggaagtcaggtgaaactgga

SEQ ID NO: 3201 - DNA, 20 bp, Chlamydia pneumoniae
ccacacgtcaaggacagaaa

SEQ ID NO: 3202 - DNA, 20 bp, Chlamydia pneumoniae
ggaaagcttaggggggattc

SEQ ID NO: 3203 - DNA, 20 bp, Chlamydia pneumoniae
gcgatgtgcaagaagaagag

SEQ ID NO: 3204 - DNA, 20 bp, Chlamydia pneumoniae
ggaaaggtaacaggacctct

SEQ ID NO: 3205 - DNA, 20 bp, Chlamydia pneumoniae
gcctttagagtgcttcacag

SEQ ID NO: 3206 - DNA, 20 bp, Chlamydia pneumoniae
catcagacagtctcacggag

SEQ ID NO: 3207 - DNA, 20 bp, Chlamydia pneumoniae
ggagcagacgattatgaggg

SEQ ID NO: 3208 - DNA, 20 bp, Chlamydia pneumoniae
gctccatacgaatgacgcta

SEQ ID NO: 3209 - DNA, 20 bp, Chlamydia pneumoniae
ccgtatcgaggtgctgttat

SEQ ID NO: 3210 - DNA, 20 bp, Chlamydia pneumoniae
gcgtgcattgtttcgttccg

SEQ ID NO: 3211 - DNA, 20 bp, Chlamydia pneumoniae
gcgagtccttctgtagttac

SEQ ID NO: 3212 - DNA, 20 bp, Chlamydia pneumoniae
aatcgaaggtctcgacttgg

SEQ ID NO: 3213 - DNA, 20 bp, Chlamydia pneumoniae
agaatccgctaccgcattga

SEQ ID NO: 3214 - DNA, 20 bp, Chlamydia pneumoniae
cgaggcagtatccataaagg

SEQ ID NO: 3215 - DNA, 20 bp, Chlamydia pneumoniae
cgatatccttatggtcggag

SEQ ID NO: 3216 - DNA, 20 bp, Chlamydia pneumoniae
ccacaggtcttttgaggaag

SEQ ID NO: 3217 - DNA, 20 bp, Chlamydia pneumoniae
gcgtgcattgtttcgttccg

SEQ ID NO: 3218 - DNA, 20 bp, Chlamydia pneumoniae
cggtacgagcttctctccat

SEQ ID NO: 3219 - DNA, 20 bp, Chlamydia pneumoniae
ctcgaagggtgtctgcaaaa

SEQ ID NO: 3220 - DNA, 20 bp, Chlamydia pneumoniae
cgcaccgacttccgcctgga

SEQ ID NO: 3221 - DNA, 20 bp, Chlamydia pneumoniae
cttggtgtaaagagggtagg

SEQ ID NO: 3222 - DNA, 20 bp, Chlamydia pneumoniae
tcgatgtcgctgcccttcaa

SEQ ID NO: 3223 - DNA, 20 bp, Chlamydia pneumoniae
ggggtctcgacgtaaactta

SEQ ID NO: 3224 - DNA, 20 bp, Chlamydia pneumoniae
gccctcctttcctcaacttt

SEQ ID NO: 3225 - DNA, 20 bp, Chlamydia pneumoniae
cgaggagcctggatcattat

SEQ ID NO: 3226 - DNA, 20 bp, Chlamydia pneumoniae
ccgccaagacttttggaaag

SEQ ID NO: 3227 - DNA, 20 bp, Chlamydia pneumoniae
caaactctcagtcgctactg

SEQ ID NO: 3228 - DNA, 20 bp, Chlamydia pneumoniae
ccctccagagatcattaagg

SEQ ID NO: 3229 - DNA, 20 bp, Chlamydia pneumoniae
cgatacgatttgctcccctt

SEQ ID NO: 3230 - DNA, 20 bp, Chlamydia pneumoniae
tgatcataagcccttggagc

SEQ ID NO: 3231 - DNA, 20 bp, Chlamydia pneumoniae
cctccaaagaatcgtcctca

SEQ ID NO: 3232 - DNA, 20 bp, Chlamydia pneumoniae
tcatcagcattcagtggggg

SEQ ID NO: 3233 - DNA, 20 bp, Chlamydia pneumoniae
gagcctaggggattagagta

SEQ ID NO: 3234 - DNA, 20 bp, Chlamydia pneumoniae
cgtggatgatgaagtctcag

SEQ ID NO: 3235 - DNA, 20 bp, Chlamydia pneumoniae
gagacagagctggcacatct

SEQ ID NO: 3236 - DNA, 20 bp, Chlamydia pneumoniae
cagctctttggcatcaagga

SEQ ID NO: 3237 - DNA, 20 bp, Chlamydia pneumoniae
gccggaggatgttgaaagat

SEQ ID NO: 3238 - DNA, 20 bp, Chlamydia pneumoniae
ctctggcaaccacgctaata

SEQ ID NO: 3239 - DNA, 20 bp, Chlamydia pneumoniae
ccgtggggaacatcacataa

SEQ ID NO: 3240 - DNA, 20 bp, Chlamydia pneumoniae
cttggcttccaaggcattct

SEQ ID NO: 3241 - DNA, 20 bp, Chlamydia pneumoniae
cgagggacaggagttttcat

SEQ ID NO: 3242 - DNA, 20 bp, Chlamydia pneumoniae
aagctctctacctttgttgc

SEQ ID NO: 3243 - DNA, 20 bp, Chlamydia pneumoniae
gcttatgaacgaactgtcgt

SEQ ID NO: 3244 - DNA, 20 bp, Chlamydia pneumoniae
ccttgcagcatgacattcac

SEQ ID NO: 3245 - DNA, 20 bp, Chlamydia pneumoniae
cgggatgaggagattcaaca

SEQ ID NO: 3246 - DNA, 20 bp, Chlamydia pneumoniae
ggccggctttggatagttat

SEQ ID NO: 3247 - DNA, 20 bp, Chlamydia pneumoniae
gagttaggggtaggacgtta

SEQ ID NO: 3248 - DNA, 20 bp, Chlamydia pneumoniae
cgagagcaaggtaggtggca

SEQ ID NO: 3249 - DNA, 20 bp, Chlamydia pneumoniae
gcggggtatctacgtgttcg

SEQ ID NO: 3250 - DNA, 20 bp, Chlamydia pneumoniae
cgagctttttagggaggact

SEQ ID NO: 3251 - DNA, 20 bp, Chlamydia pneumoniae
gaagatcgcaaggatgacag

SEQ ID NO: 3252 - DNA, 20 bp, Chlamydia pneumoniae
gcaaacgttccctcggtaaa

SEQ ID NO: 3253 - DNA, 20 bp, Chlamydia pneumoniae
cgctgacaaagcaatgcgct

SEQ ID NO: 3254 - DNA, 20 bp, Chlamydia pneumoniae
cctgagtggacatggttaca

SEQ ID NO: 3255 - DNA, 20 bp, Chlamydia pneumoniae
cctatgacataagctccgag

SEQ ID NO: 3256 - DNA, 20 bp, Chlamydia pneumoniae
ggatgcgctcttcaagtgta

SEQ ID NO: 3257 - DNA, 20 bp, Chlamydia pneumoniae
gaccaatagccaccaagaca

SEQ ID NO: 3258 - DNA, 20 bp, Chlamydia pneumoniae
cgtctatccgacagaggatt

SEQ ID NO: 3259 - DNA, 20 bp, Chlamydia pneumoniae
gaagaggaccctgtgcttat

SEQ ID NO: 3260 - DNA, 20 bp, Chlamydia pneumoniae
gcaacgtattctacagaacc

SEQ ID NO: 3261 - DNA, 20 bp, Chlamydia pneumoniae
gagcgtcagagggaagataa

SEQ ID NO: 3262 - DNA, 20 bp, Chlamydia pneumoniae
caggacaactgcaagaagca

SEQ ID NO: 3263 - DNA, 20 bp, Chlamydia pneumoniae
ggaggtaaacacgctgcttt

SEQ ID NO: 3264 - DNA, 20 bp, Chlamydia pneumoniae
cagctccgaagaacatagca

SEQ ID NO: 3265 - DNA, 20 bp, Chlamydia pneumoniae
cgcgagttccaacttaggaa

SEQ ID NO: 3266 - DNA, 20 bp, Chlamydia pneumoniae
ctggtatagcttccctggag

SEQ ID NO: 3267 - DNA, 20 bp, Chlamydia pneumoniae
catcctgtcgaaagatggct

SEQ ID NO: 3268 - DNA, 20 bp, Chlamydia pneumoniae
cagagagtcgtacaacagca

SEQ ID NO: 3269 - DNA, 20 bp, Chlamydia pneumoniae
ggacaaaaggtagagttacg

SEQ ID NO: 3270 - DNA, 20 bp, Chlamydia pneumoniae
cggcaacgtcctctatttag

SEQ ID NO: 3271 - DNA, 20 bp, Chlamydia pneumoniae
gaggtttttccagcctcttg

SEQ ID NO: 3272 - DNA, 20 bp, Chlamydia pneumoniae
gacgttcgcagattttgcga

SEQ ID NO: 3273 - DNA, 20 bp, Chlamydia pneumoniae
ggacgttaccttgtgtatcc

SEQ ID NO: 3274 - DNA, 20 bp, Chlamydia pneumoniae
ggtctccctggtctgtattt

SEQ ID NO: 3275 - DNA, 20 bp, Chlamydia pneumoniae
ctccatcaagctatcgaagc

SEQ ID NO: 3276 - DNA, 20 bp, Chlamydia pneumoniae
gagttgtcccctcttgagaa

SEQ ID NO: 3277 - DNA, 20 bp, Chlamydia pneumoniae
gggtccattctgaccaaact

SEQ ID NO: 3278 - DNA, 20 bp, Chlamydia pneumoniae
caatactgatgacgtctggg

SEQ ID NO: 3279 - DNA, 20 bp, Chlamydia pneumoniae
gctcttcattgagaagaccg

SEQ ID NO: 3280 - DNA, 20 bp, Chlamydia pneumoniae
gtaggttctgtaaggatggc

SEQ ID NO: 3281 - DNA, 20 bp, Chlamydia pneumoniae
cagcttccttagcgccggtg

SEQ ID NO: 3282 - DNA, 20 bp, Chlamydia pneumoniae
aggggtaagcaccctgagat

SEQ ID NO: 3283 - DNA, 20 bp, Chlamydia pneumoniae
tactgttgcggcttcctcac

SEQ ID NO: 3284 - DNA, 20 bp, Chlamydia pneumoniae
ctttcgcagaagttaccacc

SEQ ID NO: 3285 - DNA, 20 bp, Chlamydia pneumoniae
ctaatgccggggcttcttta

SEQ ID NO: 3286 - DNA, 20 bp, Chlamydia pneumoniae
ccacggcccgtatcctcgac

SEQ ID NO: 3287 - DNA, 20 bp, Chlamydia pneumoniae
gcctgatatcctgcattacg

SEQ ID NO: 3288 - DNA, 20 bp, Chlamydia pneumoniae
ccaacagttctgctttgcga

SEQ ID NO: 3289 - DNA, 20 bp, Chlamydia pneumoniae
ccagtttttgcttgcttggc

SEQ ID NO: 3290 - DNA, 20 bp, Chlamydia pneumoniae
cgagacttcgattacagcgt

SEQ ID NO: 3291 - DNA, 20 bp, Chlamydia pneumoniae
gcgacatcgtaatcagcagc

SEQ ID NO: 3292 - DNA, 20 bp, Chlamydia pneumoniae
aaaagcgggtgatgaggctt

SEQ ID NO: 3293 - DNA, 20 bp, Chlamydia pneumoniae
catcatacggctatggggaa

SEQ ID NO: 3294 - DNA, 20 bp, Chlamydia pneumoniae
ggccataagactgtggtctt

SEQ ID NO: 3295 - DNA, 20 bp, Chlamydia pneumoniae
cgttcctttagtcgtttgcg

SEQ ID NO: 3296 - DNA, 20 bp, Chlamydia pneumoniae
ctgctgtagagaatcaagcg

SEQ ID NO: 3297 - DNA, 20 bp, Chlamydia pneumoniae
agcagcatctttggctttgc

SEQ ID NO: 3298 - DNA, 20 bp, Chlamydia pneumoniae
ggggcgctttaattaaggga

SEQ ID NO: 3299 - DNA, 20 bp, Chlamydia pneumoniae
ctcggaatgcaaaatcggtg

SEQ ID NO: 3300 - DNA, 20 bp, Chlamydia pneumoniae
agggacttcggggaagtttt

SEQ ID NO: 3301 - DNA, 20 bp, Chlamydia pneumoniae
ggttccaccaagaacagact

SEQ ID NO: 3302 - DNA, 20 bp, Chlamydia pneumoniae
ggcttgaatcttgacctaca

SEQ ID NO: 3303 - DNA, 20 bp, Chlamydia pneumoniae
ggctgaacctattcagcaga

SEQ ID NO: 3304 - DNA, 20 bp, Chlamydia pneumoniae
gggcaaaatggaattacccc

SEQ ID NO: 3305 - DNA, 20 bp, Chlamydia pneumoniae
cgcccaagttcaaacctcaa

SEQ ID NO: 3306 - DNA, 20 bp, Chlamydia pneumoniae
cttgtcgatggtaaggtgga

SEQ ID NO: 3307 - DNA, 20 bp, Chlamydia pneumoniae
caaactatagaggatgctgc

SEQ ID NO: 3308 - DNA, 20 bp, Chlamydia pneumoniae
gggagaagatacaatcccga

SEQ ID NO: 3309 - DNA, 20 bp, Chlamydia pneumoniae
gggtacggaacttgccatta

SEQ ID NO: 3310 - DNA, 20 bp, Chlamydia pneumoniae
ggaggtcactccttctacaa

SEQ ID NO: 3311 - DNA, 20 bp, Chlamydia pneumoniae
ccaacggccttctacactat

SEQ ID NO: 3312 - DNA, 20 bp, Chlamydia pneumoniae
gaggcaaatgacgttatcgg

SEQ ID NO: 3313 - DNA, 20 bp, Chlamydia pneumoniae
acctgcaaggccatttagag

SEQ ID NO: 3314 - DNA, 20 bp, Chlamydia pneumoniae
agagtgtaacggagataggg

SEQ ID NO: 3315 - DNA, 20 bp, Chlamydia pneumoniae
gaagaggttgacctgcaagt

SEQ ID NO: 3316 - DNA, 20 bp, Chlamydia pneumoniae
cgaagagattcgctctgttg

SEQ ID NO: 3317 - DNA, 20 bp, Chlamydia pneumoniae
gcatgatttcactgaggagg

SEQ ID NO: 3318 - DNA, 20 bp, Chlamydia pneumoniae
gtgtaacggagatagggaca

SEQ ID NO: 3319 - DNA, 20 bp, Chlamydia pneumoniae
gaagaggttgacctgcaagt

SEQ ID NO: 3320 - DNA, 20 bp, Chlamydia pneumoniae
ggtcgggttttagctgttgt

SEQ ID NO: 3321 - DNA, 20 bp, Chlamydia pneumoniae
ctggagttgttggtgatgga

SEQ ID NO: 3322 - DNA, 20 bp, Chlamydia pneumoniae
ccctaagttgtcagataggg

SEQ ID NO: 3323 - DNA, 20 bp, Chlamydia pneumoniae
ccatcgggataaagagtcca

SEQ ID NO: 3324 - DNA, 20 bp, Chlamydia pneumoniae
ctatggcattgttgccatcg

SEQ ID NO: 3325 - DNA, 20 bp, Chlamydia pneumoniae
ggaaggacttctgttccaag

SEQ ID NO: 3326 - DNA, 20 bp, Chlamydia pneumoniae
gggattagataagggtgacc

SEQ ID NO: 3327 - DNA, 20 bp, Chlamydia pneumoniae
ggagattgtggtgttgtcac

SEQ ID NO: 3328 - DNA, 20 bp, Chlamydia pneumoniae
gattttctacaagggctgcc

SEQ ID NO: 3329 - DNA, 20 bp, Chlamydia pneumoniae
ctatggcattgttgccatcg

SEQ ID NO: 3330 - DNA, 20 bp, Chlamydia pneumoniae
ggaatgtctacccatccaga

SEQ ID NO: 3331 - DNA, 20 bp, Chlamydia pneumoniae
tgacgcagttgcccatcagt

SEQ ID NO: 3332 - DNA, 20 bp, Chlamydia pneumoniae
tcgtcgtgagtgaagggaaa

SEQ ID NO: 3333 - DNA, 20 bp, Chlamydia pneumoniae
gagttagaggagctcttcct

SEQ ID NO: 3334 - DNA, 20 bp, Chlamydia pneumoniae
cctgcaatagatagagccct

SEQ ID NO: 3335 - DNA, 20 bp, Chlamydia pneumoniae
ttccgagtccttgatggcga

SEQ ID NO: 3336 - DNA, 20 bp, Chlamydia pneumoniae
caggacatcgttaggccatt

SEQ ID NO: 3337 - DNA, 20 bp, Chlamydia pneumoniae
ctgtagatcctcgacatctc

SEQ ID NO: 3338 - DNA, 20 bp, Chlamydia pneumoniae
gctacgagatcatcccaaca

SEQ ID NO: 3339 - DNA, 20 bp, Chlamydia pneumoniae
cccgctcagaaggaggaata

SEQ ID NO: 3340 - DNA, 20 bp, Chlamydia pneumoniae
tgttgcagtcgccactgatg

SEQ ID NO: 3341 - DNA, 20 bp, Chlamydia pneumoniae
aaagcgtcatgcgttgctcg

SEQ ID NO: 3342 - DNA, 20 bp, Chlamydia pneumoniae
gataccgatctgcaggaagc

SEQ ID NO: 3343 - DNA, 20 bp, Chlamydia pneumoniae
gtgttcgtggagggaatttc

SEQ ID NO: 3344 - DNA, 20 bp, Chlamydia pneumoniae
caggagtgccagcaagaaaa

SEQ ID NO: 3345 - DNA, 20 bp, Chlamydia pneumoniae
catgatgtgcgggctgctac

SEQ ID NO: 3346 - DNA, 20 bp, Chlamydia pneumoniae
agcgcacgattcgtaggaat

SEQ ID NO: 3347 - DNA, 20 bp, Chlamydia pneumoniae
tctacccgacctacaaaagc

SEQ ID NO: 3348 - DNA, 20 bp, Chlamydia pneumoniae
tctaccccttgcgttttagc

SEQ ID NO: 3349 - DNA, 20 bp, Chlamydia pneumoniae
gaacacgtagcgacctgtta

SEQ ID NO: 3350 - DNA, 20 bp, Chlamydia pneumoniae
cctatgattcttggggacca

SEQ ID NO: 3351 - DNA, 20 bp, Chlamydia pneumoniae
caacttgagctctgtcagca

SEQ ID NO: 3352 - DNA, 20 bp, Chlamydia pneumoniae
ggaatatggcataggagcac

SEQ ID NO: 3353 - DNA, 20 bp, Chlamydia pneumoniae
caaggaatcgccatgctacg

SEQ ID NO: 3354 - DNA, 20 bp, Chlamydia pneumoniae
gcaggtattggtgctctctc

SEQ ID NO: 3355 - DNA, 20 bp, Chlamydia pneumoniae
gagtggatcttcacaaggtc

SEQ ID NO: 3356 - DNA, 20 bp, Chlamydia pneumoniae
cctcttctctatcacgttgc

SEQ ID NO: 3357 - DNA, 20 bp, Chlamydia pneumoniae
ccatgctgtaacaatcgggt

SEQ ID NO: 3358 - DNA, 20 bp, Chlamydia pneumoniae
ttgccgcatttgcctccacc

SEQ ID NO: 3359 - DNA, 20 bp, Chlamydia pneumoniae
ctgggaagaccacgaaatgt

SEQ ID NO: 3360 - DNA, 20 bp, Chlamydia pneumoniae
cgcaacaggagagacaatgt

SEQ ID NO: 3361 - DNA, 20 bp, Chlamydia pneumoniae
gagaggttccctcaaaacct

SEQ ID NO: 3362 - DNA, 20 bp, Chlamydia pneumoniae
ccaggaagacgagcaaatct

SEQ ID NO: 3363 - DNA, 20 bp, Chlamydia pneumoniae
ccatattttgcgggttaact

SEQ ID NO: 3364 - DNA, 20 bp, Chlamydia pneumoniae
gaaatcttcgctgtgcaagg

SEQ ID NO: 3365 - DNA, 20 bp, Chlamydia pneumoniae
ggccgtgattggatttggaa

SEQ ID NO: 3366 - DNA, 20 bp, Chlamydia pneumoniae
ggagctggaggacataatag

SEQ ID NO: 3367 - DNA, 20 bp, Chlamydia pneumoniae
gctggctcctatttaggttc

SEQ ID NO: 3368 - DNA, 20 bp, Chlamydia pneumoniae
caatgggagtgttatacgcc

SEQ ID NO: 3369 - DNA, 20 bp, Chlamydia pneumoniae
tcattcctctagggggtgtt

SEQ ID NO: 3370 - DNA, 20 bp, Chlamydia pneumoniae
ggagtcgaagatagcgcaat

SEQ ID NO: 3371 - DNA, 20 bp, Chlamydia pneumoniae
ggatctacagcatcatgagg

SEQ ID NO: 3372 - DNA, 20 bp, Chlamydia pneumoniae
tggcgcaaggctttcaagaa

SEQ ID NO: 3373 - DNA, 20 bp, Chlamydia pneumoniae
gctgatgactgggatgaagt

SEQ ID NO: 3374 - DNA, 20 bp, Chlamydia pneumoniae
agagtaagtcgttgccaagc

SEQ ID NO: 3375 - DNA, 20 bp, Chlamydia pneumoniae
taccgaaaggagtgctggag

SEQ ID NO: 3376 - DNA, 20 bp, Chlamydia pneumoniae
gcgtgggatatatcaacgga

SEQ ID NO: 3377 - DNA, 20 bp, Chlamydia pneumoniae
ctttcgttaaggaactcggc

SEQ ID NO: 3378 - DNA, 20 bp, Chlamydia pneumoniae
ctagcctcctcagcaatttc

SEQ ID NO: 3379 - DNA, 20 bp, Chlamydia pneumoniae
ggaactgatagtgtggcgca

SEQ ID NO: 3380 - DNA, 20 bp, Chlamydia pneumoniae
agacctcgaagagatccctc

SEQ ID NO: 3381 - DNA, 20 bp, Chlamydia pneumoniae
gtatatggtgtgacgcctgc

SEQ ID NO: 3382 - DNA, 20 bp, Chlamydia pneumoniae
atctcaccatcttgtcggtg

SEQ ID NO: 3383 - DNA, 20 bp, Chlamydia pneumoniae
ccgaactcagaagttaagcc

SEQ ID NO: 3384 - DNA, 20 bp, Chlamydia pneumoniae
cacctgcaagaatcacgcca

SEQ ID NO: 3385 - DNA, 20 bp, Chlamydia pneumoniae
gcttcttcggaatcaatggg

SEQ ID NO: 3386 - DNA, 20 bp, Chlamydia pneumoniae
gttcgggacgccataagata

SEQ ID NO: 3387 - DNA, 20 bp, Chlamydia pneumoniae
ggattcgtagggctaatgac

SEQ ID NO: 3388 - DNA, 20 bp, Chlamydia pneumoniae
gacaacaattcacaaggacc

SEQ ID NO: 3389 - DNA, 20 bp, Chlamydia pneumoniae
cacctgcaagaatcacgcca

SEQ ID NO: 3390 - DNA, 20 bp, Chlamydia pneumoniae
tgttgaatacataggcatat

SEQ ID NO: 3391 - DNA, 20 bp, Chlamydia pneumoniae
gcgcactcttgaaactgtgt

SEQ ID NO: 3392 - DNA, 20 bp, Chlamydia pneumoniae
ggcaacttttctcaggcagt

SEQ ID NO: 3393 - DNA, 20 bp, Chlamydia pneumoniae
gggattgtgactatggagtg

SEQ ID NO: 3394 - DNA, 20 bp, Chlamydia pneumoniae
cctcggtgtgtaaatcacag

SEQ ID NO: 3395 - DNA, 20 bp, Chlamydia pneumoniae
gaattggcaaaagagctggt

SEQ ID NO: 3396 - DNA, 20 bp, Chlamydia pneumoniae
gggtgaggaatcctttaggt

SEQ ID NO: 3397 - DNA, 20 bp, Chlamydia pneumoniae
gcctctgtgccaaggtctct

SEQ ID NO: 3398 - DNA, 20 bp, Chlamydia pneumoniae
cctatggtctcaacgacaag

SEQ ID NO: 3399 - DNA, 20 bp, Chlamydia pneumoniae
ggtgtggttacacaagcttc

SEQ ID NO: 3400 - DNA, 20 bp, Chlamydia pneumoniae
ggtcacagcaaaaccatcca

SEQ ID NO: 3401 - DNA, 20 bp, Chlamydia pneumoniae
acgtgcacatcagcttatgg

SEQ ID NO: 3402 - DNA, 20 bp, Chlamydia pneumoniae
cccacagcatctatgttcac

SEQ ID NO: 3403 - DNA, 20 bp, Chlamydia pneumoniae
ggagtcgcagatactgtaag

SEQ ID NO: 3404 - DNA, 20 bp, Chlamydia pneumoniae
cgtcagagactcgagatagt

SEQ ID NO: 3405 - DNA, 20 bp, Chlamydia pneumoniae
gccagcatctccgcaaatta

SEQ ID NO: 3406 - DNA, 20 bp, Chlamydia pneumoniae
gcatctgctaatgagggaac

SEQ ID NO: 3407 - DNA, 20 bp, Chlamydia pneumoniae
cccacagcatctatgttcac

SEQ ID NO: 3408 - DNA, 20 bp, Chlamydia pneumoniae
gctgcaccactatcatcggg

SEQ ID NO: 3409 - DNA, 20 bp, Chlamydia pneumoniae
tttgctgcaaggaatgccgt

SEQ ID NO: 3410 - DNA, 20 bp, Chlamydia pneumoniae
ggtggcggttagcatagaat

SEQ ID NO: 3411 - DNA, 20 bp, Chlamydia pneumoniae
cacgaaccacatcgctatac

SEQ ID NO: 3412 - DNA, 20 bp, Chlamydia pneumoniae
cccttgttgggagctttttg

SEQ ID NO: 3413 - DNA, 20 bp, Chlamydia pneumoniae
ccttgccattataggagagt

SEQ ID NO: 3414 - DNA, 20 bp, Chlamydia pneumoniae
gacacacgctctcctttgta

SEQ ID NO: 3415 - DNA, 20 bp, Chlamydia pneumoniae
ggctggatgaagttcgtgtt

SEQ ID NO: 3416 - DNA, 20 bp, Chlamydia pneumoniae
gttgctgtagagcctcctat

SEQ ID NO: 3417 - DNA, 20 bp, Chlamydia pneumoniae
cgacaagcattgcccacact

SEQ ID NO: 3418 - DNA, 20 bp, Chlamydia pneumoniae
acagtgcgtaatatggaagc

SEQ ID NO: 3419 - DNA, 20 bp, Chlamydia pneumoniae
cgtgtctctatagaagcagg

SEQ ID NO: 3420 - DNA, 20 bp, Chlamydia pneumoniae
gggattgacagggagaacat

SEQ ID NO: 3421 - DNA, 20 bp, Chlamydia pneumoniae
gacacacgctctcctttgta

SEQ ID NO: 3422 - DNA, 20 bp, Chlamydia pneumoniae
gcgagaagtgcgcataattc

SEQ ID NO: 3423 - DNA, 20 bp, Chlamydia pneumoniae
gcataggacgtgggttactt

SEQ ID NO: 3424 - DNA, 20 bp, Chlamydia pneumoniae
cagcttctcgaggagatatg

SEQ ID NO: 3425 - DNA, 20 bp, Chlamydia pneumoniae
cctgaagcttttctccctgc

SEQ ID NO: 3426 - DNA, 20 bp, Chlamydia pneumoniae
cctgctagggagctgcgctg

SEQ ID NO: 3427 - DNA, 20 bp, Chlamydia pneumoniae
ccaaggagatagctttggtc

SEQ ID NO: 3428 - DNA, 20 bp, Chlamydia pneumoniae
tccctgccttagcttctgta

SEQ ID NO: 3429 - DNA, 20 bp, Chlamydia pneumoniae
ctctgggtgttcctgtaatg

SEQ ID NO: 3430 - DNA, 20 bp, Chlamydia pneumoniae
gtctcaagatgtcagcaacg

SEQ ID NO: 3431 - DNA, 20 bp, Chlamydia pneumoniae
gcgggatctgtcattctaca

SEQ ID NO: 3432 - DNA, 20 bp, Chlamydia pneumoniae
gtgctttgtttacggagggt

SEQ ID NO: 3433 - DNA, 20 bp, Chlamydia pneumoniae
gctcttatggctgtagggaa

SEQ ID NO: 3434 - DNA, 20 bp, Chlamydia pneumoniae
ggagcttatggacatcagga

SEQ ID NO: 3435 - DNA, 20 bp, Chlamydia pneumoniae
gatctaagcagtcccttagc

SEQ ID NO: 3436 - DNA, 20 bp, Chlamydia pneumoniae
gacagcagctagcccatttt

SEQ ID NO: 3437 - DNA, 20 bp, Chlamydia pneumoniae
gctcagaaagatccctccta

SEQ ID NO: 3438 - DNA, 20 bp, Chlamydia pneumoniae
ctgctgcgacacgaatttct

SEQ ID NO: 3439 - DNA, 20 bp, Chlamydia pneumoniae
cgggagttcatcgacgtcta

SEQ ID NO: 3440 - DNA, 20 bp, Chlamydia pneumoniae
cctccgaagggaaagatgta

SEQ ID NO: 3441 - DNA, 20 bp, Chlamydia pneumoniae
gggaaatcttgcgaacacga

SEQ ID NO: 3442 - DNA, 20 bp, Chlamydia pneumoniae
ggttcctaatgggagaagga

SEQ ID NO: 3443 - DNA, 20 bp, Chlamydia pneumoniae
ctgtggtgctagtgggttta

SEQ ID NO: 3444 - DNA, 20 bp, Chlamydia pneumoniae
cagtgcctagtgttcaagag

SEQ ID NO: 3445 - DNA, 20 bp, Chlamydia pneumoniae
cgaacaggcattcactaaag

SEQ ID NO: 3446 - DNA, 20 bp, Chlamydia pneumoniae
gggaaaacccttcagcattc

SEQ ID NO: 3447 - DNA, 20 bp, Chlamydia pneumoniae
cgctctcgattacaggactt

SEQ ID NO: 3448 - DNA, 20 bp, Chlamydia pneumoniae
ggctttctgtagaacgcaca

SEQ ID NO: 3449 - DNA, 20 bp, Chlamydia pneumoniae
ccaggtctgaacaggaatgt

SEQ ID NO: 3450 - DNA, 20 bp, Chlamydia pneumoniae
gctgaggtctcttctcttct

SEQ ID NO: 3451 - DNA, 20 bp, Chlamydia pneumoniae
gcccaaagctaaaatgcggt

SEQ ID NO: 3452 - DNA, 20 bp, Chlamydia pneumoniae
gctcttgaagaattggatgc

SEQ ID NO: 3453 - DNA, 20 bp, Chlamydia pneumoniae
ggctttctgtagaacgcaca

SEQ ID NO: 3454 - DNA, 20 bp, Chlamydia pneumoniae
gtctgcagaacagacgatct

SEQ ID NO: 3455 - DNA, 20 bp, Chlamydia pneumoniae
ctcaaggctcagacttaagg

SEQ ID NO: 3456 - DNA, 20 bp, Chlamydia pneumoniae
ggtagtgtgaatgtgcatgt

SEQ ID NO: 3457 - DNA, 20 bp, Chlamydia pneumoniae
gatctccgcaaggaactgat

SEQ ID NO: 3458 - DNA, 20 bp, Chlamydia pneumoniae
agctgctggaggtgttgaag

SEQ ID NO: 3459 - DNA, 20 bp, Chlamydia pneumoniae
ctcttctgttccctgtgatg

SEQ ID NO: 3460 - DNA, 20 bp, Chlamydia pneumoniae
cgttcgcaaagaagtcacct

SEQ ID NO: 3461 - DNA, 20 bp, Chlamydia pneumoniae
cgagtatcctaaagctggtt

SEQ ID NO: 3462 - DNA, 20 bp, Chlamydia pneumoniae
ggactcataattatcctggg

SEQ ID NO: 3463 - DNA, 20 bp, Chlamydia pneumoniae
caaatatggccccagcactt

SEQ ID NO: 3464 - DNA, 20 bp, Chlamydia pneumoniae
gggaattctttatggtcccg

SEQ ID NO: 3465 - DNA, 20 bp, Chlamydia pneumoniae
gctgcagagagagaattggt

SEQ ID NO: 3466 - DNA, 20 bp, Chlamydia pneumoniae
aaccaaacggtgctcgcttc

SEQ ID NO: 3467 - DNA, 20 bp, Chlamydia pneumoniae
gctcaggcctaattgacttt

SEQ ID NO: 3468 - DNA, 20 bp, Chlamydia pneumoniae
cgagaacagggaaagaggaa

SEQ ID NO: 3469 - DNA, 20 bp, Chlamydia pneumoniae
cgtgggaacgtgattcgtaa

SEQ ID NO: 3470 - DNA, 20 bp, Chlamydia pneumoniae
gggataaggtaaggctgtgt

SEQ ID NO: 3471 - DNA, 20 bp, Chlamydia pneumoniae
ggtaaagagagtaagcgctc

SEQ ID NO: 3472 - DNA, 20 bp, Chlamydia pneumoniae
cgcacggaagcaagtcttta

SEQ ID NO: 3473 - DNA, 20 bp, Chlamydia pneumoniae
caaaagcagtccctctaacc

SEQ ID NO: 3474 - DNA, 20 bp, Chlamydia pneumoniae
cccaagaggagcaaagtagt

SEQ ID NO: 3475 - DNA, 20 bp, Chlamydia pneumoniae
gcattaaggcgtgatggagt

SEQ ID NO: 3476 - DNA, 20 bp, Chlamydia pneumoniae
ggagagatgcaagtgttgga

SEQ ID NO: 3477 - DNA, 20 bp, Chlamydia pneumoniae
ggtatgatatccccgacgat

SEQ ID NO: 3478 - DNA, 20 bp, Chlamydia pneumoniae
cccgaactggtcttcataga

SEQ ID NO: 3479 - DNA, 20 bp, Chlamydia pneumoniae
cgcttgttgctcgaagatag

SEQ ID NO: 3480 - DNA, 20 bp, Chlamydia pneumoniae
cgctaagggaaggaacagaa

SEQ ID NO: 3481 - DNA, 20 bp, Chlamydia pneumoniae
gggacttctacagctttctc

SEQ ID NO: 3482 - DNA, 20 bp, Chlamydia pneumoniae
cttggcgtgtgttgacgaaa

SEQ ID NO: 3483 - DNA, 20 bp, Chlamydia pneumoniae
gttccatcactgccatcagt

SEQ ID NO: 3484 - DNA, 20 bp, Chlamydia pneumoniae
cactcggttctgactttgta

SEQ ID NO: 3485 - DNA, 20 bp, Chlamydia pneumoniae
ctgggtctttgaaagaggga

SEQ ID NO: 3486 - DNA, 20 bp, Chlamydia pneumoniae
gagtgatcaacaacagtgga

SEQ ID NO: 3487 - DNA, 20 bp, Chlamydia pneumoniae
caacgcggtttttcgaggaa

SEQ ID NO: 3488 - DNA, 20 bp, Chlamydia pneumoniae
gaactcttggagcaacagca

SEQ ID NO: 3489 - DNA, 20 bp, Chlamydia pneumoniae
cgcatcctgaatcttgcatc

SEQ ID NO: 3490 - DNA, 20 bp, Chlamydia pneumoniae
gagttgcgtacgataatggc

SEQ ID NO: 3491 - DNA, 20 bp, Chlamydia pneumoniae
gtgaagctgctatgagtagg

SEQ ID NO: 3492 - DNA, 20 bp, Chlamydia pneumoniae
cttcggcctatcctaacaaa

SEQ ID NO: 3493 - DNA, 20 bp, Chlamydia pneumoniae
cgcatttgtagagcgcttcg

SEQ ID NO: 3494 - DNA, 20 bp, Chlamydia pneumoniae
gccgagaacagagattctga

SEQ ID NO: 3495 - DNA, 20 bp, Chlamydia pneumoniae
ttaggccctgacttagagtc

SEQ ID NO: 3496 - DNA, 20 bp, Chlamydia pneumoniae
cgtagccctgatagagtttc

SEQ ID NO: 3497 - DNA, 20 bp, Chlamydia pneumoniae
cctcagattgggcgatttca

SEQ ID NO: 3498 - DNA, 20 bp, Chlamydia pneumoniae
cgagagatgacagtctggta

SEQ ID NO: 3499 - DNA, 20 bp, Chlamydia pneumoniae
gtagcgaagttcaacgtttt

SEQ ID NO: 3500 - DNA, 20 bp, Chlamydia pneumoniae
ccgaccttcgtaaaatcgtg

SEQ ID NO: 3501 - DNA, 20 bp, Chlamydia pneumoniae
gcagagcttcctttgcttgt

SEQ ID NO: 3502 - DNA, 20 bp, Chlamydia pneumoniae
cgctagagaaatagggcacg

SEQ ID NO: 3503 - DNA, 20 bp, Chlamydia pneumoniae
ctttgaagctgctcctaacg

SEQ ID NO: 3504 - DNA, 20 bp, Chlamydia pneumoniae
cgtgtcgaagtgaacgtaga

SEQ ID NO: 3505 - DNA, 20 bp, Chlamydia pneumoniae
tccgtttcacagtgtcttcc

SEQ ID NO: 3506 - DNA, 20 bp, Chlamydia pneumoniae
tcgagagtcccctttctcat

SEQ ID NO: 3507 - DNA, 20 bp, Chlamydia pneumoniae
cgtgtcgaagtgaacgtaga

SEQ ID NO: 3508 - DNA, 20 bp, Chlamydia pneumoniae
gcagtgcaattaaggaggct

SEQ ID NO: 3509 - DNA, 20 bp, Chlamydia pneumoniae
ggtagtaattcgcagcttgc

SEQ ID NO: 3510 - DNA, 20 bp, Chlamydia pneumoniae
ccaaggcaattctcggtagt

SEQ ID NO: 3511 - DNA, 20 bp, Chlamydia pneumoniae
gagccaaaatctcagtgcgt

SEQ ID NO: 3512 - DNA, 20 bp, Chlamydia pneumoniae
cgtcacatcaacagtgaagc

SEQ ID NO: 3513 - DNA, 20 bp, Chlamydia pneumoniae
ctttggtcatcagtcgttcg

SEQ ID NO: 3514 - DNA, 20 bp, Chlamydia pneumoniae
ctcattccttaacccagctc

SEQ ID NO: 3515 - DNA, 20 bp, Chlamydia pneumoniae
catccagaaagaaaagctgc

SEQ ID NO: 3516 - DNA, 20 bp, Chlamydia pneumoniae
atcggcgacctgttctctat

SEQ ID NO: 3517 - DNA, 20 bp, Chlamydia pneumoniae
agcgagacacgctttgcagt

SEQ ID NO: 3518 - DNA, 20 bp, Chlamydia pneumoniae
cgccaagggctttaatgtcg

SEQ ID NO: 3519 - DNA, 20 bp, Chlamydia pneumoniae
cctactcttcgacagtgatg

SEQ ID NO: 3520 - DNA, 20 bp, Chlamydia pneumoniae
actccagaaggacctggtga

SEQ ID NO: 3521 - DNA, 20 bp, Chlamydia pneumoniae
gcaatgcaaacctctctctc

SEQ ID NO: 3522 - DNA, 20 bp, Chlamydia pneumoniae
cgggctttaaaatgacctgg

SEQ ID NO: 3523 - DNA, 20 bp, Chlamydia pneumoniae
gccgacactaagtcagcttt

SEQ ID NO: 3524 - DNA, 20 bp, Chlamydia pneumoniae
gagcaagagggttctcgata

SEQ ID NO: 3525 - DNA, 20 bp, Chlamydia pneumoniae
aactagccaacgtatagggc

SEQ ID NO: 3526 - DNA, 20 bp, Chlamydia pneumoniae
caagggctagtgggaaacta

SEQ ID NO: 3527 - DNA, 20 bp, Chlamydia pneumoniae
gccactctacatagctatcc

SEQ ID NO: 3528 - DNA, 20 bp, Chlamydia pneumoniae
ccagagtccttttcttctcc

SEQ ID NO: 3529 - DNA, 20 bp, Chlamydia pneumoniae
tgcaagggctagtgggaaac

SEQ ID NO: 3530 - DNA, 20 bp, Chlamydia pneumoniae
ctcgtagaagatcgtcctgt

SEQ ID NO: 3531 - DNA, 20 bp, Chlamydia pneumoniae
cagcataagttagcctggct

SEQ ID NO: 3532 - DNA, 20 bp, Chlamydia pneumoniae
cccctcgaagaggtgttgag

SEQ ID NO: 3533 - DNA, 20 bp, Chlamydia pneumoniae
tgcgtactacaataccctcg

SEQ ID NO: 3534 - DNA, 20 bp, Chlamydia pneumoniae
ggcataactaattacggcgg

SEQ ID NO: 3535 - DNA, 20 bp, Chlamydia pneumoniae
gggagaagtacttccacatc

SEQ ID NO: 3536 - DNA, 20 bp, Chlamydia pneumoniae
gaacacagaaggaagcgttt

SEQ ID NO: 3537 - DNA, 20 bp, Chlamydia pneumoniae
gtaaggcagcggtttttggt

SEQ ID NO: 3538 - DNA, 20 bp, Chlamydia pneumoniae
cggatctgtaaccattgcag

SEQ ID NO: 3539 - DNA, 20 bp, Chlamydia pneumoniae
gccctatcttctacggtctt

SEQ ID NO: 3540 - DNA, 20 bp, Chlamydia pneumoniae
gcatgaaggatagtttgagc

SEQ ID NO: 3541 - DNA, 20 bp, Chlamydia pneumoniae
cctaggcatgggtatgcaaa

SEQ ID NO: 3542 - DNA, 20 bp, Chlamydia pneumoniae
cgtatacggacagacttgaa

SEQ ID NO: 3543 - DNA, 20 bp, Chlamydia pneumoniae
taccgagtggtgttcgaaat

SEQ ID NO: 3544 - DNA, 20 bp, Chlamydia pneumoniae
gtcgtttcatctgctttagg

SEQ ID NO: 3545 - DNA, 20 bp, Chlamydia pneumoniae
gactcttagagcagattctg

SEQ ID NO: 3546 - DNA, 20 bp, Chlamydia pneumoniae
ccctagtctccaatatccca

SEQ ID NO: 3547 - DNA, 20 bp, Chlamydia pneumoniae
cccacagaaaaggcatacca

SEQ ID NO: 3548 - DNA, 20 bp, Chlamydia pneumoniae
ggcaaacgcttggaattcag

SEQ ID NO: 3549 - DNA, 20 bp, Chlamydia pneumoniae
ggatacaggatttccatggc

SEQ ID NO: 3550 - DNA, 20 bp, Chlamydia pneumoniae
cttaaggcggtgtaggttta

SEQ ID NO: 3551 - DNA, 20 bp, Chlamydia pneumoniae
ggaatcccgtgttcctgaat

SEQ ID NO: 3552 - DNA, 20 bp, Chlamydia pneumoniae
ccatgactttccttgtgcct

SEQ ID NO: 3553 - DNA, 20 bp, Chlamydia pneumoniae
gtctggtgatttgcaaggag

SEQ ID NO: 3554 - DNA, 20 bp, Chlamydia pneumoniae
ggggaataatccctttgagt

SEQ ID NO: 3555 - DNA, 20 bp, Chlamydia pneumoniae
gcgagcagcatcgtatttca

SEQ ID NO: 3556 - DNA, 20 bp, Chlamydia pneumoniae
gcacgtgctaagattcctct

SEQ ID NO: 3557 - DNA, 20 bp, Chlamydia pneumoniae
ctcgctgtacggcaaatcaa

SEQ ID NO: 3558 - DNA, 20 bp, Chlamydia pneumoniae
gctctgtagtctgtggtctt

SEQ ID NO: 3559 - DNA, 20 bp, Chlamydia pneumoniae
gcctttgagctgacgaactt

SEQ ID NO: 3560 - DNA, 20 bp, Chlamydia pneumoniae
gtaagggacctgtctctttg

SEQ ID NO: 3561 - DNA, 20 bp, Chlamydia pneumoniae
cgcaaacagccgcttcttta

SEQ ID NO: 3562 - DNA, 20 bp, Chlamydia pneumoniae
cgaggataaatcggcgaagt

SEQ ID NO: 3563 - DNA, 20 bp, Chlamydia pneumoniae
tcgtatccacagtggttcct

SEQ ID NO: 3564 - DNA, 20 bp, Chlamydia pneumoniae
gaaatcggtcgagaggaagt

SEQ ID NO: 3565 - DNA, 20 bp, Chlamydia pneumoniae
ggcgtgtttgacacgcattt

SEQ ID NO: 3566 - DNA, 20 bp, Chlamydia pneumoniae
gtgcgtgtagaagtgaaaag

SEQ ID NO: 3567 - DNA, 20 bp, Chlamydia pneumoniae
gtggctcctattgaagagag

SEQ ID NO: 3568 - DNA, 20 bp, Chlamydia pneumoniae
ctcagatttgacagccccaa

SEQ ID NO: 3569 - DNA, 20 bp, Chlamydia pneumoniae
ggaaacgcttaccgaccaaa

SEQ ID NO: 3570 - DNA, 20 bp, Chlamydia pneumoniae
tgctcatccacatgtggatg

SEQ ID NO: 3571 - DNA, 20 bp, Chlamydia pneumoniae
cccggtagagagctcttaaa

SEQ ID NO: 3572 - DNA, 20 bp, Chlamydia pneumoniae
ctgataccctagctgctttg

SEQ ID NO: 3573 - DNA, 20 bp, Chlamydia pneumoniae
gattgttctagactgcgctc

SEQ ID NO: 3574 - DNA, 20 bp, Chlamydia pneumoniae
gacctcgcaatcctatgatg

SEQ ID NO: 3575 - DNA, 20 bp, Chlamydia pneumoniae
ggctcttgcggatgttattg

SEQ ID NO: 3576 - DNA, 20 bp, Chlamydia pneumoniae
cggggccgccgtgattatcg

SEQ ID NO: 3577 - DNA, 20 bp, Chlamydia pneumoniae
cgacgtccctacataggtaa

SEQ ID NO: 3578 - DNA, 20 bp, Chlamydia pneumoniae
cgctaggcgtgtctttcttt

SEQ ID NO: 3579 - DNA, 20 bp, Chlamydia pneumoniae
gctgccctcaaactcaaaga

SEQ ID NO: 3580 - DNA, 20 bp, Chlamydia pneumoniae
ggtgcgttcctcaatggtta

SEQ ID NO: 3581 - DNA, 20 bp, Chlamydia pneumoniae
ggccctctaggttttgctat

SEQ ID NO: 3582 - DNA, 20 bp, Chlamydia pneumoniae
tgggggattcggggccgccg

SEQ ID NO: 3583 - DNA, 20 bp, Chlamydia pneumoniae
gctgtagaagctctcaagca

SEQ ID NO: 3584 - DNA, 20 bp, Chlamydia pneumoniae
gactctagtctttgctgtgg

SEQ ID NO: 3585 - DNA, 20 bp, Chlamydia pneumoniae
gtagttggtcaagtgatggc

SEQ ID NO: 3586 - DNA, 20 bp, Chlamydia pneumoniae
ttagtccgacgtaatcgtgc

SEQ ID NO: 3587 - DNA, 20 bp, Chlamydia pneumoniae
gcccatcgttcttgagcatt

SEQ ID NO: 3588 - DNA, 20 bp, Chlamydia pneumoniae
gatgagagcgtgaaagtgct

SEQ ID NO: 3589 - DNA, 20 bp, Chlamydia pneumoniae
catcttcaggaaaccgagac

SEQ ID NO: 3590 - DNA, 20 bp, Chlamydia pneumoniae
ctttccttacacacgacttt

SEQ ID NO: 3591 - DNA, 20 bp, Chlamydia pneumoniae
gagggtgagctacttgtcct

SEQ ID NO: 3592 - DNA, 20 bp, Chlamydia pneumoniae
gctgcgttgggaaaacattc

SEQ ID NO: 3593 - DNA, 20 bp, Chlamydia pneumoniae
gatatatccacctgccggga

SEQ ID NO: 3594 - DNA, 20 bp, Chlamydia pneumoniae
cactatgcgtggtaaccaag

SEQ ID NO: 3595 - DNA, 20 bp, Chlamydia pneumoniae
cccaggattttcggtaaacc

SEQ ID NO: 3596 - DNA, 20 bp, Chlamydia pneumoniae
cccgcggtagaatataggat

SEQ ID NO: 3597 - DNA, 20 bp, Chlamydia pneumoniae
cagaagctatccgttgcgaa

SEQ ID NO: 3598 - DNA, 20 bp, Chlamydia pneumoniae
cgcagtagaagagaggatct

SEQ ID NO: 3599 - DNA, 20 bp, Chlamydia pneumoniae
cgtttgactcattggcttcc

SEQ ID NO: 3600 - DNA, 20 bp, Chlamydia pneumoniae
cgtgggccttatgaaaatcc

SEQ ID NO: 3601 - DNA, 20 bp, Chlamydia pneumoniae
cggactctcttgcattacag

SEQ ID NO: 3602 - DNA, 20 bp, Chlamydia pneumoniae
tcaggaattgctcctggtca

SEQ ID NO: 3603 - DNA, 20 bp, Chlamydia pneumoniae
caaaagctctggggataagg

SEQ ID NO: 3604 - DNA, 20 bp, Chlamydia pneumoniae
gctcttctgcagcgtgaata

SEQ ID NO: 3605 - DNA, 20 bp, Chlamydia pneumoniae
cagattcccttctcaaggag

SEQ ID NO: 3606 - DNA, 20 bp, Chlamydia pneumoniae
cgcagatatcgaggggaagc

SEQ ID NO: 3607 - DNA, 20 bp, Chlamydia pneumoniae
cgctgcttgctacaaactcg

SEQ ID NO: 3608 - DNA, 20 bp, Chlamydia pneumoniae
cgtgcttccgtagcgtttta

SEQ ID NO: 3609 - DNA, 20 bp, Chlamydia pneumoniae
cgtacctttgcaaaagcggt

SEQ ID NO: 3610 - DNA, 20 bp, Chlamydia pneumoniae
gctagacgattgctgaaatc

SEQ ID NO: 3611 - DNA, 20 bp, Chlamydia pneumoniae
ggaattctataacaggggcg

SEQ ID NO: 3612 - DNA, 20 bp, Chlamydia pneumoniae
caggaaaccatgacaattcc

SEQ ID NO: 3613 - DNA, 20 bp, Chlamydia pneumoniae
gacgatggagctctttacct

SEQ ID NO: 3614 - DNA, 20 bp, Chlamydia pneumoniae
cccgagtggattatagagtg

SEQ ID NO: 3615 - DNA, 20 bp, Chlamydia pneumoniae
gcagctctcaagaccccaat

SEQ ID NO: 3616 - DNA, 20 bp, Chlamydia pneumoniae
gagcgaaaccatggatctga

SEQ ID NO: 3617 - DNA, 20 bp, Chlamydia pneumoniae
agagctgtggggttgggggt

SEQ ID NO: 3618 - DNA, 20 bp, Chlamydia pneumoniae
gctccaagaatggaaacacc

SEQ ID NO: 3619 - DNA, 20 bp, Chlamydia pneumoniae
aaacgcggcattcagcctcg

SEQ ID NO: 3620 - DNA, 20 bp, Chlamydia pneumoniae
ggctatcttccgaaagggaa

SEQ ID NO: 3621 - DNA, 20 bp, Chlamydia pneumoniae
ggacttgatgaaggcgaagt

SEQ ID NO: 3622 - DNA, 20 bp, Chlamydia pneumoniae
cacatagtgtcgagagccta

SEQ ID NO: 3623 - DNA, 20 bp, Chlamydia pneumoniae
aggccttgggcagttcatta

SEQ ID NO: 3624 - DNA, 20 bp, Chlamydia pneumoniae
ccatcaaaaccacggtcatc

SEQ ID NO: 3625 - DNA, 20 bp, Chlamydia pneumoniae
tggtaatggggattgggtag

SEQ ID NO: 3626 - DNA, 20 bp, Chlamydia pneumoniae
gctaaggagttgtgagaaag

SEQ ID NO: 3627 - DNA, 20 bp, Chlamydia pneumoniae
gtcagagcaagaaagaagtg

SEQ ID NO: 3628 - DNA, 20 bp, Chlamydia pneumoniae
ggaaaagtctcatgcccaag

SEQ ID NO: 3629 - DNA, 20 bp, Chlamydia pneumoniae
ggaacaaagctctccttcag

SEQ ID NO: 3630 - DNA, 20 bp, Chlamydia pneumoniae
aggggatttccgtagccttt

SEQ ID NO: 3631 - DNA, 20 bp, Chlamydia pneumoniae
caggtcctccaatgcggaaa

SEQ ID NO: 3632 - DNA, 20 bp, Chlamydia pneumoniae
gaactttgtggctaagagcc

SEQ ID NO: 3633 - DNA, 20 bp, Chlamydia pneumoniae
gcatgttccgtggtagagaa

SEQ ID NO: 3634 - DNA, 20 bp, Chlamydia pneumoniae
gggaagcgttttgggatgaa

SEQ ID NO: 3635 - DNA, 20 bp, Chlamydia pneumoniae
gccttttcaggtttcatagt

SEQ ID NO: 3636 - DNA, 20 bp, Chlamydia pneumoniae
aacaagctgaggcatgagga

SEQ ID NO: 3637 - DNA, 20 bp, Chlamydia pneumoniae
gggaagaagcctctttcacc

SEQ ID NO: 3638 - DNA, 20 bp, Chlamydia pneumoniae
ggcaacaatttcctgtagag

SEQ ID NO: 3639 - DNA, 20 bp, Chlamydia pneumoniae
gtgaccgttggtgttctact

SEQ ID NO: 3640 - DNA, 20 bp, Chlamydia pneumoniae
gcaactttgcgcatgaggaa

SEQ ID NO: 3641 - DNA, 20 bp, Chlamydia pneumoniae
aaggatcatgccagcatacg

SEQ ID NO: 3642 - DNA, 20 bp, Chlamydia pneumoniae
ccaaggaagacactctacct

SEQ ID NO: 3643 - DNA, 20 bp, Chlamydia pneumoniae
gggaggagaacgtttttctc

SEQ ID NO: 3644 - DNA, 20 bp, Chlamydia pneumoniae
cttcttcttgccacaactgt

SEQ ID NO: 3645 - DNA, 20 bp, Chlamydia pneumoniae
gagaatgcttctagatgcgg

SEQ ID NO: 3646 - DNA, 20 bp, Chlamydia pneumoniae
caaagacatcggatgtctcc

SEQ ID NO: 3647 - DNA, 20 bp, Chlamydia pneumoniae
ccttgcttcgcttgggaaag

SEQ ID NO: 3648 - DNA, 20 bp, Chlamydia pneumoniae
cgtttgttggataccgtcct

SEQ ID NO: 3649 - DNA, 20 bp, Chlamydia pneumoniae
gagaagggagggaagaagta

SEQ ID NO: 3650 - DNA, 20 bp, Chlamydia pneumoniae
gcgctctctcaagagaacta

SEQ ID NO: 3651 - DNA, 20 bp, Chlamydia pneumoniae
gcaggaagaggatatacagc

SEQ ID NO: 3652 - DNA, 20 bp, Chlamydia pneumoniae
ggagcccaggaattccaaaa

SEQ ID NO: 3653 - DNA, 20 bp, Chlamydia pneumoniae
agctccgttagcttgacgag

SEQ ID NO: 3654 - DNA, 20 bp, Chlamydia pneumoniae
ggggaggttaatgagctctt

SEQ ID NO: 3655 - DNA, 20 bp, Chlamydia pneumoniae
gtggaaaggtctgagattgc

SEQ ID NO: 3656 - DNA, 20 bp, Chlamydia pneumoniae
gggcaatgatggagaggtta

SEQ ID NO: 3657 - DNA, 20 bp, Chlamydia pneumoniae
ggaggcagagcatctaatga

SEQ ID NO: 3658 - DNA, 20 bp, Chlamydia pneumoniae
gtagactccctagttgtggt

SEQ ID NO: 3659 - DNA, 20 bp, Chlamydia pneumoniae
aatcaccctcatggaggctt

SEQ ID NO: 3660 - DNA, 20 bp, Chlamydia pneumoniae
gctgaaacgagttgtgtgga

SEQ ID NO: 3661 - DNA, 20 bp, Chlamydia pneumoniae
gtgaggattgctgttggatg

SEQ ID NO: 3662 - DNA, 20 bp, Chlamydia pneumoniae
gcccttttgagatgctttgc

SEQ ID NO: 3663 - DNA, 20 bp, Chlamydia pneumoniae
gtacgtgcttagcaaacgtc

SEQ ID NO: 3664 - DNA, 20 bp, Chlamydia pneumoniae
ctggagaatcgaacaggaca

SEQ ID NO: 3665 - DNA, 20 bp, Chlamydia pneumoniae
gagaagcagcgttgttctga

SEQ ID NO: 3666 - DNA, 20 bp, Chlamydia pneumoniae
gatggtgtagcgctaggata

SEQ ID NO: 3667 - DNA, 20 bp, Chlamydia pneumoniae
gggtctacaacgccttcttt

SEQ ID NO: 3668 - DNA, 20 bp, Chlamydia pneumoniae
gagaaagcatttcacgggca

SEQ ID NO: 3669 - DNA, 20 bp, Chlamydia pneumoniae
gctgtaatttggcaggcgtt

SEQ ID NO: 3670 - DNA, 20 bp, Chlamydia pneumoniae
aggtgatttggaagaggctg

SEQ ID NO: 3671 - DNA, 20 bp, Chlamydia pneumoniae
ggatcacccgttgttgtttc

SEQ ID NO: 3672 - DNA, 20 bp, Chlamydia pneumoniae
ggtgtgccaagcagatgtta

SEQ ID NO: 3673 - DNA, 20 bp, Chlamydia pneumoniae
cgagtccgtaaagagcaaac

SEQ ID NO: 3674 - DNA, 20 bp, Chlamydia pneumoniae
cgaaagcagcactgaaagca

SEQ ID NO: 3675 - DNA, 20 bp, Chlamydia pneumoniae
ggctacccattctcctgcaa

SEQ ID NO: 3676 - DNA, 20 bp, Chlamydia pneumoniae
tgccgatggtaggaatatcg

SEQ ID NO: 3677 - DNA, 20 bp, Chlamydia pneumoniae
cagtcaattgcgtcactgct

SEQ ID NO: 3678 - DNA, 20 bp, Chlamydia pneumoniae
tgcccaagggactttcacga

SEQ ID NO: 3679 - DNA, 20 bp, Chlamydia pneumoniae
cgaaagcagcactgaaagca

SEQ ID NO: 3680 - DNA, 20 bp, Chlamydia pneumoniae
gggctcgagaaagtagactt

SEQ ID NO: 3681 - DNA, 20 bp, Chlamydia pneumoniae
gacttactgtcccaagtcca

SEQ ID NO: 3682 - DNA, 20 bp, Chlamydia pneumoniae
ctgattacgttgaggcagtg

SEQ ID NO: 3683 - DNA, 20 bp, Chlamydia pneumoniae
ccagttatttcggcggattg

SEQ ID NO: 3684 - DNA, 20 bp, Chlamydia pneumoniae
cgaattccaatcgtcttcgc

SEQ ID NO: 3685 - DNA, 20 bp, Chlamydia pneumoniae
ccggggtaaattcacagtct

SEQ ID NO: 3686 - DNA, 20 bp, Chlamydia pneumoniae
ctctcttcaggattcgcgtt

SEQ ID NO: 3687 - DNA, 20 bp, Chlamydia pneumoniae
cttgtggagatttagcgcct

SEQ ID NO: 3688 - DNA, 20 bp, Chlamydia pneumoniae
gtgctgctagaataggacct

SEQ ID NO: 3689 - DNA, 20 bp, Chlamydia pneumoniae
tcttcgcgaagtggctttga

SEQ ID NO: 3690 - DNA, 20 bp, Chlamydia pneumoniae
cagtgcttgtgtcaaagcac

SEQ ID NO: 3691 - DNA, 20 bp, Chlamydia pneumoniae
cttctcgttcagagagggta

SEQ ID NO: 3692 - DNA, 20 bp, Chlamydia pneumoniae
atgggtgataggaggctcag

SEQ ID NO: 3693 - DNA, 20 bp, Chlamydia pneumoniae
gtgctgctagaataggacct

SEQ ID NO: 3694 - DNA, 20 bp, Chlamydia pneumoniae
cagcgaaaaacggtgatgct

SEQ ID NO: 3695 - DNA, 20 bp, Chlamydia pneumoniae
ggaggagtcgatatggattg

SEQ ID NO: 3696 - DNA, 20 bp, Chlamydia pneumoniae
cctcagcgactgcctctaca

SEQ ID NO: 3697 - DNA, 20 bp, Chlamydia pneumoniae
gcttgtgctgctttggctat

SEQ ID NO: 3698 - DNA, 20 bp, Chlamydia pneumoniae
gcggtttagagggaaagaga

SEQ ID NO: 3699 - DNA, 20 bp, Chlamydia pneumoniae
ccataggcatgcaaagcttg

SEQ ID NO: 3700 - DNA, 20 bp, Chlamydia pneumoniae
agcctacgcgctaacgtagt

SEQ ID NO: 3701 - DNA, 20 bp, Chlamydia pneumoniae
ttgcggaggtaaggatctct

SEQ ID NO: 3702 - DNA, 20 bp, Chlamydia pneumoniae
ggctgtgcctttatcagagg

SEQ ID NO: 3703 - DNA, 20 bp, Chlamydia pneumoniae
cattaggggcgtaggttgta

SEQ ID NO: 3704 - DNA, 20 bp, Chlamydia pneumoniae
gtctacctcagagagaggtt

SEQ ID NO: 3705 - DNA, 20 bp, Chlamydia pneumoniae
gctaacgtagtctctgcttc

SEQ ID NO: 3706 - DNA, 20 bp, Chlamydia pneumoniae
gtccctaagggacctcttta

SEQ ID NO: 3707 - DNA, 20 bp, Chlamydia pneumoniae
gctgcatcgttgttaacgct

SEQ ID NO: 3708 - DNA, 20 bp, Chlamydia pneumoniae
ggccgctttaaatacagcag

SEQ ID NO: 3709 - DNA, 20 bp, Chlamydia pneumoniae
cggctgattctctctacgat

SEQ ID NO: 3710 - DNA, 20 bp, Chlamydia pneumoniae
gtcctaaaagtgacgagtgg

SEQ ID NO: 3711 - DNA, 20 bp, Chlamydia pneumoniae
gagacgcaacggctgttttt

SEQ ID NO: 3712 - DNA, 20 bp, Chlamydia pneumoniae
gtcactgtagctatgctctc

SEQ ID NO: 3713 - DNA, 20 bp, Chlamydia pneumoniae
ctcagaatggacgggctctt

SEQ ID NO: 3714 - DNA, 20 bp, Chlamydia pneumoniae
gtggtgattgctttggttcc

SEQ ID NO: 3715 - DNA, 20 bp, Chlamydia pneumoniae
gtctggcatccgtccggtcc

SEQ ID NO: 3716 - DNA, 20 bp, Chlamydia pneumoniae
gaccatactgggaatggaga

SEQ ID NO: 3717 - DNA, 20 bp, Chlamydia pneumoniae
gttcctgacttcacacaagc

SEQ ID NO: 3718 - DNA, 20 bp, Chlamydia pneumoniae
aggcgtcagccaatccctga

SEQ ID NO: 3719 - DNA, 20 bp, Chlamydia pneumoniae
gcatagcatgctcgctcatc

SEQ ID NO: 3720 - DNA, 20 bp, Chlamydia pneumoniae
ctcctaaaacggctatacgc

SEQ ID NO: 3721 - DNA, 20 bp, Chlamydia pneumoniae
caggaaaaagctagcgtgtc

SEQ ID NO: 3722 - DNA, 20 bp, Chlamydia pneumoniae
gggacgtattgtagagagga

SEQ ID NO: 3723 - DNA, 20 bp, Chlamydia pneumoniae
cgtcagccaatccctgaata

SEQ ID NO: 3724 - DNA, 20 bp, Chlamydia pneumoniae
cacaggtatctacaggaacg

SEQ ID NO: 3725 - DNA, 20 bp, Chlamydia pneumoniae
cataagccgtggggaaggat

SEQ ID NO: 3726 - DNA, 20 bp, Chlamydia pneumoniae
cagactcataacgtcgtagc

SEQ ID NO: 3727 - DNA, 20 bp, Chlamydia pneumoniae
ccgtgatgctgagcatagta

SEQ ID NO: 3728 - DNA, 20 bp, Chlamydia pneumoniae
ccgtagaagaaggcatagtg

SEQ ID NO: 3729 - DNA, 20 bp, Chlamydia pneumoniae
tagctggttcagcattttcg

SEQ ID NO: 3730 - DNA, 20 bp, Chlamydia pneumoniae
tctcctccttgaagaagcgt

SEQ ID NO: 3731 - DNA, 20 bp, Chlamydia pneumoniae
ggattctcagagacaagacc

SEQ ID NO: 3732 - DNA, 20 bp, Chlamydia pneumoniae
gggttcaagttttgctaggg

SEQ ID NO: 3733 - DNA, 20 bp, Chlamydia pneumoniae
gggtgaagttcctgagcttt

SEQ ID NO: 3734 - DNA, 20 bp, Chlamydia pneumoniae
cccccctccaattccaataa

SEQ ID NO: 3735 - DNA, 20 bp, Chlamydia pneumoniae
gcacctacaatggcaatgtg

SEQ ID NO: 3736 - DNA, 20 bp, Chlamydia pneumoniae
gtgcctgtggtctttccttt

SEQ ID NO: 3737 - DNA, 20 bp, Chlamydia pneumoniae
cacgacctagatgctctatc

SEQ ID NO: 3738 - DNA, 20 bp, Chlamydia pneumoniae
gtgaatacgactatcgccag

SEQ ID NO: 3739 - DNA, 20 bp, Chlamydia pneumoniae
tgttaggttctccaggagga

SEQ ID NO: 3740 - DNA, 20 bp, Chlamydia pneumoniae
cctagtttgaatcgctcggt

SEQ ID NO: 3741 - DNA, 20 bp, Chlamydia pneumoniae
cagagataagcatccgcgat

SEQ ID NO: 3742 - DNA, 20 bp, Chlamydia pneumoniae
gggattgcccacaatttcca

SEQ ID NO: 3743 - DNA, 20 bp, Chlamydia pneumoniae
cggtagagcctttcactgtt

SEQ ID NO: 3744 - DNA, 20 bp, Chlamydia pneumoniae
gggagagaagtctctgagat

SEQ ID NO: 3745 - DNA, 20 bp, Chlamydia pneumoniae
gcactgctgtagttgcttac

SEQ ID NO: 3746 - DNA, 20 bp, Chlamydia pneumoniae
cgagtttcgatacgagctct

SEQ ID NO: 3747 - DNA, 20 bp, Chlamydia pneumoniae
tagaagctcccatctgcttg

SEQ ID NO: 3748 - DNA, 20 bp, Chlamydia pneumoniae
ggcgcacaaatatgactctc

SEQ ID NO: 3749 - DNA, 20 bp, Chlamydia pneumoniae
gtaagtaagcctcccagaag

SEQ ID NO: 3750 - DNA, 20 bp, Chlamydia pneumoniae
gttcttctatacgctgacag

SEQ ID NO: 3751 - DNA, 20 bp, Chlamydia pneumoniae
gctgagtccaacaaaatggc

SEQ ID NO: 3752 - DNA, 20 bp, Chlamydia pneumoniae
gcggatgtcttctaatgacc

SEQ ID NO: 3753 - DNA, 20 bp, Chlamydia pneumoniae
gatggctccctgaaacacaa

SEQ ID NO: 3754 - DNA, 20 bp, Chlamydia pneumoniae
gaggttggcgataaaagctg

SEQ ID NO: 3755 - DNA, 20 bp, Chlamydia pneumoniae
gcaagcctaagtttgctgtg

SEQ ID NO: 3756 - DNA, 20 bp, Chlamydia pneumoniae
aaccgtgaggaaaggagtcg

SEQ ID NO: 3757 - DNA, 20 bp, Chlamydia pneumoniae
tttgccctttccacaacgtc

SEQ ID NO: 3758 - DNA, 20 bp, Chlamydia pneumoniae
catcgataggaccatcggtt

SEQ ID NO: 3759 - DNA, 20 bp, Chlamydia pneumoniae
gcaaagtacctcaaaaccag

SEQ ID NO: 3760 - DNA, 20 bp, Chlamydia pneumoniae
attccccaatacctaccaac

SEQ ID NO: 3761 - DNA, 20 bp, Chlamydia pneumoniae
ggagcaaccttccctttgat

SEQ ID NO: 3762 - DNA, 20 bp, Chlamydia pneumoniae
atctagtgtcacacgcttgc

SEQ ID NO: 3763 - DNA, 20 bp, Chlamydia pneumoniae
gagatggtacgtgatttgcc

SEQ ID NO: 3764 - DNA, 20 bp, Chlamydia pneumoniae
ggagaatgtatctcctgctg

SEQ ID NO: 3765 - DNA, 20 bp, Chlamydia pneumoniae
catggacgtctcgactcctt

SEQ ID NO: 3766 - DNA, 20 bp, Chlamydia pneumoniae
cacctttatctgtcgaggtc

SEQ ID NO: 3767 - DNA, 20 bp, Chlamydia pneumoniae
ctgagctcagtttcgaagag

SEQ ID NO: 3768 - DNA, 20 bp, Chlamydia pneumoniae
ggatacctagctggtcttag

SEQ ID NO: 3769 - DNA, 20 bp, Chlamydia pneumoniae
ggttcttttagggagcactg

SEQ ID NO: 3770 - DNA, 20 bp, Chlamydia pneumoniae
ggaaaagcgcgtcctttact

SEQ ID NO: 3771 - DNA, 20 bp, Chlamydia pneumoniae
ctcccatctatacgaagcct

SEQ ID NO: 3772 - DNA, 20 bp, Chlamydia pneumoniae
ggtcgaaccaaagaggaact

SEQ ID NO: 3773 - DNA, 20 bp, Chlamydia pneumoniae
agatgcgtcgcatttttttc

SEQ ID NO: 3774 - DNA, 20 bp, Chlamydia pneumoniae
gcaacgcagcagcgagttgc

SEQ ID NO: 3775 - DNA, 20 bp, Chlamydia pneumoniae
cagctgcctaaggaattgga

SEQ ID NO: 3776 - DNA, 20 bp, Chlamydia pneumoniae
ggttgtatcgagaggagaga

SEQ ID NO: 3777 - DNA, 20 bp, Chlamydia pneumoniae
cagctgcctaaggaattgga

SEQ ID NO: 3778 - DNA, 20 bp, Chlamydia pneumoniae
ggggagcggttaaagaaatc

SEQ ID NO: 3779 - DNA, 20 bp, Chlamydia pneumoniae
gcatgctttgtatcctgagg

SEQ ID NO: 3780 - DNA, 20 bp, Chlamydia pneumoniae
gaggcaaccctgcattctat

SEQ ID NO: 3781 - DNA, 20 bp, Chlamydia pneumoniae
cagcgagttgcagcatttga

SEQ ID NO: 3782 - DNA, 20 bp, Chlamydia pneumoniae
ggattgcacagctacgacaa

SEQ ID NO: 3783 - DNA, 20 bp, Chlamydia pneumoniae
cgagaataagcccgtcttct

SEQ ID NO: 3784 - DNA, 20 bp, Chlamydia pneumoniae
cctaaggcacataagtcagg

SEQ ID NO: 3785 - DNA, 20 bp, Chlamydia pneumoniae
gggattagagcccaacgttc

SEQ ID NO: 3786 - DNA, 20 bp, Chlamydia pneumoniae
gcctggggatcttaggaaat

SEQ ID NO: 3787 - DNA, 20 bp, Chlamydia pneumoniae
gatgggtatgatggtgcgct

SEQ ID NO: 3788 - DNA, 20 bp, Chlamydia pneumoniae
cagacgaggagattcctgta

SEQ ID NO: 3789 - DNA, 20 bp, Chlamydia pneumoniae
gattgcacagctacgacaat

SEQ ID NO: 3790 - DNA, 20 bp, Chlamydia pneumoniae
ggataggtctgatgtcctac

SEQ ID NO: 3791 - DNA, 20 bp, Chlamydia pneumoniae
gcgtcgaaaagtactcgcta

SEQ ID NO: 3792 - DNA, 20 bp, Chlamydia pneumoniae
ccagaaggacttttgaggag

SEQ ID NO: 3793 - DNA, 20 bp, Chlamydia pneumoniae
cggttggtcatactactctc

SEQ ID NO: 3794 - DNA, 20 bp, Chlamydia pneumoniae
cgaactacagcttgttcctc

SEQ ID NO: 3795 - DNA, 20 bp, Chlamydia pneumoniae
acaacagttgcggagatgcc

SEQ ID NO: 3796 - DNA, 20 bp, Chlamydia pneumoniae
cgtccactaccttttcaacc

SEQ ID NO: 3797 - DNA, 20 bp, Chlamydia pneumoniae
cactatgtgtctgcgatgtc

SEQ ID NO: 3798 - DNA, 20 bp, Chlamydia pneumoniae
ggcagagctctgtgaagaaa

SEQ ID NO: 3799 - DNA, 20 bp, Chlamydia pneumoniae
gttgcagcctctacatcctt

SEQ ID NO: 3800 - DNA, 20 bp, Chlamydia pneumoniae
gcagcagcttctatattggc

SEQ ID NO: 3801 - DNA, 20 bp, Chlamydia pneumoniae
cctctacatccagagcaaac

SEQ ID NO: 3802 - DNA, 20 bp, Chlamydia pneumoniae
gatgagcgaaagatttcacc

SEQ ID NO: 3803 - DNA, 20 bp, Chlamydia pneumoniae
cacaacagcctgggactgga

SEQ ID NO: 3804 - DNA, 20 bp, Chlamydia pneumoniae
aagagaccgaaccgatggct

SEQ ID NO: 3805 - DNA, 20 bp, Chlamydia pneumoniae
cagggaaaacttcagcatcg

SEQ ID NO: 3806 - DNA, 20 bp, Chlamydia pneumoniae
gcggcatttcttccccaaat

SEQ ID NO: 3807 - DNA, 20 bp, Chlamydia pneumoniae
cttctacgactccacatcat

SEQ ID NO: 3808 - DNA, 20 bp, Chlamydia pneumoniae
cttcttccgtccgacgtttt

SEQ ID NO: 3809 - DNA, 20 bp, Chlamydia pneumoniae
caaatagctggacacgaggt

SEQ ID NO: 3810 - DNA, 20 bp, Chlamydia pneumoniae
gggctgctctatataggcat

SEQ ID NO: 3811 - DNA, 20 bp, Chlamydia pneumoniae
cgcatgaatccgcatcatca

SEQ ID NO: 3812 - DNA, 20 bp, Chlamydia pneumoniae
ggccatcttctctaatcttc

SEQ ID NO: 3813 - DNA, 20 bp, Chlamydia pneumoniae
gatgggttccttctccttca

SEQ ID NO: 3814 - DNA, 20 bp, Chlamydia pneumoniae
gaggcctttgccaaaagtaa

SEQ ID NO: 3815 - DNA, 20 bp, Chlamydia pneumoniae
ggttcatctccaaagcgatt

SEQ ID NO: 3816 - DNA, 20 bp, Chlamydia pneumoniae
cctgcgagttttcctaaagg

SEQ ID NO: 3817 - DNA, 20 bp, Chlamydia pneumoniae
agttctggggatcccttagg

SEQ ID NO: 3818 - DNA, 20 bp, Chlamydia pneumoniae
atttcaccttcgacagcgca

SEQ ID NO: 3819 - DNA, 20 bp, Chlamydia pneumoniae
acccagaaaaacgtgccgtt

SEQ ID NO: 3820 - DNA, 20 bp, Chlamydia pneumoniae
agcaagccgagcacaagaat

SEQ ID NO: 3821 - DNA, 20 bp, Chlamydia pneumoniae
gggtctcttgaacctgcatt

SEQ ID NO: 3822 - DNA, 20 bp, Chlamydia pneumoniae
cggagacaagcaaaccaaga

SEQ ID NO: 3823 - DNA, 20 bp, Chlamydia pneumoniae
accttctccagtaacactgc

SEQ ID NO: 3824 - DNA, 20 bp, Chlamydia pneumoniae
cagcattcccccacaagata

SEQ ID NO: 3825 - DNA, 20 bp, Chlamydia pneumoniae
gggacttctcgtttcttcag

SEQ ID NO: 3826 - DNA, 20 bp, Chlamydia pneumoniae
ctgtgatgtcatcatgctca

SEQ ID NO: 3827 - DNA, 20 bp, Chlamydia pneumoniae
ggctacttctataggttggg

SEQ ID NO: 3828 - DNA, 20 bp, Chlamydia pneumoniae
ttcggaccatagtcgcatga

SEQ ID NO: 3829 - DNA, 20 bp, Chlamydia pneumoniae
gggtatcctcaaccacaaag

SEQ ID NO: 3830 - DNA, 20 bp, Chlamydia pneumoniae
gcggagatagaagtacttgc

SEQ ID NO: 3831 - DNA, 20 bp, Chlamydia pneumoniae
aaacccgaatccccctggaa

SEQ ID NO: 3832 - DNA, 20 bp, Chlamydia pneumoniae
ccaagagcgcgagatttact

SEQ ID NO: 3833 - DNA, 20 bp, Chlamydia pneumoniae
gcggctgccttaaaatcttc

SEQ ID NO: 3834 - DNA, 20 bp, Chlamydia pneumoniae
ccaagagcgcgagatttact

SEQ ID NO: 3835 - DNA, 20 bp, Chlamydia pneumoniae
gcggctgccttaaaatcttc

SEQ ID NO: 3836 - DNA, 20 bp, Chlamydia pneumoniae
ctcatcgttctcattcagcc

SEQ ID NO: 3837 - DNA, 20 bp, Chlamydia pneumoniae
ccatctgtagccgatgatgt

SEQ ID NO: 3838 - DNA, 20 bp, Chlamydia pneumoniae
ttccctggtcgtaagcaaag

SEQ ID NO: 3839 - DNA, 20 bp, Chlamydia pneumoniae
gttatctccagtatcagggc

SEQ ID NO: 3840 - DNA, 20 bp, Chlamydia pneumoniae
ccaagccaaaatcttgggag

SEQ ID NO: 3841 - DNA, 20 bp, Chlamydia pneumoniae
gtatcaccacccggcatcct

SEQ ID NO: 3842 - DNA, 20 bp, Chlamydia pneumoniae
gctcctatcgtattgccttc

SEQ ID NO: 3843 - DNA, 20 bp, Chlamydia pneumoniae
gcgtggtatcctgcaatctt

SEQ ID NO: 3844 - DNA, 20 bp, Chlamydia pneumoniae
ctctcatcgctaattgccag

SEQ ID NO: 3845 - DNA, 20 bp, Chlamydia pneumoniae
gaacttccaggagacgcaat

SEQ ID NO: 3846 - DNA, 20 bp, Chlamydia pneumoniae
ggggaaagaagacttcattg

SEQ ID NO: 3847 - DNA, 20 bp, Chlamydia pneumoniae
ccttcgtttgcagtctccat

SEQ ID NO: 3848 - DNA, 20 bp, Chlamydia pneumoniae
gctcctgtgaccttattgtc

SEQ ID NO: 3849 - DNA, 20 bp, Chlamydia pneumoniae
ggactaaagcttgtcttgcc

SEQ ID NO: 3850 - DNA, 20 bp, Chlamydia pneumoniae
ttcacgagcttctgttccct

SEQ ID NO: 3851 - DNA, 20 bp, Chlamydia pneumoniae
atactaaggcacctgcagca

SEQ ID NO: 3852 - DNA, 20 bp, Chlamydia pneumoniae
gtgcaaagtctgaacgctac

SEQ ID NO: 3853 - DNA, 20 bp, Chlamydia pneumoniae
gaacttgtgctccggtccat

SEQ ID NO: 3854 - DNA, 20 bp, Chlamydia pneumoniae
gccgtcgccttaatgatagc

SEQ ID NO: 3855 - DNA, 20 bp, Chlamydia pneumoniae
acctgcatctaccgacagga

SEQ ID NO: 3856 - DNA, 20 bp, Chlamydia pneumoniae
ctgccttgcatttcttcctg

SEQ ID NO: 3857 - DNA, 20 bp, Chlamydia pneumoniae
gggatgacttgcacattcca

SEQ ID NO: 3858 - DNA, 20 bp, Chlamydia pneumoniae
tccctcccgctcctggagat

SEQ ID NO: 3859 - DNA, 20 bp, Chlamydia pneumoniae
gactacccacatcttgagca

SEQ ID NO: 3860 - DNA, 20 bp, Chlamydia pneumoniae
gagaatgaacctcctgtgtc

SEQ ID NO: 3861 - DNA, 20 bp, Chlamydia pneumoniae
tgtgggtcaaagcctgaagc

SEQ ID NO: 3862 - DNA, 20 bp, Chlamydia pneumoniae
ggtctagaaggagctacttc

SEQ ID NO: 3863 - DNA, 20 bp, Chlamydia pneumoniae
ctgagtaagactaaccctcg

SEQ ID NO: 3864 - DNA, 20 bp, Chlamydia pneumoniae
cgttctctccatgattatgc

SEQ ID NO: 3865 - DNA, 20 bp, Chlamydia pneumoniae
gaacttgccgcacaaaaggc

SEQ ID NO: 3866 - DNA, 20 bp, Chlamydia pneumoniae
ggatggtcagagctactaca

SEQ ID NO: 3867 - DNA, 20 bp, Chlamydia pneumoniae
ggggatcatcaggtaatcca

SEQ ID NO: 3868 - DNA, 20 bp, Chlamydia pneumoniae
ccttgaggaatcagacgcat

SEQ ID NO: 3869 - DNA, 20 bp, Chlamydia pneumoniae
gctgtctgctatgagcatag

SEQ ID NO: 3870 - DNA, 20 bp, Chlamydia pneumoniae
ccttgatgaagcgaacaacc

SEQ ID NO: 3871 - DNA, 20 bp, Chlamydia pneumoniae
cgggtttgaggattagtgag

SEQ ID NO: 3872 - DNA, 20 bp, Chlamydia pneumoniae
ggggatcatcaggtaatcca

SEQ ID NO: 3873 - DNA, 20 bp, Chlamydia pneumoniae
gcctctccgcatacattaag

SEQ ID NO: 3874 - DNA, 20 bp, Chlamydia pneumoniae
tcgacgttctggactttcag

SEQ ID NO: 3875 - DNA, 20 bp, Chlamydia pneumoniae
ccgacagacccataactatc

SEQ ID NO: 3876 - DNA, 20 bp, Chlamydia pneumoniae
gaagcgcaaagtctctgaac

SEQ ID NO: 3877 - DNA, 20 bp, Chlamydia pneumoniae
gccccaaaagatgcctctga

SEQ ID NO: 3878 - DNA, 20 bp, Chlamydia pneumoniae
acgtgccgcaacacaaaagc

SEQ ID NO: 3879 - DNA, 20 bp, Chlamydia pneumoniae
gccaagttgaacccttgttc

SEQ ID NO: 3880 - DNA, 20 bp, Chlamydia pneumoniae
atctcctccacccgtacaac

SEQ ID NO: 3881 - DNA, 20 bp, Chlamydia pneumoniae
cgtacgtgttgatctatcca

SEQ ID NO: 3882 - DNA, 20 bp, Chlamydia pneumoniae
gactatgaagagcttcctgc

SEQ ID NO: 3883 - DNA, 20 bp, Chlamydia pneumoniae
gagtttcctatcatgcggac

SEQ ID NO: 3884 - DNA, 20 bp, Chlamydia pneumoniae
cgccatgttcctgattatgc

SEQ ID NO: 3885 - DNA, 20 bp, Chlamydia pneumoniae
cttaggaaaaagctctggca

SEQ ID NO: 3886 - DNA, 20 bp, Chlamydia pneumoniae
cttggaaaatctacccccta

SEQ ID NO: 3887 - DNA, 20 bp, Chlamydia pneumoniae
gctgcggattaggagaaatc

SEQ ID NO: 3888 - DNA, 20 bp, Chlamydia pneumoniae
cttaggaaaaagctctggca

SEQ ID NO: 3889 - DNA, 20 bp, Chlamydia pneumoniae
cgaaacgatcgtaagagtcg

SEQ ID NO: 3890 - DNA, 20 bp, Chlamydia pneumoniae
gggacgtcccgttttcaata

SEQ ID NO: 3891 - DNA, 20 bp, Chlamydia pneumoniae
cgttcgcaggatttaatccc

SEQ ID NO: 3892 - DNA, 20 bp, Chlamydia pneumoniae
gcaactccctgaaaagagag

SEQ ID NO: 3893 - DNA, 20 bp, Chlamydia pneumoniae
ggagtttctacagaaatgcg

SEQ ID NO: 3894 - DNA, 20 bp, Chlamydia pneumoniae
acgatctacaggctctccaa

SEQ ID NO: 3895 - DNA, 20 bp, Chlamydia pneumoniae
gcagttggtgtagtgctaca

SEQ ID NO: 3896 - DNA, 20 bp, Chlamydia pneumoniae
ggaccagtctttaccaggaa

SEQ ID NO: 3897 - DNA, 20 bp, Chlamydia pneumoniae
gtgtcgggctctctttttga

SEQ ID NO: 3898 - DNA, 20 bp, Chlamydia pneumoniae
gagtctcggtataaggagag

SEQ ID NO: 3899 - DNA, 20 bp, Chlamydia pneumoniae
ccttacctccaactctacct

SEQ ID NO: 3900 - DNA, 20 bp, Chlamydia pneumoniae
gattaaataacctcagcgca

SEQ ID NO: 3901 - DNA, 20 bp, Chlamydia pneumoniae
atgctctgtgctcttcttcc

SEQ ID NO: 3902 - DNA, 20 bp, Chlamydia pneumoniae
gctacacaaccccaatatcc

SEQ ID NO: 3903 - DNA, 20 bp, Chlamydia pneumoniae
ggtctctgcgtatttcagga

SEQ ID NO: 3904 - DNA, 20 bp, Chlamydia pneumoniae
gtggagctcccaacataaga

SEQ ID NO: 3905 - DNA, 20 bp, Chlamydia pneumoniae
gcacattggcacgactagaa

SEQ ID NO: 3906 - DNA, 20 bp, Chlamydia pneumoniae
ggctctccttgaaacccaca

SEQ ID NO: 3907 - DNA, 20 bp, Chlamydia pneumoniae
ccttgcaaagaggctttagc

SEQ ID NO: 3908 - DNA, 20 bp, Chlamydia pneumoniae
gtcccgtaacttcctgttct

SEQ ID NO: 3909 - DNA, 20 bp, Chlamydia pneumoniae
gcagcggatacgctaagaaa

SEQ ID NO: 3910 - DNA, 20 bp, Chlamydia pneumoniae
gcctctccacaaatgctaac

SEQ ID NO: 3911 - DNA, 20 bp, Chlamydia pneumoniae
ggaattcgtggtacagggaa

SEQ ID NO: 3912 - DNA, 20 bp, Chlamydia pneumoniae
ggcacgactagaaaacacag

SEQ ID NO: 3913 - DNA, 20 bp, Chlamydia pneumoniae
ccatcgcgatcaaacacata

SEQ ID NO: 3914 - DNA, 20 bp, Chlamydia pneumoniae
ccctgaagatccagaagtca

SEQ ID NO: 3915 - DNA, 20 bp, Chlamydia pneumoniae
tcgagaagaaatcgacccta

SEQ ID NO: 3916 - DNA, 20 bp, Chlamydia pneumoniae
cccacctacaaagaacagag

SEQ ID NO: 3917 - DNA, 20 bp, Chlamydia pneumoniae
ctcctccttgacgtcttgta

SEQ ID NO: 3918 - DNA, 20 bp, Chlamydia pneumoniae
ggagcctcccaccgtggtat

SEQ ID NO: 3919 - DNA, 20 bp, Chlamydia pneumoniae
gcctctacaacagagactgc

SEQ ID NO: 3920 - DNA, 20 bp, Chlamydia pneumoniae
gccatcgcgatcaaacacat

SEQ ID NO: 3921 - DNA, 20 bp, Chlamydia pneumoniae
gactctttgtacgcacgttg

SEQ ID NO: 3922 - DNA, 20 bp, Chlamydia pneumoniae
gctcctgatcatgcaattcc

SEQ ID NO: 3923 - DNA, 20 bp, Chlamydia pneumoniae
ttgtacctcatggatcaggc

SEQ ID NO: 3924 - DNA, 20 bp, Chlamydia pneumoniae
cctcgactcgagatagcata

SEQ ID NO: 3925 - DNA, 20 bp, Chlamydia pneumoniae
gcagtgagcacttctatgtc

SEQ ID NO: 3926 - DNA, 20 bp, Chlamydia pneumoniae
ctgtggtgctatcggaatca

SEQ ID NO: 3927 - DNA, 20 bp, Chlamydia pneumoniae
tctgcaatcgctcttcgcta

SEQ ID NO: 3928 - DNA, 20 bp, Chlamydia pneumoniae
cgatctcttggaatctcctc

SEQ ID NO: 3929 - DNA, 20 bp, Chlamydia pneumoniae
ctaagacaaccacttccgct

SEQ ID NO: 3930 - DNA, 20 bp, Chlamydia pneumoniae
gatcaggccctctagatacc

SEQ ID NO: 3931 - DNA, 20 bp, Chlamydia pneumoniae
gtgatgccatcgtgaccaaa

SEQ ID NO: 3932 - DNA, 20 bp, Chlamydia pneumoniae
tgatcggggggtagctgtgg

SEQ ID NO: 3933 - DNA, 20 bp, Chlamydia pneumoniae
ccagcccttgagtttcaaac

SEQ ID NO: 3934 - DNA, 20 bp, Chlamydia pneumoniae
ctaaatctctgctcagcacg

SEQ ID NO: 3935 - DNA, 20 bp, Chlamydia pneumoniae
gcgactatgaaggaacacga

SEQ ID NO: 3936 - DNA, 20 bp, Chlamydia pneumoniae
gagttgtaagtgtcatgcga

SEQ ID NO: 3937 - DNA, 20 bp, Chlamydia pneumoniae
atatcagactcaggaagccc

SEQ ID NO: 3938 - DNA, 20 bp, Chlamydia pneumoniae
acagaaagagtgtgtcgagg

SEQ ID NO: 3939 - DNA, 20 bp, Chlamydia pneumoniae
cccccttcgttattgctttc

SEQ ID NO: 3940 - DNA, 20 bp, Chlamydia pneumoniae
ggatcacgcaggtaaatgga

SEQ ID NO: 3941 - DNA, 20 bp, Chlamydia pneumoniae
gtcccccaggctcgatctgg

SEQ ID NO: 3942 - DNA, 20 bp, Chlamydia pneumoniae
caaccgcctgttacctaaca

SEQ ID NO: 3943 - DNA, 20 bp, Chlamydia pneumoniae
cagacctcatacgtatccga

SEQ ID NO: 3944 - DNA, 20 bp, Chlamydia pneumoniae
tcttctacgagtgcgattgc

SEQ ID NO: 3945 - DNA, 20 bp, Chlamydia pneumoniae
cttcaagctgtgcaggatct

SEQ ID NO: 3946 - DNA, 20 bp, Chlamydia pneumoniae
ctccttcctcctagagaaga

SEQ ID NO: 3947 - DNA, 20 bp, Chlamydia pneumoniae
cctcccgaagccatataaac

SEQ ID NO: 3948 - DNA, 20 bp, Chlamydia pneumoniae
ttccttcgatggatgaggga

SEQ ID NO: 3949 - DNA, 20 bp, Chlamydia pneumoniae
gagaacatgaggaacgagag

SEQ ID NO: 3950 - DNA, 20 bp, Chlamydia pneumoniae
caccgcacagtgtctatagt

SEQ ID NO: 3951 - DNA, 20 bp, Chlamydia pneumoniae
cctcggctccaaatacgaat

SEQ ID NO: 3952 - DNA, 20 bp, Chlamydia pneumoniae
gcttggtctggtataatcca

SEQ ID NO: 3953 - DNA, 20 bp, Chlamydia pneumoniae
ggagatttagcccaagtgta

SEQ ID NO: 3954 - DNA, 20 bp, Chlamydia pneumoniae
ggctccaaagcgtcataatc

SEQ ID NO: 3955 - DNA, 20 bp, Chlamydia pneumoniae
gccgtgctttaaagccaaac

SEQ ID NO: 3956 - DNA, 20 bp, Chlamydia pneumoniae
cttgactctttcgatcgcag

SEQ ID NO: 3957 - DNA, 20 bp, Chlamydia pneumoniae
cttggatcatgagtgcttgg

SEQ ID NO: 3958 - DNA, 20 bp, Chlamydia pneumoniae
gaagttctcctcctgaatcc

SEQ ID NO: 3959 - DNA, 20 bp, Chlamydia pneumoniae
gagtccttgaagaagggact

SEQ ID NO: 3960 - DNA, 20 bp, Chlamydia pneumoniae
ctcgggagtgtttgcctaaa

SEQ ID NO: 3961 - DNA, 20 bp, Chlamydia pneumoniae
gaatcgaggcttgggatgcc

SEQ ID NO: 3962 - DNA, 20 bp, Chlamydia pneumoniae
agccacgcccattccgattc

SEQ ID NO: 3963 - DNA, 20 bp, Chlamydia pneumoniae
cgagcttcaagagcttgtct

SEQ ID NO: 3964 - DNA, 20 bp, Chlamydia pneumoniae
cgccacgatgaattgctttg

SEQ ID NO: 3965 - DNA, 20 bp, Chlamydia pneumoniae
ggaggagttggatctgatgt

SEQ ID NO: 3966 - DNA, 20 bp, Chlamydia pneumoniae
cggatgtaatgtagaccgtg

SEQ ID NO: 3967 - DNA, 20 bp, Chlamydia pneumoniae
ggccggtcgagatctataat

SEQ ID NO: 3968 - DNA, 20 bp, Chlamydia pneumoniae
gcaaatctgacacgatgcaa

SEQ ID NO: 3969 - DNA, 20 bp, Chlamydia pneumoniae
ctgacgattacgcttggtgt

SEQ ID NO: 3970 - DNA, 20 bp, Chlamydia pneumoniae
aaacacgaataccttaggtc

SEQ ID NO: 3971 - DNA, 20 bp, Chlamydia pneumoniae
ggaccttagagatcctgtct

SEQ ID NO: 3972 - DNA, 20 bp, Chlamydia pneumoniae
gattgtgtgggatttgccat

SEQ ID NO: 3973 - DNA, 20 bp, Chlamydia pneumoniae
gatataaaggaaagaggccg

SEQ ID NO: 3974 - DNA, 20 bp, Chlamydia pneumoniae
ccctgaaccttttcaatgac

SEQ ID NO: 3975 - DNA, 20 bp, Chlamydia pneumoniae
cagaattgaggaggatcctg

SEQ ID NO: 3976 - DNA, 20 bp, Chlamydia pneumoniae
gggtgacatagagggtcttt

SEQ ID NO: 3977 - DNA, 20 bp, Chlamydia pneumoniae
ctaggaaacgtcgccccacg

SEQ ID NO: 3978 - DNA, 20 bp, Chlamydia pneumoniae
gctagcatttcaacgtgaac

SEQ ID NO: 3979 - DNA, 20 bp, Chlamydia pneumoniae
gtcccccttctagtgaagtt

SEQ ID NO: 3980 - DNA, 20 bp, Chlamydia pneumoniae
gaggatcgggatggtggggg

SEQ ID NO: 3981 - DNA, 20 bp, Chlamydia pneumoniae
cgggatctatggtatcttcg

SEQ ID NO: 3982 - DNA, 20 bp, Chlamydia pneumoniae
ctctacagcagcactgctta

SEQ ID NO: 3983 - DNA, 20 bp, Chlamydia pneumoniae
caagcgatcaaccagcatca

SEQ ID NO: 3984 - DNA, 20 bp, Chlamydia pneumoniae
gtcccctcatttcgagtcta

SEQ ID NO: 3985 - DNA, 20 bp, Chlamydia pneumoniae
ggtgctcttcatttccccta

SEQ ID NO: 3986 - DNA, 20 bp, Chlamydia pneumoniae
aaacggatcctgccacagcg

SEQ ID NO: 3987 - DNA, 20 bp, Chlamydia pneumoniae
gttcagcatcttcttgagag

SEQ ID NO: 3988 - DNA, 20 bp, Chlamydia pneumoniae
ctggctggcctagtgggtag

SEQ ID NO: 3989 - DNA, 20 bp, Chlamydia pneumoniae
cgtgcttgcttacccattca

SEQ ID NO: 3990 - DNA, 20 bp, Chlamydia pneumoniae
cgtgcttgcttacccattca

SEQ ID NO: 3991 - DNA, 20 bp, Chlamydia pneumoniae
ttagctgcaggaggtttggc

SEQ ID NO: 3992 - DNA, 20 bp, Chlamydia pneumoniae
aagactcgtcagtcagatgc

SEQ ID NO: 3993 - DNA, 20 bp, Chlamydia pneumoniae
ccttccagcgaggaaaacta

SEQ ID NO: 3994 - DNA, 20 bp, Chlamydia pneumoniae
ggcttatcttgagttgcagc

SEQ ID NO: 3995 - DNA, 20 bp, Chlamydia pneumoniae
gccagcatcttgtaacttct

SEQ ID NO: 3996 - DNA, 20 bp, Chlamydia pneumoniae
ggtaaaaaaacggctccacg

SEQ ID NO: 3997 - DNA, 20 bp, Chlamydia pneumoniae
cccgtttcatcggttaaacg

SEQ ID NO: 3998 - DNA, 20 bp, Chlamydia pneumoniae
tctacctctaaacctgcagc

SEQ ID NO: 3999 - DNA, 20 bp, Chlamydia pneumoniae
ataacgccctacacgtccta

SEQ ID NO: 4000 - DNA, 20 bp, Chlamydia pneumoniae
ttctgtaggttcggcagcaa

SEQ ID NO: 4001 - DNA, 20 bp, Chlamydia pneumoniae
gaaagagaggtgatcagacc

SEQ ID NO: 4002 - DNA, 20 bp, Chlamydia pneumoniae
gaaaacctcttctaaaccga

SEQ ID NO: 4003 - DNA, 20 bp, Chlamydia pneumoniae
gcaacaacaatagctccaga

SEQ ID NO: 4004 - DNA, 20 bp, Chlamydia pneumoniae
cgcagcaacattcccaatct

SEQ ID NO: 4005 - DNA, 20 bp, Chlamydia pneumoniae
ctgttcggaaacttcagtcc

SEQ ID NO: 4006 - DNA, 20 bp, Chlamydia pneumoniae
gtcttcttcggtacgacgat

SEQ ID NO: 4007 - DNA, 20 bp, Chlamydia pneumoniae
ggctacttcaggagatgcaa

SEQ ID NO: 4008 - DNA, 20 bp, Chlamydia pneumoniae
gggttcttgggccactttta

SEQ ID NO: 4009 - DNA, 20 bp, Chlamydia pneumoniae
aaaacaagagcactgcgcgg

SEQ ID NO: 4010 - DNA, 20 bp, Chlamydia pneumoniae
ccgacacagtagcatttcca

SEQ ID NO: 4011 - DNA, 20 bp, Chlamydia pneumoniae
ggaactaagatccagaaccc

SEQ ID NO: 4012 - DNA, 20 bp, Chlamydia pneumoniae
ctcttcatggggacgtgtat

SEQ ID NO: 4013 - DNA, 20 bp, Chlamydia pneumoniae
cgatcttgagaagacttatg

SEQ ID NO: 4014 - DNA, 20 bp, Chlamydia pneumoniae
gagctatgctatgtgctttg

SEQ ID NO: 4015 - DNA, 20 bp, Chlamydia pneumoniae
tccgtcaaagcgtacacgta

SEQ ID NO: 4016 - DNA, 20 bp, Chlamydia pneumoniae
gattctggtagctgagtagg

SEQ ID NO: 4017 - DNA, 20 bp, Chlamydia pneumoniae
cctcgctcataaaaagcagc

SEQ ID NO: 4018 - DNA, 20 bp, Chlamydia pneumoniae
cctgagcaagtttggttctg

SEQ ID NO: 4019 - DNA, 20 bp, Chlamydia pneumoniae
ccaccaaaaacctggagagt

SEQ ID NO: 4020 - DNA, 20 bp, Chlamydia pneumoniae
gcgttctgctggagataaca

SEQ ID NO: 4021 - DNA, 20 bp, Chlamydia pneumoniae
cggggtccctaaaagagaat

SEQ ID NO: 4022 - DNA, 20 bp, Chlamydia pneumoniae
gtctccctaagaacgtgaca

SEQ ID NO: 4023 - DNA, 20 bp, Chlamydia pneumoniae
cctcggagacaatatcttcg

SEQ ID NO: 4024 - DNA, 20 bp, Chlamydia pneumoniae
gacctcaacaccagctatgt

SEQ ID NO: 4025 - DNA, 20 bp, Chlamydia pneumoniae
cctcctaattcatagggaac

SEQ ID NO: 4026 - DNA, 20 bp, Chlamydia pneumoniae
cctcggagacaatatcttcg

SEQ ID NO: 4027 - DNA, 20 bp, Chlamydia pneumoniae
ccacatcctatagcacttcc

SEQ ID NO: 4028 - DNA, 20 bp, Chlamydia pneumoniae
ccatgtccttcatctatccg

SEQ ID NO: 4029 - DNA, 20 bp, Chlamydia pneumoniae
cgacacgaagcttataaggc

SEQ ID NO: 4030 - DNA, 20 bp, Chlamydia pneumoniae
cacgggaaggcatttcctca

SEQ ID NO: 4031 - DNA, 20 bp, Chlamydia pneumoniae
ggaccattcaccaaagtcgt

SEQ ID NO: 4032 - DNA, 20 bp, Chlamydia pneumoniae
cgggttctgtatcctgaaag

SEQ ID NO: 4033 - DNA, 20 bp, Chlamydia pneumoniae
cctcctcaagctgatgaatc

SEQ ID NO: 4034 - DNA, 20 bp, Chlamydia pneumoniae
acaggaacaacaccaggatg

SEQ ID NO: 4035 - DNA, 20 bp, Chlamydia pneumoniae
ggctttctgatcctcaagag

SEQ ID NO: 4036 - DNA, 20 bp, Chlamydia pneumoniae
ggccactcggtaatctacat

SEQ ID NO: 4037 - DNA, 20 bp, Chlamydia pneumoniae
gaggctgcctctaaatctca

SEQ ID NO: 4038 - DNA, 20 bp, Chlamydia pneumoniae
gcgtgtgatcatactgtcct

SEQ ID NO: 4039 - DNA, 20 bp, Chlamydia pneumoniae
ggaaccactcttcatctaac

SEQ ID NO: 4040 - DNA, 20 bp, Chlamydia pneumoniae
ggttcttgtgctgtgtactc

SEQ ID NO: 4041 - DNA, 20 bp, Chlamydia pneumoniae
cttcttcgatcaactgggct

SEQ ID NO: 4042 - DNA, 20 bp, Chlamydia pneumoniae
gtctgcaggacttttagctc

SEQ ID NO: 4043 - DNA, 20 bp, Chlamydia pneumoniae
gtagagcaattagctgccag

SEQ ID NO: 4044 - DNA, 20 bp, Chlamydia pneumoniae
cttcttcgatcaactgggct

SEQ ID NO: 4045 - DNA, 20 bp, Chlamydia pneumoniae
agccgagcactttgtgcaac

SEQ ID NO: 4046 - DNA, 20 bp, Chlamydia pneumoniae
cgatcaactgggctatagaa

SEQ ID NO: 4047 - DNA, 20 bp, Chlamydia pneumoniae
ccgagcactttgtgcaactt

SEQ ID NO: 4048 - DNA, 20 bp, Chlamydia pneumoniae
ctcgcgtcgttctcccacta

SEQ ID NO: 4049 - DNA, 20 bp, Chlamydia pneumoniae
gagacaccgcatctttggtt

SEQ ID NO: 4050 - DNA, 20 bp, Chlamydia pneumoniae
cccatactcagaggcacaaa

SEQ ID NO: 4051 - DNA, 20 bp, Chlamydia pneumoniae
gacaaggaaggacgaaagaa

SEQ ID NO: 4052 - DNA, 20 bp, Chlamydia pneumoniae
cccaccgacaatgatcacta

SEQ ID NO: 4053 - DNA, 20 bp, Chlamydia pneumoniae
caggttatgtgttccgctca

SEQ ID NO: 4054 - DNA, 20 bp, Chlamydia pneumoniae
gaatgaaggcttcggactct

SEQ ID NO: 4055 - DNA, 20 bp, Chlamydia pneumoniae
ggaacaaatcccatcgaagc

SEQ ID NO: 4056 - DNA, 20 bp, Chlamydia pneumoniae
cgtctacttgggacccccca

SEQ ID NO: 4057 - DNA, 20 bp, Chlamydia pneumoniae
ctgaagaattccccatctgg

SEQ ID NO: 4058 - DNA, 20 bp, Chlamydia pneumoniae
gggcttctggatcatagatg

SEQ ID NO: 4059 - DNA, 20 bp, Chlamydia pneumoniae
tgcacaacctcgtcttgtca

SEQ ID NO: 4060 - DNA, 20 bp, Chlamydia pneumoniae
tctacgcgcctcctgaaaat

SEQ ID NO: 4061 - DNA, 20 bp, Chlamydia pneumoniae
gttgtgggggtgtataggtt

SEQ ID NO: 4062 - DNA, 20 bp, Chlamydia pneumoniae
ccagactctatggtttctcc

SEQ ID NO: 4063 - DNA, 20 bp, Chlamydia pneumoniae
cccaacgtcctatacgattg

SEQ ID NO: 4064 - DNA, 20 bp, Chlamydia pneumoniae
ctcctacctctccaacagga

SEQ ID NO: 4065 - DNA, 20 bp, Chlamydia pneumoniae
cggaatcattctgaagaggc

SEQ ID NO: 4066 - DNA, 20 bp, Chlamydia pneumoniae
gagtttgtcaaggacgagag

SEQ ID NO: 4067 - DNA, 20 bp, Chlamydia pneumoniae
tgatagcccaatcacgagcg

SEQ ID NO: 4068 - DNA, 20 bp, Chlamydia pneumoniae
cggatagtcgagaatttggc

SEQ ID NO: 4069 - DNA, 20 bp, Chlamydia pneumoniae
cctgactctaagacacaatg

SEQ ID NO: 4070 - DNA, 20 bp, Chlamydia pneumoniae
ggcaacttctccctatgtct

SEQ ID NO: 4071 - DNA, 20 bp, Chlamydia pneumoniae
gtaaacgcttcaccccagtt

SEQ ID NO: 4072 - DNA, 20 bp, Chlamydia pneumoniae
ctgtgcaggctgtcttacat

SEQ ID NO: 4073 - DNA, 20 bp, Chlamydia pneumoniae
gctgacaaatcgcctagaag

SEQ ID NO: 4074 - DNA, 20 bp, Chlamydia pneumoniae
cggtttaaatactcggcaac

SEQ ID NO: 4075 - DNA, 20 bp, Chlamydia pneumoniae
ggatctctcccatccatttc

SEQ ID NO: 4076 - DNA, 20 bp, Chlamydia pneumoniae
actcacggcaccattgagat

SEQ ID NO: 4077 - DNA, 20 bp, Chlamydia pneumoniae
tttcgaaactggttcacgtc

SEQ ID NO: 4078 - DNA, 20 bp, Chlamydia pneumoniae
ggggaaacatgcttccagat

SEQ ID NO: 4079 - DNA, 20 bp, Chlamydia pneumoniae
caggacatagtcccctatac

SEQ ID NO: 4080 - DNA, 20 bp, Chlamydia pneumoniae
gctccctgctttactaaagc

SEQ ID NO: 4081 - DNA, 20 bp, Chlamydia pneumoniae
cgaacttgggctcgttgttt

SEQ ID NO: 4082 - DNA, 20 bp, Chlamydia pneumoniae
agctgaagtgacaggctctg

SEQ ID NO: 4083 - DNA, 20 bp, Chlamydia pneumoniae
ggaccataacgtcgtattgc

SEQ ID NO: 4084 - DNA, 20 bp, Chlamydia pneumoniae
gccttcatgaggaagacaaa

SEQ ID NO: 4085 - DNA, 20 bp, Chlamydia pneumoniae
ccctgtacgcttgatttaag

SEQ ID NO: 4086 - DNA, 20 bp, Chlamydia pneumoniae
gcaacacgatgcaaggatac

SEQ ID NO: 4087 - DNA, 20 bp, Chlamydia pneumoniae
cgtctcctaacaatctacgg

SEQ ID NO: 4088 - DNA, 20 bp, Chlamydia pneumoniae
ctccaggaaatacctttccc

SEQ ID NO: 4089 - DNA, 20 bp, Chlamydia pneumoniae
caaccccagaaatcttagac

SEQ ID NO: 4090 - DNA, 20 bp, Chlamydia pneumoniae
gcctgacgatccaaaagtct

SEQ ID NO: 4091 - DNA, 20 bp, Chlamydia pneumoniae
cgaacaagttgacgcacttc

SEQ ID NO: 4092 - DNA, 20 bp, Chlamydia pneumoniae
ctttctttccacagtagggc

SEQ ID NO: 4093 - DNA, 20 bp, Chlamydia pneumoniae
gcgggggaaaaaattggtga

SEQ ID NO: 4094 - DNA, 20 bp, Chlamydia pneumoniae
ggtacatatccacgtactct

SEQ ID NO: 4095 - DNA, 20 bp, Chlamydia pneumoniae
cgttggcgataaggtaatgc

SEQ ID NO: 4096 - DNA, 20 bp, Chlamydia pneumoniae
cctcgcactttatgatgctc

SEQ ID NO: 4097 - DNA, 20 bp, Chlamydia pneumoniae
cccaacctttggaactagga

SEQ ID NO: 4098 - DNA, 20 bp, Chlamydia pneumoniae
ccagcactccttagaagaac

SEQ ID NO: 4099 - DNA, 20 bp, Chlamydia pneumoniae
cctaagttgtccgaagtcac

SEQ ID NO: 4100 - DNA, 20 bp, Chlamydia pneumoniae
gcacaagggaacatcgatct

SEQ ID NO: 4101 - DNA, 20 bp, Chlamydia pneumoniae
cataatctctgcacagctgc

SEQ ID NO: 4102 - DNA, 20 bp, Chlamydia pneumoniae
ctctggcttcaaagtcctct

SEQ ID NO: 4103 - DNA, 20 bp, Chlamydia pneumoniae
ccccaatctcttccctaagc

SEQ ID NO: 4104 - DNA, 20 bp, Chlamydia pneumoniae
ccacaactagaaatagctcc

SEQ ID NO: 4105 - DNA, 20 bp, Chlamydia pneumoniae
cccaactcccgctagatcaa

SEQ ID NO: 4106 - DNA, 20 bp, Chlamydia pneumoniae
gcacttcagatagatggctc

SEQ ID NO: 4107 - DNA, 20 bp, Chlamydia pneumoniae
ctctgcctagttctcttcgg

SEQ ID NO: 4108 - DNA, 20 bp, Chlamydia pneumoniae
ccgtcatatttaaaaggcgg

SEQ ID NO: 4109 - DNA, 20 bp, Chlamydia pneumoniae
ctcgaaaaaacaccccccat

SEQ ID NO: 4110 - DNA, 20 bp, Chlamydia pneumoniae
gcattgctaggggcgatatt

SEQ ID NO: 4111 - DNA, 20 bp, Chlamydia pneumoniae
cacggctatgaagagatgtc

SEQ ID NO: 4112 - DNA, 20 bp, Chlamydia pneumoniae
gggagtcattgcagtcatac

SEQ ID NO: 4113 - DNA, 20 bp, Chlamydia pneumoniae
cacctactacttccctgtag

SEQ ID NO: 4114 - DNA, 20 bp, Chlamydia pneumoniae
gaaagcaccttcttgagtgc

SEQ ID NO: 4115 - DNA, 20 bp, Chlamydia pneumoniae
cccatcctccggagtatttt

SEQ ID NO: 4116 - DNA, 20 bp, Chlamydia pneumoniae
cgcttttctgtgtgtattcg

SEQ ID NO: 4117 - DNA, 20 bp, Chlamydia pneumoniae
ccatgtcacgcgctttctta

SEQ ID NO: 4118 - DNA, 20 bp, Chlamydia pneumoniae
cgatggaaaaacatacgcac

SEQ ID NO: 4119 - DNA, 20 bp, Chlamydia pneumoniae
ccccagagaaataacagacc

SEQ ID NO: 4120 - DNA, 20 bp, Chlamydia pneumoniae
ccccattccacgttcttaca

SEQ ID NO: 4121 - DNA, 20 bp, Chlamydia pneumoniae
gagacctttttctttgggaa

SEQ ID NO: 4122 - DNA, 20 bp, Chlamydia pneumoniae
gctaccaaagcaagcacaga

SEQ ID NO: 4123 - DNA, 20 bp, Chlamydia pneumoniae
ggcgctatcatttgtcagca

SEQ ID NO: 4124 - DNA, 20 bp, Chlamydia pneumoniae
caaaactctcagaggctctc

SEQ ID NO: 4125 - DNA, 20 bp, Chlamydia pneumoniae
gaggtatcgacaaagccgta

SEQ ID NO: 4126 - DNA, 20 bp, Chlamydia pneumoniae
cccaagtcactgtaggaaga

SEQ ID NO: 4127 - DNA, 20 bp, Chlamydia pneumoniae
gtgaaatcatggccgtccta

SEQ ID NO: 4128 - DNA, 20 bp, Chlamydia pneumoniae
actcctcacaacagaagcct

SEQ ID NO: 4129 - DNA, 20 bp, Chlamydia pneumoniae
cgctttgttatcgtgattgc

SEQ ID NO: 4130 - DNA, 20 bp, Chlamydia pneumoniae
cgtgctgaggtccttgtttt

SEQ ID NO: 4131 - DNA, 20 bp, Chlamydia pneumoniae
ccgaattctctccctctcat

SEQ ID NO: 4132 - DNA, 20 bp, Chlamydia pneumoniae
ggtctgacttcccactcaat

SEQ ID NO: 4133 - DNA, 20 bp, Chlamydia pneumoniae
gccacagaaaaagtaggtcc

SEQ ID NO: 4134 - DNA, 20 bp, Chlamydia pneumoniae
gtcgacagctctagaaagca

SEQ ID NO: 4135 - DNA, 20 bp, Chlamydia pneumoniae
ggaggcatctcaacaactga

SEQ ID NO: 4136 - DNA, 20 bp, Chlamydia pneumoniae
gccgaattacaacccccatt

SEQ ID NO: 4137 - DNA, 20 bp, Chlamydia pneumoniae
ccccctacaagcaaaccaaa

SEQ ID NO: 4138 - DNA, 20 bp, Chlamydia pneumoniae
tggcaagcaggacaacttga

SEQ ID NO: 4139 - DNA, 20 bp, Chlamydia pneumoniae
ccaaccagctcttcccttta

SEQ ID NO: 4140 - DNA, 20 bp, Chlamydia pneumoniae
cgatatccaagtgttacgtg

SEQ ID NO: 4141 - DNA, 20 bp, Chlamydia pneumoniae
ggaggtttagtagaccctcg

SEQ ID NO: 4142 - DNA, 20 bp, Chlamydia pneumoniae
atgaaggagaatggcgccta

SEQ ID NO: 4143 - DNA, 20 bp, Chlamydia pneumoniae
cggtagttttttgcgtcctg

SEQ ID NO: 4144 - DNA, 20 bp, Chlamydia pneumoniae
gaggctgctacacaagtaac

SEQ ID NO: 4145 - DNA, 20 bp, Chlamydia pneumoniae
ccaccttgtgcttgtcaaac

SEQ ID NO: 4146 - DNA, 20 bp, Chlamydia pneumoniae
gcacttcgagatttctagag

SEQ ID NO: 4147 - DNA, 20 bp, Chlamydia pneumoniae
ccataaaattcaccccaagc

SEQ ID NO: 4148 - DNA, 20 bp, Chlamydia pneumoniae
ccttgtgcttgtcaaacata

SEQ ID NO: 4149 - DNA, 20 bp, Chlamydia pneumoniae
taccgaagctcagctacacg

SEQ ID NO: 4150 - DNA, 20 bp, Chlamydia pneumoniae
ggggataggaagcaagaatg

SEQ ID NO: 4151 - DNA, 20 bp, Chlamydia pneumoniae
gcgcatccgaaagacttttc

SEQ ID NO: 4152 - DNA, 20 bp, Chlamydia pneumoniae
cccctaaacatacgccgaat

SEQ ID NO: 4153 - DNA, 20 bp, Chlamydia pneumoniae
ccgagtaaggagatagctac

SEQ ID NO: 4154 - DNA, 20 bp, Chlamydia pneumoniae
ggccatgaactgtctggaaa

SEQ ID NO: 4155 - DNA, 20 bp, Chlamydia pneumoniae
gggaaaatgccttgaggaag

SEQ ID NO: 4156 - DNA, 20 bp, Chlamydia pneumoniae
cgttgctctctcctctgtat

SEQ ID NO: 4157 - DNA, 20 bp, Chlamydia pneumoniae
cccgaacgacgctgtatacg

SEQ ID NO: 4158 - DNA, 20 bp, Chlamydia pneumoniae
cccttgcgatagagaatcct

SEQ ID NO: 4159 - DNA, 20 bp, Chlamydia pneumoniae
cagagattctaggacgatgc

SEQ ID NO: 4160 - DNA, 20 bp, Chlamydia pneumoniae
cccttgcgatagagaatcct

SEQ ID NO: 4161 - DNA, 20 bp, Chlamydia pneumoniae
cagagattctaggacgatgc

SEQ ID NO: 4162 - DNA, 20 bp, Chlamydia pneumoniae
gccccaggattattacgatg

SEQ ID NO: 4163 - DNA, 20 bp, Chlamydia pneumoniae
cccacaattccggatagcag

SEQ ID NO: 4164 - DNA, 20 bp, Chlamydia pneumoniae
ttccagagggacgatctccg

SEQ ID NO: 4165 - DNA, 20 bp, Chlamydia pneumoniae
gccgtcctgtttagtcgaat

SEQ ID NO: 4166 - DNA, 20 bp, Chlamydia pneumoniae
cacctgggacgctcgattcc

SEQ ID NO: 4167 - DNA, 20 bp, Chlamydia pneumoniae
ccccttcactagagattgct

SEQ ID NO: 4168 - DNA, 20 bp, Chlamydia pneumoniae
ttttccggtggctatcgcct

SEQ ID NO: 4169 - DNA, 20 bp, Chlamydia pneumoniae
gcttctgagatttcccactg

SEQ ID NO: 4170 - DNA, 20 bp, Chlamydia pneumoniae
gcacgagctgatctcatatc

SEQ ID NO: 4171 - DNA, 20 bp, Chlamydia pneumoniae
ggcgatgttgatctcctcat

SEQ ID NO: 4172 - DNA, 20 bp, Chlamydia pneumoniae
ccctaacacaggacacaact

SEQ ID NO: 4173 - DNA, 20 bp, Chlamydia pneumoniae
gcgatctcgttcacttttcc

SEQ ID NO: 4174 - DNA, 20 bp, Chlamydia pneumoniae
gcttgaaagcttcgatgttc

SEQ ID NO: 4175 - DNA, 20 bp, Chlamydia pneumoniae
gatttaggaaacgacggcac

SEQ ID NO: 4176 - DNA, 20 bp, Chlamydia pneumoniae
ccacgttccattttcttccc

SEQ ID NO: 4177 - DNA, 20 bp, Chlamydia pneumoniae
gcctcacgcacttcttgatt

SEQ ID NO: 4178 - DNA, 20 bp, Chlamydia pneumoniae
ctcttcgctgatatgcggag

SEQ ID NO: 4179 - DNA, 20 bp, Chlamydia pneumoniae
caggacgtactttaagtctg

SEQ ID NO: 4180 - DNA, 20 bp, Chlamydia pneumoniae
agaagcaaacgaacttcccc

SEQ ID NO: 4181 - DNA, 20 bp, Chlamydia pneumoniae
ggtggtgttggaataccatc

SEQ ID NO: 4182 - DNA, 20 bp, Chlamydia pneumoniae
ggtaggaaattttggctaag

SEQ ID NO: 4183 - DNA, 20 bp, Chlamydia pneumoniae
ctataccatggcctaaactc

SEQ ID NO: 4184 - DNA, 20 bp, Chlamydia pneumoniae
ggctgttgtttctacagcag

SEQ ID NO: 4185 - DNA, 20 bp, Chlamydia pneumoniae
gcaggattcccttccaactt

SEQ ID NO: 4186 - DNA, 20 bp, Chlamydia pneumoniae
ggaggtccatatggacctat

SEQ ID NO: 4187 - DNA, 20 bp, Chlamydia pneumoniae
caactgagtgaacagcttgc

SEQ ID NO: 4188 - DNA, 20 bp, Chlamydia pneumoniae
ggctatccgctacttcttac

SEQ ID NO: 4189 - DNA, 20 bp, Chlamydia pneumoniae
ccctccagagttgcaaaaac

SEQ ID NO: 4190 - DNA, 20 bp, Chlamydia pneumoniae
gatgcaaaggaacggctctt

SEQ ID NO: 4191 - DNA, 20 bp, Chlamydia pneumoniae
tatgcctagtgctcgcaatc

SEQ ID NO: 4192 - DNA, 20 bp, Chlamydia pneumoniae
tgctcgcaatctccctccaa

SEQ ID NO: 4193 - DNA, 20 bp, Chlamydia pneumoniae
gtgtcgctggtgtaggggta

SEQ ID NO: 4194 - DNA, 20 bp, Chlamydia pneumoniae
ctcaaggaccagacaatcct

SEQ ID NO: 4195 - DNA, 20 bp, Chlamydia pneumoniae
ctacaggtcattgtcatctc

SEQ ID NO: 4196 - DNA, 20 bp, Chlamydia pneumoniae
gcggctcttcgaactacaaa

SEQ ID NO: 4197 - DNA, 20 bp, Chlamydia pneumoniae
ggcgtgagataaccatcttg

SEQ ID NO: 4198 - DNA, 20 bp, Chlamydia pneumoniae
tctggggagcgcaatctctg

SEQ ID NO: 4199 - DNA, 20 bp, Chlamydia pneumoniae
cgtactccgattagccctat

SEQ ID NO: 4200 - DNA, 20 bp, Chlamydia pneumoniae
cccccacaattagagttagg

SEQ ID NO: 4201 - DNA, 20 bp, Chlamydia pneumoniae
gcagcaaaacgaagacaacc

SEQ ID NO: 4202 - DNA, 20 bp, Chlamydia pneumoniae
ggcagaaaagaggtgcatct

SEQ ID NO: 4203 - DNA, 20 bp, Chlamydia pneumoniae
gcggaagacaataatcgctc

SEQ ID NO: 4204 - DNA, 20 bp, Chlamydia pneumoniae
ggaaggatcccagctacaaa

SEQ ID NO: 4205 - DNA, 20 bp, Chlamydia pneumoniae
agaggaaagacctgtctagc

SEQ ID NO: 4206 - DNA, 20 bp, Chlamydia pneumoniae
cgtttagctgcaaccgtaga

SEQ ID NO: 4207 - DNA, 20 bp, Chlamydia pneumoniae
cgagtgactttctcgtctct

SEQ ID NO: 4208 - DNA, 20 bp, Chlamydia pneumoniae
gcagcaaaacgaagacaacc

SEQ ID NO: 4209 - DNA, 20 bp, Chlamydia pneumoniae
cgtgcttcgcaaacgttttc

SEQ ID NO: 4210 - DNA, 20 bp, Chlamydia pneumoniae
ggcttagggttattaagccg

SEQ ID NO: 4211 - DNA, 20 bp, Chlamydia pneumoniae
tgggaccataacacctcaat

SEQ ID NO: 4212 - DNA, 20 bp, Chlamydia pneumoniae
gggagggtgtctcattaaat

SEQ ID NO: 4213 - DNA, 20 bp, Chlamydia pneumoniae
ggacatgcctccgaagtaat

SEQ ID NO: 4214 - DNA, 20 bp, Chlamydia pneumoniae
ccatagcattacgtgctgta

SEQ ID NO: 4215 - DNA, 20 bp, Chlamydia pneumoniae
cgctataggcattggtcctt

SEQ ID NO: 4216 - DNA, 20 bp, Chlamydia pneumoniae
gttcctgggggagttgaagg

SEQ ID NO: 4217 - DNA, 20 bp, Chlamydia pneumoniae
ccctgatccaaactcgagat

SEQ ID NO: 4218 - DNA, 20 bp, Chlamydia pneumoniae
gcatacatggaagaagcctt

SEQ ID NO: 4219 - DNA, 20 bp, Chlamydia pneumoniae
gctgttgagtgtgtgactgt

SEQ ID NO: 4220 - DNA, 20 bp, Chlamydia pneumoniae
gagtgctgtcgtcgtatatc

SEQ ID NO: 4221 - DNA, 20 bp, Chlamydia pneumoniae
cctcgacttggagataagac

SEQ ID NO: 4222 - DNA, 20 bp, Chlamydia pneumoniae
acgcaagaactggcacctat

SEQ ID NO: 4223 - DNA, 20 bp, Chlamydia pneumoniae
gagtggggaaaagataggga

SEQ ID NO: 4224 - DNA, 20 bp, Chlamydia pneumoniae
ccaagtctgtgagtgtcatc

SEQ ID NO: 4225 - DNA, 20 bp, Chlamydia pneumoniae
cctcaggggaatccttttgt

SEQ ID NO: 4226 - DNA, 20 bp, Chlamydia pneumoniae
gattcttggcgtccaacctt

SEQ ID NO: 4227 - DNA, 20 bp, Chlamydia pneumoniae
cttggatctctttcctcctg

SEQ ID NO: 4228 - DNA, 20 bp, Chlamydia pneumoniae
ggaaagcgtttcttcctctg

SEQ ID NO: 4229 - DNA, 20 bp, Chlamydia pneumoniae
ggctatggtacgtagaacac

SEQ ID NO: 4230 - DNA, 20 bp, Chlamydia pneumoniae
gaatctcggggtgctttcat

SEQ ID NO: 4231 - DNA, 20 bp, Chlamydia pneumoniae
ccatctccaggtcgtttaga

SEQ ID NO: 4232 - DNA, 20 bp, Chlamydia pneumoniae
acaaccagcaagccgcgtta

SEQ ID NO: 4233 - DNA, 20 bp, Chlamydia pneumoniae
tatagagcgttttctgccgc

SEQ ID NO: 4234 - DNA, 20 bp, Chlamydia pneumoniae
ggctatggtacgtagaacac

SEQ ID NO: 4235 - DNA, 20 bp, Chlamydia pneumoniae
gcctcaagcagcaaagtctt

SEQ ID NO: 4236 - DNA, 20 bp, Chlamydia pneumoniae
agctcggaggcttttctaat

SEQ ID NO: 4237 - DNA, 20 bp, Chlamydia pneumoniae
aggggaatagacaagagcct

SEQ ID NO: 4238 - DNA, 20 bp, Chlamydia pneumoniae
ctacaacaagttccggagac

SEQ ID NO: 4239 - DNA, 20 bp, Chlamydia pneumoniae
cctttcttgctgaggatcca

SEQ ID NO: 4240 - DNA, 20 bp, Chlamydia pneumoniae
gactgtctctgcaatggtct

SEQ ID NO: 4241 - DNA, 20 bp, Chlamydia pneumoniae
ctcttctaagtcctcagcag

SEQ ID NO: 4242 - DNA, 20 bp, Chlamydia pneumoniae
cgggatttacaggacagagc

SEQ ID NO: 4243 - DNA, 20 bp, Chlamydia pneumoniae
cagccttctgagcttcttgt

SEQ ID NO: 4244 - DNA, 20 bp, Chlamydia pneumoniae
gtataggaggttagaatcac

SEQ ID NO: 4245 - DNA, 20 bp, Chlamydia pneumoniae
aggcgtttgctaagatctgc

SEQ ID NO: 4246 - DNA, 20 bp, Chlamydia pneumoniae
cccaagaggtttcctcctta

SEQ ID NO: 4247 - DNA, 20 bp, Chlamydia pneumoniae
caggctggtacccattgtta

SEQ ID NO: 4248 - DNA, 20 bp, Chlamydia pneumoniae
agcatctccagcgtttgctt

SEQ ID NO: 4249 - DNA, 20 bp, Chlamydia pneumoniae
ccacaatagctacgattggc

SEQ ID NO: 4250 - DNA, 20 bp, Chlamydia pneumoniae
gacgttgcttctgacctgtt

SEQ ID NO: 4251 - DNA, 20 bp, Chlamydia pneumoniae
tcccagaaaggggaagctat

SEQ ID NO: 4252 - DNA, 20 bp, Chlamydia pneumoniae
ggaacacaagtaagcaaacc

SEQ ID NO: 4253 - DNA, 20 bp, Chlamydia pneumoniae
ggccttgaagcttcatttga

SEQ ID NO: 4254 - DNA, 20 bp, Chlamydia pneumoniae
ccgtcgagttcgaatttctc

SEQ ID NO: 4255 - DNA, 20 bp, Chlamydia pneumoniae
ctgggctcacttcccactgg

SEQ ID NO: 4256 - DNA, 20 bp, Chlamydia pneumoniae
gggagttgtgcttgttgtag

SEQ ID NO: 4257 - DNA, 20 bp, Chlamydia pneumoniae
gtcgaggcgcttacaaatga

SEQ ID NO: 4258 - DNA, 20 bp, Chlamydia pneumoniae
tatctctccagaaccctgga

SEQ ID NO: 4259 - DNA, 20 bp, Chlamydia pneumoniae
cttgagcgatgcgttagtgt

SEQ ID NO: 4260 - DNA, 20 bp, Chlamydia pneumoniae
cgaagagggtatgtgaatcc

SEQ ID NO: 4261 - DNA, 20 bp, Chlamydia pneumoniae
gggaagcttccatcgttaga

SEQ ID NO: 4262 - DNA, 20 bp, Chlamydia pneumoniae
cgatttctgcattgggggtt

SEQ ID NO: 4263 - DNA, 20 bp, Chlamydia pneumoniae
cgaaaccttgcctactctgt

SEQ ID NO: 4264 - DNA, 20 bp, Chlamydia pneumoniae
ggcatcgttccgacatcttt

SEQ ID NO: 4265 - DNA, 20 bp, Chlamydia pneumoniae
gttggcctgttgtagagctt

SEQ ID NO: 4266 - DNA, 20 bp, Chlamydia pneumoniae
gaatccgcaatggttttggg

SEQ ID NO: 4267 - DNA, 20 bp, Chlamydia pneumoniae
catagtttagcaggggggaa

SEQ ID NO: 4268 - DNA, 20 bp, Chlamydia pneumoniae
gtaattcgtacggttcctgg

SEQ ID NO: 4269 - DNA, 20 bp, Chlamydia pneumoniae
ggattgcagggttctttgag

SEQ ID NO: 4270 - DNA, 20 bp, Chlamydia pneumoniae
gcaagttcaggaacgactcc

SEQ ID NO: 4271 - DNA, 20 bp, Chlamydia pneumoniae
gcgttgtgccatctcttgtt

SEQ ID NO: 4272 - DNA, 20 bp, Chlamydia pneumoniae
ccgtccgaggaaagagagta

SEQ ID NO: 4273 - DNA, 20 bp, Chlamydia pneumoniae
cggactcctagattttctgg

SEQ ID NO: 4274 - DNA, 20 bp, Chlamydia pneumoniae
cagcgaagaaacggagcata

SEQ ID NO: 4275 - DNA, 20 bp, Chlamydia pneumoniae
gctccataaagcgctgtctt

SEQ ID NO: 4276 - DNA, 20 bp, Chlamydia pneumoniae
gttgggcaatagaaaggtcc

SEQ ID NO: 4277 - DNA, 20 bp, Chlamydia pneumoniae
gttgctctagggtaatcacc

SEQ ID NO: 4278 - DNA, 20 bp, Chlamydia pneumoniae
ggtcggagtccgtggtggat

SEQ ID NO: 4279 - DNA, 20 bp, Chlamydia pneumoniae
cttgaagtagacctcagctc

SEQ ID NO: 4280 - DNA, 20 bp, Chlamydia pneumoniae
cttgaagtagacctcagctc

SEQ ID NO: 4281 - DNA, 20 bp, Chlamydia pneumoniae
atccatgagatccctcttcg

SEQ ID NO: 4282 - DNA, 20 bp, Chlamydia pneumoniae
cgagcatggagagacaagaa

SEQ ID NO: 4283 - DNA, 20 bp, Chlamydia pneumoniae
gggaggttcacaagatcaag

SEQ ID NO: 4284 - DNA, 20 bp, Chlamydia pneumoniae
ccgactagagcaagatttcg

SEQ ID NO: 4285 - DNA, 20 bp, Chlamydia pneumoniae
gaaggcgagggttcttttag

SEQ ID NO: 4286 - DNA, 20 bp, Chlamydia pneumoniae
accttacgtgctctggggat

SEQ ID NO: 4287 - DNA, 20 bp, Chlamydia pneumoniae
ttgtgaagatttggtagccc

SEQ ID NO: 4288 - DNA, 20 bp, Chlamydia pneumoniae
gaagcaagaacattatgggg

SEQ ID NO: 4289 - DNA, 20 bp, Chlamydia pneumoniae
gcgtgtggagtatcatcttc

SEQ ID NO: 4290 - DNA, 20 bp, Chlamydia pneumoniae
ggagttctcttagacagact

SEQ ID NO: 4291 - DNA, 20 bp, Chlamydia pneumoniae
ggtgggtagagtttgtagag

SEQ ID NO: 4292 - DNA, 20 bp, Chlamydia pneumoniae
gtgtgagtagtagtgtggag

SEQ ID NO: 4293 - DNA, 20 bp, Chlamydia pneumoniae
tatttacgaaccccacgagg

SEQ ID NO: 4294 - DNA, 20 bp, Chlamydia pneumoniae
gctccgaaccagatgaatgt

SEQ ID NO: 4295 - DNA, 20 bp, Chlamydia pneumoniae
gaccaggtggatgagtagtt

SEQ ID NO: 4296 - DNA, 20 bp, Chlamydia pneumoniae
tcctgccatagcagtgagga

SEQ ID NO: 4297 - DNA, 20 bp, Chlamydia pneumoniae
gctgagcgtcccataagttt

SEQ ID NO: 4298 - DNA, 20 bp, Chlamydia pneumoniae
ggctaaagtcaatgggattc

SEQ ID NO: 4299 - DNA, 20 bp, Chlamydia pneumoniae
agtgcaccagttgtggcttg

SEQ ID NO: 4300 - DNA, 20 bp, Chlamydia pneumoniae
ggttgatcgacgctctcttt

SEQ ID NO: 4301 - DNA, 20 bp, Chlamydia pneumoniae
ccaatgtacaggcctcttct

SEQ ID NO: 4302 - DNA, 20 bp, Chlamydia pneumoniae
ggggctgtttagttatgagg

SEQ ID NO: 4303 - DNA, 20 bp, Chlamydia pneumoniae
cagagaagacctttggtgct

SEQ ID NO: 4304 - DNA, 20 bp, Chlamydia pneumoniae
ccaatgtacaggcctcttct

SEQ ID NO: 4305 - DNA, 20 bp, Chlamydia pneumoniae
ctccagttcagaggtgctat

SEQ ID NO: 4306 - DNA, 20 bp, Chlamydia pneumoniae
ggctgtggaggattgtattg

SEQ ID NO: 4307 - DNA, 20 bp, Chlamydia pneumoniae
agaaagtccggcacgtcttt

SEQ ID NO: 4308 - DNA, 20 bp, Chlamydia pneumoniae
aggaattcccagattagagc

SEQ ID NO: 4309 - DNA, 20 bp, Chlamydia pneumoniae
ccgaagttataggagggaac

SEQ ID NO: 4310 - DNA, 20 bp, Chlamydia pneumoniae
gcacgtattcgcaagactct

SEQ ID NO: 4311 - DNA, 20 bp, Chlamydia pneumoniae
cttggaaatccttcccagtc

SEQ ID NO: 4312 - DNA, 20 bp, Chlamydia pneumoniae
ggggatcttcttctgtttgg

SEQ ID NO: 4313 - DNA, 20 bp, Chlamydia pneumoniae
cgtcacaaagattgctgacc

SEQ ID NO: 4314 - DNA, 20 bp, Chlamydia pneumoniae
tgagtgcgatttctgagcgt

SEQ ID NO: 4315 - DNA, 20 bp, Chlamydia pneumoniae
aggcgctggtaggtacaata

SEQ ID NO: 4316 - DNA, 20 bp, Chlamydia pneumoniae
cagagaaagtctggaatcca

SEQ ID NO: 4317 - DNA, 20 bp, Chlamydia pneumoniae
gaaccatgcgccttcatcag

SEQ ID NO: 4318 - DNA, 20 bp, Chlamydia pneumoniae
gccgatccatcctagagata

SEQ ID NO: 4319 - DNA, 20 bp, Chlamydia pneumoniae
gaatatcggcgttggagtag

SEQ ID NO: 4320 - DNA, 20 bp, Chlamydia pneumoniae
gaccctagcttgggatttct

SEQ ID NO: 4321 - DNA, 20 bp, Chlamydia pneumoniae
gctacgtataggtacttcgt

SEQ ID NO: 4322 - DNA, 20 bp, Chlamydia pneumoniae
gaatatcggcgttggagtag

SEQ ID NO: 4323 - DNA, 20 bp, Chlamydia pneumoniae
ccagacttttgcatgttgcg

SEQ ID NO: 4324 - DNA, 20 bp, Chlamydia pneumoniae
cgctattgtgggagggaaga

SEQ ID NO: 4325 - DNA, 20 bp, Chlamydia pneumoniae
ccgtaggcgtggattaattg

SEQ ID NO: 4326 - DNA, 20 bp, Chlamydia pneumoniae
ggagaactgcttgtgccata

SEQ ID NO: 4327 - DNA, 20 bp, Chlamydia pneumoniae
cgggtttttggggaactgct

SEQ ID NO: 4328 - DNA, 20 bp, Chlamydia pneumoniae
ggttcgttaatccctcgaga

SEQ ID NO: 4329 - DNA, 20 bp, Chlamydia pneumoniae
tagggtagacgattctaggc

SEQ ID NO: 4330 - DNA, 20 bp, Chlamydia pneumoniae
cagaatggagcgaatgatcg

SEQ ID NO: 4331 - DNA, 20 bp, Chlamydia pneumoniae
gctgtagtcggagactactt

SEQ ID NO: 4332 - DNA, 20 bp, Chlamydia pneumoniae
ggttgtggggttgttgtttg

SEQ ID NO: 4333 - DNA, 20 bp, Chlamydia pneumoniae
gcagctcaagcattgctatg

SEQ ID NO: 4334 - DNA, 20 bp, Chlamydia pneumoniae
ggctgccatttgctgttgaa

SEQ ID NO: 4335 - DNA, 20 bp, Chlamydia pneumoniae
ccaagaaatgcagggaggat

SEQ ID NO: 4336 - DNA, 20 bp, Chlamydia pneumoniae
cttacaaagttggctgaggg

SEQ ID NO: 4337 - DNA, 20 bp, Chlamydia pneumoniae
gttaggcacgtaagcttctc

SEQ ID NO: 4338 - DNA, 20 bp, Chlamydia pneumoniae
ccttcttgttctgcttgtgc

SEQ ID NO: 4339 - DNA, 20 bp, Chlamydia pneumoniae
ctacatagaatctcaggtgc

SEQ ID NO: 4340 - DNA, 20 bp, Chlamydia pneumoniae
ccaagaaatgcagggaggat

SEQ ID NO: 4341 - DNA, 20 bp, Chlamydia pneumoniae
ctggatccttcaatgagacc

SEQ ID NO: 4342 - DNA, 20 bp, Chlamydia pneumoniae
cgagcagagagtatacagtc

SEQ ID NO: 4343 - DNA, 20 bp, Chlamydia pneumoniae
gacgttgcctatatgcagca

SEQ ID NO: 4344 - DNA, 20 bp, Chlamydia pneumoniae
cttcccaagacagagtgtgt

SEQ ID NO: 4345 - DNA, 20 bp, Chlamydia pneumoniae
ctagtctccaaatcgcggtt

SEQ ID NO: 4346 - DNA, 20 bp, Chlamydia pneumoniae
gttaggcacgtaagcttctc

SEQ ID NO: 4347 - DNA, 20 bp, Chlamydia pneumoniae
tagtgtcagcggcgctgttt

SEQ ID NO: 4348 - DNA, 20 bp, Chlamydia pneumoniae
caggtgctagtacctgagta

SEQ ID NO: 4349 - DNA, 20 bp, Chlamydia pneumoniae
gcagatgtgaggcctttctt

SEQ ID NO: 4350 - DNA, 20 bp, Chlamydia pneumoniae
gcagctcagtgcttgtcttt

SEQ ID NO: 4351 - DNA, 20 bp, Chlamydia pneumoniae
caaggactatgtttttgggc

SEQ ID NO: 4352 - DNA, 20 bp, Chlamydia pneumoniae
gataccttgctcaagagtgt

SEQ ID NO: 4353 - DNA, 20 bp, Chlamydia pneumoniae
ggagtcgaagctaaatctgg

SEQ ID NO: 4354 - DNA, 20 bp, Chlamydia pneumoniae
cgttcaagagattgggatct

SEQ ID NO: 4355 - DNA, 20 bp, Chlamydia pneumoniae
cgttaagccgttgacgttct

SEQ ID NO: 4356 - DNA, 20 bp, Chlamydia pneumoniae
gcgtgcgggcaaaactccaa

SEQ ID NO: 4357 - DNA, 20 bp, Chlamydia pneumoniae
ggggtccatttctagggaat

SEQ ID NO: 4358 - DNA, 20 bp, Chlamydia pneumoniae
cgttaagccgttgacgttct

SEQ ID NO: 4359 - DNA, 20 bp, Chlamydia pneumoniae
gccagggaatctgtttttcc

SEQ ID NO: 4360 - DNA, 20 bp, Chlamydia pneumoniae
cttcctcttgcagagatgag

SEQ ID NO: 4361 - DNA, 20 bp, Chlamydia pneumoniae
gttgccatagtctcaatccc

SEQ ID NO: 4362 - DNA, 20 bp, Chlamydia pneumoniae
agtgaggtgatatagagcgg

SEQ ID NO: 4363 - DNA, 20 bp, Chlamydia pneumoniae
gaccatcttctcctagtcct

SEQ ID NO: 4364 - DNA, 20 bp, Chlamydia pneumoniae
cataacttctatcccccccc

SEQ ID NO: 4365 - DNA, 20 bp, Chlamydia pneumoniae
cgacatgatgatgacagggt

SEQ ID NO: 4366 - DNA, 20 bp, Chlamydia pneumoniae
gttgccatagtctcaatccc

SEQ ID NO: 4367 - DNA, 20 bp, Chlamydia pneumoniae
ttcagtggtgcgcagtaact

SEQ ID NO: 4368 - DNA, 20 bp, Chlamydia pneumoniae
gttctcgaccatctcagcat

SEQ ID NO: 4369 - DNA, 20 bp, Chlamydia pneumoniae
ccgcctcacaatctacaatc

SEQ ID NO: 4370 - DNA, 20 bp, Chlamydia pneumoniae
taggaccgacattaggtgcc

SEQ ID NO: 4371 - DNA, 20 bp, Chlamydia pneumoniae
aggaaactcttcttccttgc

SEQ ID NO: 4372 - DNA, 20 bp, Chlamydia pneumoniae
gctgagagcccttagctaaa

SEQ ID NO: 4373 - DNA, 20 bp, Chlamydia pneumoniae
gctgtagtttgtgcagttgt

SEQ ID NO: 4374 - DNA, 20 bp, Chlamydia pneumoniae
gcaataggcaagctgtagtt

SEQ ID NO: 4375 - DNA, 20 bp, Chlamydia pneumoniae
agagggggaagggttagaat

SEQ ID NO: 4376 - DNA, 20 bp, Chlamydia pneumoniae
ccgcctcacaatctacaatc

SEQ ID NO: 4377 - DNA, 20 bp, Chlamydia pneumoniae
ggcttgaacggggaaatagt

SEQ ID NO: 4378 - DNA, 20 bp, Chlamydia pneumoniae
gacagaaggcgaacatcact

SEQ ID NO: 4379 - DNA, 20 bp, Chlamydia pneumoniae
ccttctcggaataatcgctc

SEQ ID NO: 4380 - DNA, 20 bp, Chlamydia pneumoniae
ggaaccgcaattcacggatt

SEQ ID NO: 4381 - DNA, 20 bp, Chlamydia pneumoniae
catagcttccctaagctgtc

SEQ ID NO: 4382 - DNA, 20 bp, Chlamydia pneumoniae
tctcctgcttatcaagtggg

SEQ ID NO: 4383 - DNA, 20 bp, Chlamydia pneumoniae
ctccccatacatagggaaag

SEQ ID NO: 4384 - DNA, 20 bp, Chlamydia pneumoniae
catggaccaataacaagtag

SEQ ID NO: 4385 - DNA, 20 bp, Chlamydia pneumoniae
agccccagatggtgttcata

SEQ ID NO: 4386 - DNA, 20 bp, Chlamydia pneumoniae
caggcttggctttgcagttt

SEQ ID NO: 4387 - DNA, 20 bp, Chlamydia pneumoniae
ccagaactcgcttaggaaag

SEQ ID NO: 4388 - DNA, 20 bp, Chlamydia pneumoniae
gggcttccataacagctcat

SEQ ID NO: 4389 - DNA, 20 bp, Chlamydia pneumoniae
ctagggaaggagtcttatcc

SEQ ID NO: 4390 - DNA, 20 bp, Chlamydia pneumoniae
caagggcaggtaattgctac

SEQ ID NO: 4391 - DNA, 20 bp, Chlamydia pneumoniae
ggggacatcatcacgaagtt

SEQ ID NO: 4392 - DNA, 20 bp, Chlamydia pneumoniae
ctggagctaagaaaggccaa

SEQ ID NO: 4393 - DNA, 20 bp, Chlamydia pneumoniae
ggggatacaggagtttttag

SEQ ID NO: 4394 - DNA, 20 bp, Chlamydia pneumoniae
ctagggaaggagtcttatcc

SEQ ID NO: 4395 - DNA, 20 bp, Chlamydia pneumoniae
gtcgacccttatgatcctga

SEQ ID NO: 4396 - DNA, 20 bp, Chlamydia pneumoniae
gtggagtggttataggaacg

SEQ ID NO: 4397 - DNA, 20 bp, Chlamydia pneumoniae
ggttggaagtcatgcatcca

SEQ ID NO: 4398 - DNA, 20 bp, Chlamydia pneumoniae
cgttagggggaagaactgta

SEQ ID NO: 4399 - DNA, 20 bp, Chlamydia pneumoniae
ccatcactcacttcatcagg

SEQ ID NO: 4400 - DNA, 20 bp, Chlamydia pneumoniae
aaaggactcatccatggcaa

SEQ ID NO: 4401 - DNA, 20 bp, Chlamydia pneumoniae
gggagtcaatgtaccttgga

SEQ ID NO: 4402 - DNA, 20 bp, Chlamydia pneumoniae
gggagcttcttttggtagca

SEQ ID NO: 4403 - DNA, 20 bp, Chlamydia pneumoniae
ctgtagggggaaatactgcg

SEQ ID NO: 4404 - DNA, 20 bp, Chlamydia pneumoniae
cagcacttactattggtcag

SEQ ID NO: 4405 - DNA, 20 bp, Chlamydia pneumoniae
cttacggttattcacactca

SEQ ID NO: 4406 - DNA, 20 bp, Chlamydia pneumoniae
cggagataattctgccactc

SEQ ID NO: 4407 - DNA, 20 bp, Chlamydia pneumoniae
ggagggaggataaatgtcac

SEQ ID NO: 4408 - DNA, 20 bp, Chlamydia pneumoniae
gtacactggggacctcaata

SEQ ID NO: 4409 - DNA, 20 bp, Chlamydia pneumoniae
ttgctaccccccctcatgat

SEQ ID NO: 4410 - DNA, 20 bp, Chlamydia pneumoniae
gttgccttgccttacgttga

SEQ ID NO: 4411 - DNA, 20 bp, Chlamydia pneumoniae
gagggtattcaacgataggg

SEQ ID NO: 4412 - DNA, 20 bp, Chlamydia pneumoniae
gggcaacatagtggacttga

SEQ ID NO: 4413 - DNA, 20 bp, Chlamydia pneumoniae
tttgggggtgtcgcatagtg

SEQ ID NO: 4414 - DNA, 20 bp, Chlamydia pneumoniae
atggaacaatgttgtgcggg

SEQ ID NO: 4415 - DNA, 20 bp, Chlamydia pneumoniae
ctttcatccacggaggattt

SEQ ID NO: 4416 - DNA, 20 bp, Chlamydia pneumoniae
ggcgccttcctcaataacaa

SEQ ID NO: 4417 - DNA, 20 bp, Chlamydia pneumoniae
ccttgcttgagagcatggat

SEQ ID NO: 4418 - DNA, 20 bp, Chlamydia pneumoniae
cccccacttctttttcttca

SEQ ID NO: 4419 - DNA, 20 bp, Chlamydia pneumoniae
gcagagactaggcaactcat

SEQ ID NO: 4420 - DNA, 20 bp, Chlamydia pneumoniae
gctttcatccacggaggatt

SEQ ID NO: 4421 - DNA, 20 bp, Chlamydia pneumoniae
ggtcgaacccgcaacttccg

SEQ ID NO: 4422 - DNA, 20 bp, Chlamydia pneumoniae
gcagagactaggcaactcat

SEQ ID NO: 4423 - DNA, 20 bp, Chlamydia pneumoniae
gctgagggatcttctctatg

SEQ ID NO: 4424 - DNA, 20 bp, Chlamydia pneumoniae
tcccgcaaatggacacgaca

SEQ ID NO: 4425 - DNA, 20 bp, Chlamydia pneumoniae
gtgggtatggtaatagctgc

SEQ ID NO: 4426 - DNA, 20 bp, Chlamydia pneumoniae
tgtccctagagagacccctt

SEQ ID NO: 4427 - DNA, 20 bp, Chlamydia pneumoniae
ggtaacagtgcatgcgaaag

SEQ ID NO: 4428 - DNA, 20 bp, Chlamydia pneumoniae
cggtgaaaagaaagccgttg

SEQ ID NO: 4429 - DNA, 20 bp, Chlamydia pneumoniae
tggtataccatcttctcccc

SEQ ID NO: 4430 - DNA, 20 bp, Chlamydia pneumoniae
ctgatgcacaagaactaccc

SEQ ID NO: 4431 - DNA, 20 bp, Chlamydia pneumoniae
accctgccaatcccccaaca

SEQ ID NO: 4432 - DNA, 20 bp, Chlamydia pneumoniae
gattgagaagggcattggtt

SEQ ID NO: 4433 - DNA, 20 bp, Chlamydia pneumoniae
cacagaagctcctaagagac

SEQ ID NO: 4434 - DNA, 20 bp, Chlamydia pneumoniae
cattcggtgtagatgtgcct

SEQ ID NO: 4435 - DNA, 20 bp, Chlamydia pneumoniae
agcaccgcaatcctagattc

SEQ ID NO: 4436 - DNA, 20 bp, Chlamydia pneumoniae
ctttcttctcgggctgagaa

SEQ ID NO: 4437 - DNA, 20 bp, Chlamydia pneumoniae
ttcaagtggcgtagtcaata

SEQ ID NO: 4438 - DNA, 20 bp, Chlamydia pneumoniae
ctttcttctcgggctgagaa

SEQ ID NO: 4439 - DNA, 20 bp, Chlamydia pneumoniae
ttcaagtggcgtagtcaata

SEQ ID NO: 4440 - DNA, 20 bp, Chlamydia pneumoniae
gtcacatgccttttcgaagc

SEQ ID NO: 4441 - DNA, 20 bp, Chlamydia pneumoniae
gctcctagagctatatcgag

SEQ ID NO: 4442 - DNA, 20 bp, Chlamydia pneumoniae
gcggttttgtgcggattcta

SEQ ID NO: 4443 - DNA, 20 bp, Chlamydia pneumoniae
gcaacttgggttatgcacct

SEQ ID NO: 4444 - DNA, 20 bp, Chlamydia pneumoniae
tttgtcttcaagtggcgtag

SEQ ID NO: 4445 - DNA, 20 bp, Chlamydia pneumoniae
gacctacacctttccttcct

SEQ ID NO: 4446 - DNA, 20 bp, Chlamydia pneumoniae
gctcctagagctatatcgag

SEQ ID NO: 4447 - DNA, 20 bp, Chlamydia pneumoniae
caccaaacgtggtgttgtga

SEQ ID NO: 4448 - DNA, 20 bp, Chlamydia pneumoniae
gccgacctttgttctaaggt

SEQ ID NO: 4449 - DNA, 20 bp, Chlamydia pneumoniae
gctctacaagttcaccgatg

SEQ ID NO: 4450 - DNA, 20 bp, Chlamydia pneumoniae
ctgttacggatcacgacagt

SEQ ID NO: 4451 - DNA, 20 bp, Chlamydia pneumoniae
ctcgtcttacccatagtgct

SEQ ID NO: 4452 - DNA, 20 bp, Chlamydia pneumoniae
ggtataaaggtcttggagag

SEQ ID NO: 4453 - DNA, 20 bp, Chlamydia pneumoniae
gtccttcatgctggaggaaa

SEQ ID NO: 4454 - DNA, 20 bp, Chlamydia pneumoniae
gggatgtctcaagctatagg

SEQ ID NO: 4455 - DNA, 20 bp, Chlamydia pneumoniae
ggggcgtcgtgtattaaagt

SEQ ID NO: 4456 - DNA, 20 bp, Chlamydia pneumoniae
acagcccctaaaaagggatt

SEQ ID NO: 4457 - DNA, 20 bp, Chlamydia pneumoniae
tgttcctctcactatcggag

SEQ ID NO: 4458 - DNA, 20 bp, Chlamydia pneumoniae
cagcaaacctttctccaaag

SEQ ID NO: 4459 - DNA, 20 bp, Chlamydia pneumoniae
catgacgcctatccaggaaa

SEQ ID NO: 4460 - DNA, 20 bp, Chlamydia pneumoniae
ctgaaagctatccacagctc

SEQ ID NO: 4461 - DNA, 20 bp, Chlamydia pneumoniae
ccagggatttgtcaaggaac

SEQ ID NO: 4462 - DNA, 20 bp, Chlamydia pneumoniae
gcagaagacagggaagaagt

SEQ ID NO: 4463 - DNA, 20 bp, Chlamydia pneumoniae
ggattgcgtagatagcacca

SEQ ID NO: 4464 - DNA, 20 bp, Chlamydia pneumoniae
cgtcaccaagaagttcgtct

SEQ ID NO: 4465 - DNA, 20 bp, Chlamydia pneumoniae
ggaagaagatttccccaaga

SEQ ID NO: 4466 - DNA, 20 bp, Chlamydia pneumoniae
gaggcttgaaagaagcaagc

SEQ ID NO: 4467 - DNA, 20 bp, Chlamydia pneumoniae
ctcctactttcagggttgtg

SEQ ID NO: 4468 - DNA, 20 bp, Chlamydia pneumoniae
gctctactggaatcagagga

SEQ ID NO: 4469 - DNA, 20 bp, Chlamydia pneumoniae
aaggcgcatttagaagcagg

SEQ ID NO: 4470 - DNA, 20 bp, Chlamydia pneumoniae
gaagctccaggagaagagat

SEQ ID NO: 4471 - DNA, 20 bp, Chlamydia pneumoniae
ccccaccaaagaccttgaaa

SEQ ID NO: 4472 - DNA, 20 bp, Chlamydia pneumoniae
gagtagggaagaagactctc

SEQ ID NO: 4473 - DNA, 20 bp, Chlamydia pneumoniae
ccttctcattgtctcctgtg

SEQ ID NO: 4474 - DNA, 20 bp, Chlamydia pneumoniae
gagaatcccaagtgtcagac

SEQ ID NO: 4475 - DNA, 20 bp, Chlamydia pneumoniae
cctggcttttggtgactcta

SEQ ID NO: 4476 - DNA, 20 bp, Chlamydia pneumoniae
gggagcttctctcacagcta

SEQ ID NO: 4477 - DNA, 20 bp, Chlamydia pneumoniae
gaagccacaatcgatgaagc

SEQ ID NO: 4478 - DNA, 20 bp, Chlamydia pneumoniae
gtgtgtttaggtaagcttgc

SEQ ID NO: 4479 - DNA, 20 bp, Chlamydia pneumoniae
gtgggtaagaacaccttcta

SEQ ID NO: 4480 - DNA, 20 bp, Chlamydia pneumoniae
gcagccttttctaaagggga

SEQ ID NO: 4481 - DNA, 20 bp, Chlamydia pneumoniae
ctctagccaggttgagaaag

SEQ ID NO: 4482 - DNA, 20 bp, Chlamydia pneumoniae
gtaatggtggagccgagagc

SEQ ID NO: 4483 - DNA, 20 bp, Chlamydia pneumoniae
ctccaggcaaacgggtaaat

SEQ ID NO: 4484 - DNA, 20 bp, Chlamydia pneumoniae
ccctataggagctttcttgg

SEQ ID NO: 4485 - DNA, 20 bp, Chlamydia pneumoniae
gcaaccgaggttgaagctat

SEQ ID NO: 4486 - DNA, 20 bp, Chlamydia pneumoniae
gccatagactaaagctgcgt

SEQ ID NO: 4487 - DNA, 20 bp, Chlamydia pneumoniae
gggatgaaagaacgcaaagg

SEQ ID NO: 4488 - DNA, 20 bp, Chlamydia pneumoniae
ctagttcggatacctgttgg

SEQ ID NO: 4489 - DNA, 20 bp, Chlamydia pneumoniae
ctctgtagcaatcgctagca

SEQ ID NO: 4490 - DNA, 20 bp, Chlamydia pneumoniae
gctcctcctacttgaaggat

SEQ ID NO: 4491 - DNA, 20 bp, Chlamydia pneumoniae
ctggggtgtttaagatgagc

SEQ ID NO: 4492 - DNA, 20 bp, Chlamydia pneumoniae
gagagtgccgtaacaaccta

SEQ ID NO: 4493 - DNA, 20 bp, Chlamydia pneumoniae
ccaatcatagcctcagcata

SEQ ID NO: 4494 - DNA, 20 bp, Chlamydia pneumoniae
gcctccacaatggtttaaga

SEQ ID NO: 4495 - DNA, 20 bp, Chlamydia pneumoniae
gtcttggtacttttgctcag

SEQ ID NO: 4496 - DNA, 20 bp, Chlamydia pneumoniae
ggagtggatccaaaagaagt

SEQ ID NO: 4497 - DNA, 20 bp, Chlamydia pneumoniae
gtaggtatgggacaagacct

SEQ ID NO: 4498 - DNA, 20 bp, Chlamydia pneumoniae
cctcgcagttatcgagctat

SEQ ID NO: 4499 - DNA, 20 bp, Chlamydia pneumoniae
ggcaggcattcaggaagagg

SEQ ID NO: 4500 - DNA, 20 bp, Chlamydia pneumoniae
gtgtcacacgtggtaggaaa

SEQ ID NO: 4501 - DNA, 20 bp, Chlamydia pneumoniae
ctgtcccaagagatgagttc

SEQ ID NO: 4502 - DNA, 20 bp, Chlamydia pneumoniae
caggcattcaggaagaggat

SEQ ID NO: 4503 - DNA, 20 bp, Chlamydia pneumoniae
ccaccacatggccttcttta

SEQ ID NO: 4504 - DNA, 20 bp, Chlamydia pneumoniae
ggggcctaaattaaggttag

SEQ ID NO: 4505 - DNA, 20 bp, Chlamydia pneumoniae
cgaccctcgatcaatatcca

SEQ ID NO: 4506 - DNA, 20 bp, Chlamydia pneumoniae
gactacgctcactagcaaca

SEQ ID NO: 4507 - DNA, 20 bp, Chlamydia pneumoniae
gagacccttcacttacctca

SEQ ID NO: 4508 - DNA, 20 bp, Chlamydia pneumoniae
tttcccgtcctaacaccggg

SEQ ID NO: 4509 - DNA, 20 bp, Chlamydia pneumoniae
ctgcagcagagacaaatcct

SEQ ID NO: 4510 - DNA, 20 bp, Chlamydia pneumoniae
ccgataggctttccatgtaa

SEQ ID NO: 4511 - DNA, 20 bp, Chlamydia pneumoniae
ggactcaagcgtagtggaaa

SEQ ID NO: 4512 - DNA, 20 bp, Chlamydia pneumoniae
gcatgttgcattgcctgaga

SEQ ID NO: 4513 - DNA, 20 bp, Chlamydia pneumoniae
ggattcgatagacggtgtca

SEQ ID NO: 4514 - DNA, 20 bp, Chlamydia pneumoniae
gctttaaactctggcggaga

SEQ ID NO: 4515 - DNA, 20 bp, Chlamydia pneumoniae
cctcttcagtcagaacctct

SEQ ID NO: 4516 - DNA, 20 bp, Chlamydia pneumoniae
cccgtaaaggtctaagatcc

SEQ ID NO: 4517 - DNA, 20 bp, Chlamydia pneumoniae
cattaggcaaagtggcctgt

SEQ ID NO: 4518 - DNA, 20 bp, Chlamydia pneumoniae
tgacaatgcggctcctattc

SEQ ID NO: 4519 - DNA, 20 bp, Chlamydia pneumoniae
ccgtcaagaacaagagcttg

SEQ ID NO: 4520 - DNA, 20 bp, Chlamydia pneumoniae
gccccaacgttttttggcta

SEQ ID NO: 4521 - DNA, 20 bp, Chlamydia pneumoniae
gtacatcgcctactgcatga

SEQ ID NO: 4522 - DNA, 20 bp, Chlamydia pneumoniae
caataggggtgcctataacg

SEQ ID NO: 4523 - DNA, 20 bp, Chlamydia pneumoniae
gttggagaaatagtagaccc

SEQ ID NO: 4524 - DNA, 20 bp, Chlamydia pneumoniae
cgctgcccatgaaaatgtga

SEQ ID NO: 4525 - DNA, 20 bp, Chlamydia pneumoniae
tacggctacggtatacgcta

SEQ ID NO: 4526 - DNA, 20 bp, Chlamydia pneumoniae
tgaggcgtagacctgctgcc

SEQ ID NO: 4527 - DNA, 20 bp, Chlamydia pneumoniae
gatgataagcgccggtcttt

SEQ ID NO: 4528 - DNA, 20 bp, Chlamydia pneumoniae
gccttgtgagatactgatgg

SEQ ID NO: 4529 - DNA, 20 bp, Chlamydia pneumoniae
ggggaacatgatggcgattt

SEQ ID NO: 4530 - DNA, 20 bp, Chlamydia pneumoniae
gccatgttgttctcctgagt

SEQ ID NO: 4531 - DNA, 20 bp, Chlamydia pneumoniae
gtccagcagtggatcactaa

SEQ ID NO: 4532 - DNA, 20 bp, Chlamydia pneumoniae
cgtcaggtagccatgtactt

SEQ ID NO: 4533 - DNA, 20 bp, Chlamydia pneumoniae
gttacgggttcttggggaat

SEQ ID NO: 4534 - DNA, 20 bp, Chlamydia pneumoniae
ggggaacatgatggcgattt

SEQ ID NO: 4535 - DNA, 20 bp, Chlamydia pneumoniae
ggggaatcttggagctttgt

SEQ ID NO: 4536 - DNA, 20 bp, Chlamydia pneumoniae
gggaaagttttagcagagga

SEQ ID NO: 4537 - DNA, 20 bp, Chlamydia pneumoniae
caactagagaagctgcgggg

SEQ ID NO: 4538 - DNA, 20 bp, Chlamydia pneumoniae
tggtctttcgagccatggtc

SEQ ID NO: 4539 - DNA, 20 bp, Chlamydia pneumoniae
gcatagacgctaagtgttgt

SEQ ID NO: 4540 - DNA, 20 bp, Chlamydia pneumoniae
gggatgctaatccccaagaa

SEQ ID NO: 4541 - DNA, 20 bp, Chlamydia pneumoniae
gctgctcaagaaccaagtgc

SEQ ID NO: 4542 - DNA, 20 bp, Chlamydia pneumoniae
gctccctatgccagttccta

SEQ ID NO: 4543 - DNA, 20 bp, Chlamydia pneumoniae
cgccaggctgtatttcgtta

SEQ ID NO: 4544 - DNA, 20 bp, Chlamydia pneumoniae
tgcgggggtgttctttgcta

SEQ ID NO: 4545 - DNA, 20 bp, Chlamydia pneumoniae
caatattgcgacgttcaacg

SEQ ID NO: 4546 - DNA, 20 bp, Chlamydia pneumoniae
gggtcttggtttcttagctc

SEQ ID NO: 4547 - DNA, 20 bp, Chlamydia pneumoniae
cagcagggaacatagcttca

SEQ ID NO: 4548 - DNA, 20 bp, Chlamydia pneumoniae
gttcgcgtcatctcttaagg

SEQ ID NO: 4549 - DNA, 20 bp, Chlamydia pneumoniae
cgatcacgaaagtcggtaag

SEQ ID NO: 4550 - DNA, 20 bp, Chlamydia pneumoniae
cagtagcgtagtctgcatca

SEQ ID NO: 4551 - DNA, 20 bp, Chlamydia pneumoniae
cccaagcttctggcaataga

SEQ ID NO: 4552 - DNA, 20 bp, Chlamydia pneumoniae
gatgatgagaacgacgaacg

SEQ ID NO: 4553 - DNA, 20 bp, Chlamydia pneumoniae
cggcagtaaacgaatgtctg

SEQ ID NO: 4554 - DNA, 20 bp, Chlamydia pneumoniae
gcgagtcataattccttcag

SEQ ID NO: 4555 - DNA, 20 bp, Chlamydia pneumoniae
cgaatcctagagaacctcct

SEQ ID NO: 4556 - DNA, 20 bp, Chlamydia pneumoniae
gcgataaaaccagcagagac

SEQ ID NO: 4557 - DNA, 20 bp, Chlamydia pneumoniae
gggctttattcgtgctgaag

SEQ ID NO: 4558 - DNA, 20 bp, Chlamydia pneumoniae
tacggccaatcaacatgacc

SEQ ID NO: 4559 - DNA, 20 bp, Chlamydia pneumoniae
ccgtttttgaccatgaagcc

SEQ ID NO: 4560 - DNA, 20 bp, Chlamydia pneumoniae
cacctaaccagtctatggga

SEQ ID NO: 4561 - DNA, 20 bp, Chlamydia pneumoniae
ggtagggaaaacttcaatcg

SEQ ID NO: 4562 - DNA, 20 bp, Chlamydia pneumoniae
gctgcgtatgacactttagg

SEQ ID NO: 4563 - DNA, 20 bp, Chlamydia pneumoniae
ccgtgtctttaaactcctgc

SEQ ID NO: 4564 - DNA, 20 bp, Chlamydia pneumoniae
gggaaatcggtttctctctc

SEQ ID NO: 4565 - DNA, 20 bp, Chlamydia pneumoniae
agtcaacgataggcggaggc

SEQ ID NO: 4566 - DNA, 20 bp, Chlamydia pneumoniae
gaagcccaaacgttttgttc

SEQ ID NO: 4567 - DNA, 20 bp, Chlamydia pneumoniae
cgtcaaaccgccaacaatgt

SEQ ID NO: 4568 - DNA, 20 bp, Chlamydia pneumoniae
cagctgcaaagcacttggaa

SEQ ID NO: 4569 - DNA, 20 bp, Chlamydia pneumoniae
cctatgagcgacaacgtatc

SEQ ID NO: 4570 - DNA, 20 bp, Chlamydia pneumoniae
ccagcttctccttttttccg

SEQ ID NO: 4571 - DNA, 20 bp, Chlamydia pneumoniae
cgagggaagacttgcaacat

SEQ ID NO: 4572 - DNA, 20 bp, Chlamydia pneumoniae
ggagtttggattccctcagc

SEQ ID NO: 4573 - DNA, 20 bp, Chlamydia pneumoniae
cgtcttggggtataatccct

SEQ ID NO: 4574 - DNA, 20 bp, Chlamydia pneumoniae
ccatttacagagagagcagc

SEQ ID NO: 4575 - DNA, 20 bp, Chlamydia pneumoniae
ggggaagaggttttcttaga

SEQ ID NO: 4576 - DNA, 20 bp, Chlamydia pneumoniae
ggactcgtatcttcaccagt

SEQ ID NO: 4577 - DNA, 20 bp, Chlamydia pneumoniae
ggacttacgggagcaaaaac

SEQ ID NO: 4578 - DNA, 20 bp, Chlamydia pneumoniae
cctgtaagtgggcactttct

SEQ ID NO: 4579 - DNA, 20 bp, Chlamydia pneumoniae
ggtgagtagcaaaatggctg

SEQ ID NO: 4580 - DNA, 20 bp, Chlamydia pneumoniae
gaggttatcaggagcttgag

SEQ ID NO: 4581 - DNA, 20 bp, Chlamydia pneumoniae
ctctgttggatcttgggttc

SEQ ID NO: 4582 - DNA, 20 bp, Chlamydia pneumoniae
cgcatgtcctcattgcattg

SEQ ID NO: 4583 - DNA, 20 bp, Chlamydia pneumoniae
ggagagtgttttccctaagg

SEQ ID NO: 4584 - DNA, 20 bp, Chlamydia pneumoniae
gttgcgtcatgtgcatttag

SEQ ID NO: 4585 - DNA, 20 bp, Chlamydia pneumoniae
gcgttcaggatctacaggaa

SEQ ID NO: 4586 - DNA, 20 bp, Chlamydia pneumoniae
ggaacctgaagccgttgtta

SEQ ID NO: 4587 - DNA, 20 bp, Chlamydia pneumoniae
gctttggctcaggagattca

SEQ ID NO: 4588 - DNA, 20 bp, Chlamydia pneumoniae
agacagtcggatccgagtga

SEQ ID NO: 4589 - DNA, 20 bp, Chlamydia pneumoniae
ctgcgcattttgtcacaacg

SEQ ID NO: 4590 - DNA, 20 bp, Chlamydia pneumoniae
cgtggatgctaggatcttga

SEQ ID NO: 4591 - DNA, 20 bp, Chlamydia pneumoniae
cgttttgactgggactgaga

SEQ ID NO: 4592 - DNA, 20 bp, Chlamydia pneumoniae
gctcggttgattatcgagag

SEQ ID NO: 4593 - DNA, 20 bp, Chlamydia pneumoniae
ctccagtaagaacatagcgg

SEQ ID NO: 4594 - DNA, 20 bp, Chlamydia pneumoniae
gggcatgactttgattcctc

SEQ ID NO: 4595 - DNA, 20 bp, Chlamydia pneumoniae
gggaaggtggtctttctcaa

SEQ ID NO: 4596 - DNA, 20 bp, Chlamydia pneumoniae
gctcatttcgggatacaacg

SEQ ID NO: 4597 - DNA, 20 bp, Chlamydia pneumoniae
cttcgcgatgagggccaacg

SEQ ID NO: 4598 - DNA, 20 bp, Chlamydia pneumoniae
ccttcatcggagcacatctt

SEQ ID NO: 4599 - DNA, 20 bp, Chlamydia pneumoniae
ctagaacgcgagcaataggt

SEQ ID NO: 4600 - DNA, 20 bp, Chlamydia pneumoniae
cgaaggtgatggtatctgtg

SEQ ID NO: 4601 - DNA, 20 bp, Chlamydia pneumoniae
gggaacgtgctcgattatcg

SEQ ID NO: 4602 - DNA, 20 bp, Chlamydia pneumoniae
agactgtgtttctgcccttc

SEQ ID NO: 4603 - DNA, 20 bp, Chlamydia pneumoniae
cctcgtccttggattgatgt

SEQ ID NO: 4604 - DNA, 20 bp, Chlamydia pneumoniae
ccccaattccagatggaagg

SEQ ID NO: 4605 - DNA, 20 bp, Chlamydia pneumoniae
tccctaccttcgtaatgagc

SEQ ID NO: 4606 - DNA, 20 bp, Chlamydia pneumoniae
ggtaagaagctgtcgtccta

SEQ ID NO: 4607 - DNA, 20 bp, Chlamydia pneumoniae
gctgtcttggctttcagcat

SEQ ID NO: 4608 - DNA, 20 bp, Chlamydia pneumoniae
ctgtgggtattgtgcaggtt

SEQ ID NO: 4609 - DNA, 20 bp, Chlamydia pneumoniae
ctcctagggatggtatggat

SEQ ID NO: 4610 - DNA, 20 bp, Chlamydia pneumoniae
gagcgatttcctagtatccg

SEQ ID NO: 4611 - DNA, 20 bp, Chlamydia pneumoniae
gctatttcctgttcaggtgc

SEQ ID NO: 4612 - DNA, 20 bp, Chlamydia pneumoniae
gatgatgtacatcgtggtta

SEQ ID NO: 4613 - DNA, 20 bp, Chlamydia pneumoniae
ggctgcgatcgtcttttgtg

SEQ ID NO: 4614 - DNA, 20 bp, Chlamydia pneumoniae
cagattttagaatggcgggg

SEQ ID NO: 4615 - DNA, 20 bp, Chlamydia pneumoniae
gggtggctcttgaatgtcaa

SEQ ID NO: 4616 - DNA, 20 bp, Chlamydia pneumoniae
acaaaccctgaagctctctc

SEQ ID NO: 4617 - DNA, 20 bp, Chlamydia pneumoniae
cctctcaggatctttttgtt

SEQ ID NO: 4618 - DNA, 20 bp, Chlamydia pneumoniae
ggatgagttgttttcagcga

SEQ ID NO: 4619 - DNA, 20 bp, Chlamydia pneumoniae
gccatgaaacccacctttta

SEQ ID NO: 4620 - DNA, 20 bp, Chlamydia pneumoniae
ggtctatctccagaagctca

SEQ ID NO: 4621 - DNA, 20 bp, Chlamydia pneumoniae
gagcgcaattttccaaaagg

SEQ ID NO: 4622 - DNA, 20 bp, Chlamydia pneumoniae
cctctcaggatctttttgtt

SEQ ID NO: 4623 - DNA, 20 bp, Chlamydia pneumoniae
gaagttccccatgaactcac

SEQ ID NO: 4624 - DNA, 20 bp, Chlamydia pneumoniae
gccacaagaaagagcgcaat

SEQ ID NO: 4625 - DNA, 20 bp, Chlamydia pneumoniae
cagtgctacgactagcgtta

SEQ ID NO: 4626 - DNA, 20 bp, Chlamydia pneumoniae
gagtcgggcaattgtcctaa

SEQ ID NO: 4627 - DNA, 20 bp, Chlamydia pneumoniae
gatccaacttcagagtgcaa

SEQ ID NO: 4628 - DNA, 20 bp, Chlamydia pneumoniae
ctaggctcatcaatttgcgt

SEQ ID NO: 4629 - DNA, 20 bp, Chlamydia pneumoniae
tgcttgggattggctgtgtt

SEQ ID NO: 4630 - DNA, 20 bp, Chlamydia pneumoniae
cttgggggaatacttgttct

SEQ ID NO: 4631 - DNA, 20 bp, Chlamydia pneumoniae
gggatacagtacagctaagg

SEQ ID NO: 4632 - DNA, 20 bp, Chlamydia pneumoniae
gctacgagagggagtagaat

SEQ ID NO: 4633 - DNA, 20 bp, Chlamydia pneumoniae
gctctcttgaaagcaagtgc

SEQ ID NO: 4634 - DNA, 20 bp, Chlamydia pneumoniae
cagtacctaggttccttaga

SEQ ID NO: 4635 - DNA, 20 bp, Chlamydia pneumoniae
cccgtgatcaatatgcgcta

SEQ ID NO: 4636 - DNA, 20 bp, Chlamydia pneumoniae
ccctctctttttgaacgtcg

SEQ ID NO: 4637 - DNA, 20 bp, Chlamydia pneumoniae
gtgcttttggaggaggaaca

SEQ ID NO: 4638 - DNA, 20 bp, Chlamydia pneumoniae
tcgactcgatccaagagtat

SEQ ID NO: 4639 - DNA, 20 bp, Chlamydia pneumoniae
tacggtaatccccaagacgg

SEQ ID NO: 4640 - DNA, 20 bp, Chlamydia pneumoniae
cgttagctcaaggactgcga

SEQ ID NO: 4641 - DNA, 20 bp, Chlamydia pneumoniae
cagagtcgggaactgtatgg

SEQ ID NO: 4642 - DNA, 20 bp, Chlamydia pneumoniae
ttcaagcagggaaacctgtg

SEQ ID NO: 4643 - DNA, 20 bp, Chlamydia pneumoniae
cgcagactctctgcatttcg

SEQ ID NO: 4644 - DNA, 20 bp, Chlamydia pneumoniae
gggaaacgttggttagacct

SEQ ID NO: 4645 - DNA, 20 bp, Chlamydia pneumoniae
gagctatggattctcttcgc

SEQ ID NO: 4646 - DNA, 20 bp, Chlamydia pneumoniae
aggtaggaaggggtgccttg

SEQ ID NO: 4647 - DNA, 20 bp, Chlamydia pneumoniae
gagcctgcatcagaagattc

SEQ ID NO: 4648 - DNA, 20 bp, Chlamydia pneumoniae
cttgaagagagaatccccga

SEQ ID NO: 4649 - DNA, 20 bp, Chlamydia pneumoniae
cttccagcaaaacagatggc

SEQ ID NO: 4650 - DNA, 20 bp, Chlamydia pneumoniae
gttacgagctgtgaaacacg

SEQ ID NO: 4651 - DNA, 20 bp, Chlamydia pneumoniae
ggccatggagttttccttct

SEQ ID NO: 4652 - DNA, 20 bp, Chlamydia pneumoniae
gctgcgctatactccgtaaa

SEQ ID NO: 4653 - DNA, 20 bp, Chlamydia pneumoniae
atcttggaggctttaggagc

SEQ ID NO: 4654 - DNA, 20 bp, Chlamydia pneumoniae
ggaattcacctgagttcctt

SEQ ID NO: 4655 - DNA, 20 bp, Chlamydia pneumoniae
gtcggtgtttgctgatgaga

SEQ ID NO: 4656 - DNA, 20 bp, Chlamydia pneumoniae
cgtattgatcgcagtctgga

SEQ ID NO: 4657 - DNA, 20 bp, Chlamydia pneumoniae
aagcacgggtgattctgaga

SEQ ID NO: 4658 - DNA, 20 bp, Chlamydia pneumoniae
gtacctaagaattcgtgcgt

SEQ ID NO: 4659 - DNA, 20 bp, Chlamydia pneumoniae
catgttcgaattcgctgcgt

SEQ ID NO: 4660 - DNA, 20 bp, Chlamydia pneumoniae
gggtagggagaacgatgttt

SEQ ID NO: 4661 - DNA, 20 bp, Chlamydia pneumoniae
gaccgcagcaattgctaatg

SEQ ID NO: 4662 - DNA, 20 bp, Chlamydia pneumoniae
ggtttacgggttctagttcc

SEQ ID NO: 4663 - DNA, 20 bp, Chlamydia pneumoniae
agcagcggttccagaactta

SEQ ID NO: 4664 - DNA, 20 bp, Chlamydia pneumoniae
gggtaggggattagaatctg

SEQ ID NO: 4665 - DNA, 20 bp, Chlamydia pneumoniae
gatcaggtatacggtcccaa

SEQ ID NO: 4666 - DNA, 20 bp, Chlamydia pneumoniae
gggttctgtggtggacataa

SEQ ID NO: 4667 - DNA, 20 bp, Chlamydia pneumoniae
ctgtgactactggagaagac

SEQ ID NO: 4668 - DNA, 20 bp, Chlamydia pneumoniae
cacgggcatcgtcttttagt

SEQ ID NO: 4669 - DNA, 20 bp, Chlamydia pneumoniae
gcagttaccatgatcttcgg

SEQ ID NO: 4670 - DNA, 20 bp, Chlamydia pneumoniae
ggagatgcacttgatgttcc

SEQ ID NO: 4671 - DNA, 20 bp, Chlamydia pneumoniae
gcttgatgaacagcagggct

SEQ ID NO: 4672 - DNA, 20 bp, Chlamydia pneumoniae
ggccgagtgtttcaggccat

SEQ ID NO: 4673 - DNA, 20 bp, Chlamydia pneumoniae
tcttccatgggtatgtgagc

SEQ ID NO: 4674 - DNA, 20 bp, Chlamydia pneumoniae
gtgggggatgtaggtgtaac

SEQ ID NO: 4675 - DNA, 20 bp, Chlamydia pneumoniae
ctgcctcattactcgacttg

SEQ ID NO: 4676 - DNA, 20 bp, Chlamydia pneumoniae
caatctcagcgagtttggct

SEQ ID NO: 4677 - DNA, 20 bp, Chlamydia pneumoniae
tcgtgatcagatggaccaag

SEQ ID NO: 4678 - DNA, 20 bp, Chlamydia pneumoniae
cctctcctaagagatcttgc

SEQ ID NO: 4679 - DNA, 20 bp, Chlamydia pneumoniae
ctcaagatcggcgtaaggac

SEQ ID NO: 4680 - DNA, 20 bp, Chlamydia pneumoniae
ggggattttggggatgcata

SEQ ID NO: 4681 - DNA, 20 bp, Chlamydia pneumoniae
atcgaagggtacaacctgag

SEQ ID NO: 4682 - DNA, 20 bp, Chlamydia pneumoniae
gcatgacctcgattcgtaag

SEQ ID NO: 4683 - DNA, 20 bp, Chlamydia pneumoniae
ctctgcaagttcgtgagaga

SEQ ID NO: 4684 - DNA, 20 bp, Chlamydia pneumoniae
gcttgcgtatagagagcttg

SEQ ID NO: 4685 - DNA, 20 bp, Chlamydia pneumoniae
gagaccttggtccccatgtt

SEQ ID NO: 4686 - DNA, 20 bp, Chlamydia pneumoniae
gatttcttcttggtgcctgc

SEQ ID NO: 4687 - DNA, 20 bp, Chlamydia pneumoniae
gtgcaggctttatcataggc

SEQ ID NO: 4688 - DNA, 20 bp, Chlamydia pneumoniae
gcgcttaagatcaagaggag

SEQ ID NO: 4689 - DNA, 20 bp, Chlamydia pneumoniae
gccgaaagatcacagttacc

SEQ ID NO: 4690 - DNA, 20 bp, Chlamydia pneumoniae
gtgctttcgtcttgttcgta

SEQ ID NO: 4691 - DNA, 20 bp, Chlamydia pneumoniae
ccggtatcattgtcaggagt

SEQ ID NO: 4692 - DNA, 20 bp, Chlamydia pneumoniae
ggacttaggttctgtgaagc

SEQ ID NO: 4693 - DNA, 20 bp, Chlamydia pneumoniae
cctgtgctttagcatgccac

SEQ ID NO: 4694 - DNA, 20 bp, Chlamydia pneumoniae
ggacttaggttctgtgaagc

SEQ ID NO: 4695 - DNA, 20 bp, Chlamydia pneumoniae
cgtgtctgttcttcaacagc

SEQ ID NO: 4696 - DNA, 20 bp, Chlamydia pneumoniae
cctatagtagctgtggaaac

SEQ ID NO: 4697 - DNA, 20 bp, Chlamydia pneumoniae
ttcggtagcttgggcacatc

SEQ ID NO: 4698 - DNA, 20 bp, Chlamydia pneumoniae
gtgaagatcccttggggatt

SEQ ID NO: 4699 - DNA, 20 bp, Chlamydia pneumoniae
ggagaagaggttgcaggttt

SEQ ID NO: 4700 - DNA, 20 bp, Chlamydia pneumoniae
gcatggctctaaaagccgtg

SEQ ID NO: 4701 - DNA, 20 bp, Chlamydia pneumoniae
cggggagattgaactccttt

SEQ ID NO: 4702 - DNA, 20 bp, Chlamydia pneumoniae
caggggctattacagcagca

SEQ ID NO: 4703 - DNA, 20 bp, Chlamydia pneumoniae
gacttctcgtttttgtcctg

SEQ ID NO: 4704 - DNA, 20 bp, Chlamydia pneumoniae
gtagcttgggcacatcttga

SEQ ID NO: 4705 - DNA, 20 bp, Chlamydia pneumoniae
gacttctcgtttttgtcctg

SEQ ID NO: 4706 - DNA, 20 bp, Chlamydia pneumoniae
ccaagggttcttgtgtggat

SEQ ID NO: 4707 - DNA, 20 bp, Chlamydia pneumoniae
gccagaaatacaagggagtt

SEQ ID NO: 4708 - DNA, 20 bp, Chlamydia pneumoniae
gcaaagatggtttcaccgca

SEQ ID NO: 4709 - DNA, 20 bp, Chlamydia pneumoniae
aggtcgtcccttgcaagccc

SEQ ID NO: 4710 - DNA, 20 bp, Chlamydia pneumoniae
gacttctcgtttttgtcctg

SEQ ID NO: 4711 - DNA, 20 bp, Chlamydia pneumoniae
gagacagtgtggggaaatag

SEQ ID NO: 4712 - DNA, 20 bp, Chlamydia pneumoniae
cctcaaggcggtggtggaat

SEQ ID NO: 4713 - DNA, 20 bp, Chlamydia pneumoniae
cctctccgttagcctcatta

SEQ ID NO: 4714 - DNA, 20 bp, Chlamydia pneumoniae
ggggtaaagagggacttcta

SEQ ID NO: 4715 - DNA, 20 bp, Chlamydia pneumoniae
gaagttctacaaggatgtgg

SEQ ID NO: 4716 - DNA, 20 bp, Chlamydia pneumoniae
gaccaagcagttctatggtg

SEQ ID NO: 4717 - DNA, 20 bp, Chlamydia pneumoniae
ctaccaacttctcagtggaa

SEQ ID NO: 4718 - DNA, 20 bp, Chlamydia pneumoniae
gggtcagagattttgctcag

SEQ ID NO: 4719 - DNA, 20 bp, Chlamydia pneumoniae
tacggtgatgccttgttgct

SEQ ID NO: 4720 - DNA, 20 bp, Chlamydia pneumoniae
ctagatcaccacaggaagtt

SEQ ID NO: 4721 - DNA, 20 bp, Chlamydia pneumoniae
gactacgccgaaatccttac

SEQ ID NO: 4722 - DNA, 20 bp, Chlamydia pneumoniae
cttgccagtgttgcagatgt

SEQ ID NO: 4723 - DNA, 20 bp, Chlamydia pneumoniae
gatctgcacaagtcgcactt

SEQ ID NO: 4724 - DNA, 20 bp, Chlamydia pneumoniae
cacgaagctgcatctccaaa

SEQ ID NO: 4725 - DNA, 20 bp, Chlamydia pneumoniae
tgaggacaacagcaacactc

SEQ ID NO: 4726 - DNA, 20 bp, Chlamydia pneumoniae
acccgacttgtagagcgata

SEQ ID NO: 4727 - DNA, 20 bp, Chlamydia pneumoniae
tcacctcaggtagcgaacac

SEQ ID NO: 4728 - DNA, 20 bp, Chlamydia pneumoniae
aggtgctaccgcacccttta

SEQ ID NO: 4729 - DNA, 20 bp, Chlamydia pneumoniae
cctagctctagggcgattat

SEQ ID NO: 4730 - DNA, 20 bp, Chlamydia pneumoniae
cctgacattcggaatcttcc

SEQ ID NO: 4731 - DNA, 20 bp, Chlamydia pneumoniae
cgcggaaaagacggctatgc

SEQ ID NO: 4732 - DNA, 20 bp, Chlamydia pneumoniae
cgcaaccactaagagctaac

SEQ ID NO: 4733 - DNA, 20 bp, Chlamydia pneumoniae
gggagaaagaatgtgccgat

SEQ ID NO: 4734 - DNA, 20 bp, Chlamydia pneumoniae
ggcaaggctaattcctgtca

SEQ ID NO: 4735 - DNA, 20 bp, Chlamydia pneumoniae
ccctgatgatgccatttcct

SEQ ID NO: 4736 - DNA, 20 bp, Chlamydia pneumoniae
gctaagcaccgagagaaaaa

SEQ ID NO: 4737 - DNA, 20 bp, Chlamydia pneumoniae
cgtgtcatgtgtgccatttg

SEQ ID NO: 4738 - DNA, 20 bp, Chlamydia pneumoniae
gccctttggaattcttaggt

SEQ ID NO: 4739 - DNA, 20 bp, Chlamydia pneumoniae
ctagagagcgttcccctgtg

SEQ ID NO: 4740 - DNA, 20 bp, Chlamydia pneumoniae
aacacggtcgccaggttgta

SEQ ID NO: 4741 - DNA, 20 bp, Chlamydia pneumoniae
cagtaacaagtcctggagca

SEQ ID NO: 4742 - DNA, 20 bp, Chlamydia pneumoniae
aggtcgcaccccggaagggt

SEQ ID NO: 4743 - DNA, 20 bp, Chlamydia pneumoniae
gagatcctgcctccaatgta

SEQ ID NO: 4744 - DNA, 20 bp, Chlamydia pneumoniae
gtgagcttggcattgatacc

SEQ ID NO: 4745 - DNA, 20 bp, Chlamydia pneumoniae
ggtctcaccagtaattgctg

SEQ ID NO: 4746 - DNA, 20 bp, Chlamydia pneumoniae
gcatcgttggcacagatcat

SEQ ID NO: 4747 - DNA, 20 bp, Chlamydia pneumoniae
ggcaaagccttagatcgtgt

SEQ ID NO: 4748 - DNA, 20 bp, Chlamydia pneumoniae
ccatatccttggtcatcacc

SEQ ID NO: 4749 - DNA, 20 bp, Chlamydia pneumoniae
tagagagctcccctagatga

SEQ ID NO: 4750 - DNA, 20 bp, Chlamydia pneumoniae
ggcaaagccttagatcgtgt

SEQ ID NO: 4751 - DNA, 20 bp, Chlamydia pneumoniae
gatcaacccaatagcatgag

SEQ ID NO: 4752 - DNA, 20 bp, Chlamydia pneumoniae
cccgatttgtatccaactac

SEQ ID NO: 4753 - DNA, 20 bp, Chlamydia pneumoniae
gcctgaattgggggtctttt

SEQ ID NO: 4754 - DNA, 20 bp, Chlamydia pneumoniae
tttctccctcactgcggatt

SEQ ID NO: 4755 - DNA, 20 bp, Chlamydia pneumoniae
gtacttccccaaacatggac

SEQ ID NO: 4756 - DNA, 20 bp, Chlamydia pneumoniae
cctcgtaggcttcaggaaat

SEQ ID NO: 4757 - DNA, 20 bp, Chlamydia pneumoniae
cctacggacatggcaataac

SEQ ID NO: 4758 - DNA, 20 bp, Chlamydia pneumoniae
ccgctgttgtatcctaaggt

SEQ ID NO: 4759 - DNA, 20 bp, Chlamydia pneumoniae
cggctatcaggaagataagc

SEQ ID NO: 4760 - DNA, 20 bp, Chlamydia pneumoniae
ccccacaaaacctggattga

SEQ ID NO: 4761 - DNA, 20 bp, Chlamydia pneumoniae
cgtcaggactactttaaggc

SEQ ID NO: 4762 - DNA, 20 bp, Chlamydia pneumoniae
cctacggacatggcaataac

SEQ ID NO: 4763 - DNA, 20 bp, Chlamydia pneumoniae
ggctgttctctactcgcaat

SEQ ID NO: 4764 - DNA, 20 bp, Chlamydia pneumoniae
cgaagcagcttccatgttga

SEQ ID NO: 4765 - DNA, 20 bp, Chlamydia pneumoniae
ggcagtctgtactcaagatt

SEQ ID NO: 4766 - DNA, 20 bp, Chlamydia pneumoniae
gtcccggaaacgacattatg

SEQ ID NO: 4767 - DNA, 20 bp, Chlamydia pneumoniae
tcgccgagggagttcataat

SEQ ID NO: 4768 - DNA, 20 bp, Chlamydia pneumoniae
gcgcttgatagaaactccga

SEQ ID NO: 4769 - DNA, 20 bp, Chlamydia pneumoniae
gcttgtgtcaacctcctcca

SEQ ID NO: 4770 - DNA, 20 bp, Chlamydia pneumoniae
cttggttaaaggtgacaggc

SEQ ID NO: 4771 - DNA, 20 bp, Chlamydia pneumoniae
caccggtcatcacttatggt

SEQ ID NO: 4772 - DNA, 20 bp, Chlamydia pneumoniae
tgcacgctagcaatttaggg

SEQ ID NO: 4773 - DNA, 20 bp, Chlamydia pneumoniae
cttcagggcttttaggaacc

SEQ ID NO: 4774 - DNA, 20 bp, Chlamydia pneumoniae
gagatcgcagtaaacggaag

SEQ ID NO: 4775 - DNA, 20 bp, Chlamydia pneumoniae
cgccgtcatattgcttcttt

SEQ ID NO: 4776 - DNA, 20 bp, Chlamydia pneumoniae
ggaggcttctgttcgtagaa

SEQ ID NO: 4777 - DNA, 20 bp, Chlamydia pneumoniae
tattgaggggcagacctacg

SEQ ID NO: 4778 - DNA, 20 bp, Chlamydia pneumoniae
gctgtctatgcttttgtgga

SEQ ID NO: 4779 - DNA, 20 bp, Chlamydia pneumoniae
gcgcctgactattttcacca

SEQ ID NO: 4780 - DNA, 20 bp, Chlamydia pneumoniae
gtgaatggagaggatagaca

SEQ ID NO: 4781 - DNA, 20 bp, Chlamydia pneumoniae
ccggagttcttcaatcacga

SEQ ID NO: 4782 - DNA, 20 bp, Chlamydia pneumoniae
cgaggccttaaaaaaccgtc

SEQ ID NO: 4783 - DNA, 20 bp, Chlamydia pneumoniae
gtagtgacctacggcatgaa

SEQ ID NO: 4784 - DNA, 20 bp, Chlamydia pneumoniae
cagcaagcgcctgactattt

SEQ ID NO: 4785 - DNA, 20 bp, Chlamydia pneumoniae
gacgcttaagagtttcgtca

SEQ ID NO: 4786 - DNA, 20 bp, Chlamydia pneumoniae
tacacccttcctccgcaggt

SEQ ID NO: 4787 - DNA, 20 bp, Chlamydia pneumoniae
ccactcctttaggaccgata

SEQ ID NO: 4788 - DNA, 20 bp, Chlamydia pneumoniae
gaggaccattgaggaagaga

SEQ ID NO: 4789 - DNA, 20 bp, Chlamydia pneumoniae
gcgtctctgtccaaagagaa

SEQ ID NO: 4790 - DNA, 20 bp, Chlamydia pneumoniae
ccccgagttgtattgcctat

SEQ ID NO: 4791 - DNA, 20 bp, Chlamydia pneumoniae
gcggacggtatgttttgaag

SEQ ID NO: 4792 - DNA, 20 bp, Chlamydia pneumoniae
ggcttggaaggggtttcaat

SEQ ID NO: 4793 - DNA, 20 bp, Chlamydia pneumoniae
cgtcggctcctgacatattt

SEQ ID NO: 4794 - DNA, 20 bp, Chlamydia pneumoniae
gcaggcacccactctttttt

SEQ ID NO: 4795 - DNA, 20 bp, Chlamydia pneumoniae
ggaatatcagagtaggcgag

SEQ ID NO: 4796 - DNA, 20 bp, Chlamydia pneumoniae
ggtgatgataagacccacaa

SEQ ID NO: 4797 - DNA, 20 bp, Chlamydia pneumoniae
ctagtccggtagcccctcat

SEQ ID NO: 4798 - DNA, 20 bp, Chlamydia pneumoniae
ccgcaatcaccacgatgaaa

SEQ ID NO: 4799 - DNA, 20 bp, Chlamydia pneumoniae
gccccaagagtttgatagga

SEQ ID NO: 4800 - DNA, 20 bp, Chlamydia pneumoniae
gctttcgccgtgactttgtt

SEQ ID NO: 4801 - DNA, 20 bp, Chlamydia pneumoniae
gatccttcctatagcgacca

SEQ ID NO: 4802 - DNA, 20 bp, Chlamydia pneumoniae
ggtatctcgtgtgaagaagc

SEQ ID NO: 4803 - DNA, 20 bp, Chlamydia pneumoniae
caagaaagctcgtgacgact

SEQ ID NO: 4804 - DNA, 20 bp, Chlamydia pneumoniae
gtcctgtatcaggagaggtt

SEQ ID NO: 4805 - DNA, 20 bp, Chlamydia pneumoniae
cttcagctccccagctttta

SEQ ID NO: 4806 - DNA, 20 bp, Chlamydia pneumoniae
agctgccccaagagtttgat

SEQ ID NO: 4807 - DNA, 20 bp, Chlamydia pneumoniae
gggatcctgcctggtttttt

SEQ ID NO: 4808 - DNA, 20 bp, Chlamydia pneumoniae
aaatgttggagtaccgcagc

SEQ ID NO: 4809 - DNA, 20 bp, Chlamydia pneumoniae
cctgcatgacaggaggccga

SEQ ID NO: 4810 - DNA, 20 bp, Chlamydia pneumoniae
ttctaacgacaagggtggga

SEQ ID NO: 4811 - DNA, 20 bp, Chlamydia pneumoniae
gatgaagtgctgcaggaggc

SEQ ID NO: 4812 - DNA, 20 bp, Chlamydia pneumoniae
cgcagttgcacaagaagtgt

SEQ ID NO: 4813 - DNA, 20 bp, Chlamydia pneumoniae
aatcttcagcggcctcccac

SEQ ID NO: 4814 - DNA, 20 bp, Chlamydia pneumoniae
ggtttgcagctcagagaaga

SEQ ID NO: 4815 - DNA, 20 bp, Chlamydia pneumoniae
ctgaagagcgacactatctg

SEQ ID NO: 4816 - DNA, 20 bp, Chlamydia pneumoniae
gtcggttgcgttttcgcttg

SEQ ID NO: 4817 - DNA, 20 bp, Chlamydia pneumoniae
tcgcgctaacgcaggtttta

SEQ ID NO: 4818 - DNA, 20 bp, Chlamydia pneumoniae
gcaaggtgcaacagggattt

SEQ ID NO: 4819 - DNA, 20 bp, Chlamydia pneumoniae
ggaggaaacgtccatgaaca

SEQ ID NO: 4820 - DNA, 20 bp, Chlamydia pneumoniae
gcctcctttttcgccagttt

SEQ ID NO: 4821 - DNA, 20 bp, Chlamydia pneumoniae
gggtgtgccttttctatctc

SEQ ID NO: 4822 - DNA, 20 bp, Chlamydia pneumoniae
ccagctctacctacgggaat

SEQ ID NO: 4823 - DNA, 20 bp, Chlamydia pneumoniae
ctctggaagatgcacgcttt

SEQ ID NO: 4824 - DNA, 20 bp, Chlamydia pneumoniae
ggaatggagtgggtgagaaa

SEQ ID NO: 4825 - DNA, 20 bp, Chlamydia pneumoniae
gttacagacagatgtcgagc

SEQ ID NO: 4826 - DNA, 20 bp, Chlamydia pneumoniae
ccccctaaggttaacagtag

SEQ ID NO: 4827 - DNA, 20 bp, Chlamydia pneumoniae
tagaagcgcaagggatcagg

SEQ ID NO: 4828 - DNA, 20 bp, Chlamydia pneumoniae
ggacgtggaggaggattttt

SEQ ID NO: 4829 - DNA, 20 bp, Chlamydia pneumoniae
cctgtgtcatagacatagcg

SEQ ID NO: 4830 - DNA, 20 bp, Chlamydia pneumoniae
gacagatgtcgagcggtaat

SEQ ID NO: 4831 - DNA, 20 bp, Chlamydia pneumoniae
gctcaggatttcgtgacgaa

SEQ ID NO: 4832 - DNA, 20 bp, Chlamydia pneumoniae
gccattcaggtatagctgag

SEQ ID NO: 4833 - DNA, 20 bp, Chlamydia pneumoniae
ggagagagtaaggaagatgg

SEQ ID NO: 4834 - DNA, 20 bp, Chlamydia pneumoniae
gggtttatagggggttggct

SEQ ID NO: 4835 - DNA, 20 bp, Chlamydia pneumoniae
gagtgacgagaatcctgaga

SEQ ID NO: 4836 - DNA, 20 bp, Chlamydia pneumoniae
gtcggcggatggagtcacta

SEQ ID NO: 4837 - DNA, 20 bp, Chlamydia pneumoniae
ccaccattcgcagttgttgt

SEQ ID NO: 4838 - DNA, 20 bp, Chlamydia pneumoniae
ccgcatctgagggttttgtt

SEQ ID NO: 4839 - DNA, 20 bp, Chlamydia pneumoniae
tttgtgctgaaggtcacggt

SEQ ID NO: 4840 - DNA, 20 bp, Chlamydia pneumoniae
gcatggtgcaccaatagaga

SEQ ID NO: 4841 - DNA, 20 bp, Chlamydia pneumoniae
ctcccgaagtttcagcagta

SEQ ID NO: 4842 - DNA, 20 bp, Chlamydia pneumoniae
cggtaagcatctacagcgta

SEQ ID NO: 4843 - DNA, 20 bp, Chlamydia pneumoniae
ccccccatccattaagatgc

SEQ ID NO: 4844 - DNA, 20 bp, Chlamydia pneumoniae
ccaagagacagaggacttca

SEQ ID NO: 4845 - DNA, 20 bp, Chlamydia pneumoniae
cccactggacttggtttcta

SEQ ID NO: 4846 - DNA, 20 bp, Chlamydia pneumoniae
cgataaaggaatgatctggg

SEQ ID NO: 4847 - DNA, 20 bp, Chlamydia pneumoniae
gcttcatctgcagagagctt

SEQ ID NO: 4848 - DNA, 20 bp, Chlamydia pneumoniae
gcctttcccagcatcgttta

SEQ ID NO: 4849 - DNA, 20 bp, Chlamydia pneumoniae
ccgaagagctggcagaaagc

SEQ ID NO: 4850 - DNA, 20 bp, Chlamydia pneumoniae
cagcagcaaacgcagagaaa

SEQ ID NO: 4851 - DNA, 20 bp, Chlamydia pneumoniae
gcacttatgtggcgaaaacc

SEQ ID NO: 4852 - DNA, 20 bp, Chlamydia pneumoniae
cggcgaaggtcagactttta

SEQ ID NO: 4853 - DNA, 20 bp, Chlamydia pneumoniae
cagcttccccagagagttct

SEQ ID NO: 4854 - DNA, 20 bp, Chlamydia pneumoniae
taagacgggcggagttcgtg

SEQ ID NO: 4855 - DNA, 20 bp, Chlamydia pneumoniae
cctcttgggaaacttatgcc

SEQ ID NO: 4856 - DNA, 20 bp, Chlamydia pneumoniae
cctttcttgttacaaacacg

SEQ ID NO: 4857 - DNA, 20 bp, Chlamydia pneumoniae
ctaatacggctgcggattct

SEQ ID NO: 4858 - DNA, 20 bp, Chlamydia pneumoniae
gggctatttgtgctactggt

SEQ ID NO: 4859 - DNA, 20 bp, Chlamydia pneumoniae
gttccttctgaagtgatggg

SEQ ID NO: 4860 - DNA, 20 bp, Chlamydia pneumoniae
gggctatttgtgctactggt

SEQ ID NO: 4861 - DNA, 20 bp, Chlamydia pneumoniae
gttccttctgaagtgatggg

SEQ ID NO: 4862 - DNA, 20 bp, Chlamydia pneumoniae
cacaggcacctatactccta

SEQ ID NO: 4863 - DNA, 20 bp, Chlamydia pneumoniae
gctggtcatggctgaacata

SEQ ID NO: 4864 - DNA, 20 bp, Chlamydia pneumoniae
gtgactgtaggtgacatgag

SEQ ID NO: 4865 - DNA, 20 bp, Chlamydia pneumoniae
cggaagcctttgcgattttc

SEQ ID NO: 4866 - DNA, 20 bp, Chlamydia pneumoniae
gtatggtcatggtttcctcg

SEQ ID NO: 4867 - DNA, 20 bp, Chlamydia pneumoniae
gcacgtagagatgaaaccag

SEQ ID NO: 4868 - DNA, 20 bp, Chlamydia pneumoniae
ggcattttcccatttcttac

SEQ ID NO: 4869 - DNA, 20 bp, Chlamydia pneumoniae
cgtggttgtcacagcaatct

SEQ ID NO: 4870 - DNA, 20 bp, Chlamydia pneumoniae
ctccattggtactctgcaca

SEQ ID NO: 4871 - DNA, 20 bp, Chlamydia pneumoniae
gcctcctgacgaagtaaagt

SEQ ID NO: 4872 - DNA, 20 bp, Chlamydia pneumoniae
tcctagagtggcaaacttgg

SEQ ID NO: 4873 - DNA, 20 bp, Chlamydia pneumoniae
ggaaaggcccttccctaata

SEQ ID NO: 4874 - DNA, 20 bp, Chlamydia pneumoniae
cccttccctaataaggagag

SEQ ID NO: 4875 - DNA, 20 bp, Chlamydia pneumoniae
tcgcggttatggacaacccg

SEQ ID NO: 4876 - DNA, 20 bp, Chlamydia pneumoniae
atagctccacccttctccgc

SEQ ID NO: 4877 - DNA, 20 bp, Chlamydia pneumoniae
cggggctacagaaaactcta

SEQ ID NO: 4878 - DNA, 20 bp, Chlamydia pneumoniae
tcgcacccgcatcatttggt

SEQ ID NO: 4879 - DNA, 20 bp, Chlamydia pneumoniae
gcggcgtagatttgctcctg

SEQ ID NO: 4880 - DNA, 20 bp, Chlamydia pneumoniae
ttgtcaggtctgaggtaggt

SEQ ID NO: 4881 - DNA, 20 bp, Chlamydia pneumoniae
cactgccattcctatcttgc

SEQ ID NO: 4882 - DNA, 20 bp, Chlamydia pneumoniae
gaagccattgcaacgtgaag

SEQ ID NO: 4883 - DNA, 20 bp, Chlamydia pneumoniae
cgggccgagatcatatttct

SEQ ID NO: 4884 - DNA, 20 bp, Chlamydia pneumoniae
ggctgttatgggaaggattc

SEQ ID NO: 4885 - DNA, 20 bp, Chlamydia pneumoniae
cttaaggcagcactttggct

SEQ ID NO: 4886 - DNA, 20 bp, Chlamydia pneumoniae
cgacggtttgaggataacga

SEQ ID NO: 4887 - DNA, 20 bp, Chlamydia pneumoniae
gagagtttcgtgaccaagcc

SEQ ID NO: 4888 - DNA, 20 bp, Chlamydia pneumoniae
ctccttagaggactctctct

SEQ ID NO: 4889 - DNA, 20 bp, Chlamydia pneumoniae
ggcggagatattgcaaagag

SEQ ID NO: 4890 - DNA, 20 bp, Chlamydia pneumoniae
caaagggctccctgaaaact

SEQ ID NO: 4891 - DNA, 20 bp, Chlamydia pneumoniae
tcccagacacaccgttcgtc

SEQ ID NO: 4892 - DNA, 20 bp, Chlamydia pneumoniae
cccagaggcattgtctctat

SEQ ID NO: 4893 - DNA, 20 bp, Chlamydia pneumoniae
ggcagcagtctcttagttga

SEQ ID NO: 4894 - DNA, 20 bp, Chlamydia pneumoniae
gtgcagaatcactatcccca

SEQ ID NO: 4895 - DNA, 20 bp, Chlamydia pneumoniae
tcctgcccctcatacctctt

SEQ ID NO: 4896 - DNA, 20 bp, Chlamydia pneumoniae
cccatcccgtttgttctcgg

SEQ ID NO: 4897 - DNA, 20 bp, Chlamydia pneumoniae
ctcagtacccccaaactcaa

SEQ ID NO: 4898 - DNA, 20 bp, Chlamydia pneumoniae
ggtatcgagggttcttattg

SEQ ID NO: 4899 - DNA, 20 bp, Chlamydia pneumoniae
agcttagggttcgacttcct

SEQ ID NO: 4900 - DNA, 20 bp, Chlamydia pneumoniae
catgtggctgtagtctgcaa

SEQ ID NO: 4901 - DNA, 20 bp, Chlamydia pneumoniae
ctgtagacgtatcagcagga

SEQ ID NO: 4902 - DNA, 20 bp, Chlamydia pneumoniae
gccatctatcgtatcgtacc

SEQ ID NO: 4903 - DNA, 20 bp, Chlamydia pneumoniae
gagccacttatctctattcc

SEQ ID NO: 4904 - DNA, 20 bp, Chlamydia pneumoniae
gttccaagatcctagagcgg

SEQ ID NO: 4905 - DNA, 20 bp, Chlamydia pneumoniae
tggctccaccgttgctctgg

SEQ ID NO: 4906 - DNA, 20 bp, Chlamydia pneumoniae
cgctccctgtgttcacgaat

SEQ ID NO: 4907 - DNA, 20 bp, Chlamydia pneumoniae
aacagcaaggactccttgac

SEQ ID NO: 4908 - DNA, 20 bp, Chlamydia pneumoniae
cagaggatcaagctctttgc

SEQ ID NO: 4909 - DNA, 20 bp, Chlamydia pneumoniae
gtgcagcgacatcgacaata

SEQ ID NO: 4910 - DNA, 20 bp, Chlamydia pneumoniae
aatcctgtaagagtggagag

SEQ ID NO: 4911 - DNA, 20 bp, Chlamydia pneumoniae
ccggggatgctattttgatg

SEQ ID NO: 4912 - DNA, 20 bp, Chlamydia pneumoniae
ctgagacaaatgggtcgcat

SEQ ID NO: 4913 - DNA, 20 bp, Chlamydia pneumoniae
gcctgtggtttgtattggtc

SEQ ID NO: 4914 - DNA, 20 bp, Chlamydia pneumoniae
cctcctgaaccatttcctga

SEQ ID NO: 4915 - DNA, 20 bp, Chlamydia pneumoniae
gcgcagtttgattgtggact

SEQ ID NO: 4916 - DNA, 20 bp, Chlamydia pneumoniae
ctgtcggaccgttattttgg

SEQ ID NO: 4917 - DNA, 20 bp, Chlamydia pneumoniae
ggctccaacaaagaaggaag

SEQ ID NO: 4918 - DNA, 20 bp, Chlamydia pneumoniae
gaggtaagatgcggattcct

SEQ ID NO: 4919 - DNA, 20 bp, Chlamydia pneumoniae
catgatagcgccgccccaag

SEQ ID NO: 4920 - DNA, 20 bp, Chlamydia pneumoniae
gtcttggttagtgtcatccc

SEQ ID NO: 4921 - DNA, 20 bp, Chlamydia pneumoniae
cccgtagcttccatatggaa

SEQ ID NO: 4922 - DNA, 20 bp, Chlamydia pneumoniae
taggagccatgacgatccac

SEQ ID NO: 4923 - DNA, 20 bp, Chlamydia pneumoniae
gcggctatatggaggcaaca

SEQ ID NO: 4924 - DNA, 20 bp, Chlamydia pneumoniae
gggacttgtagctacaacga

SEQ ID NO: 4925 - DNA, 20 bp, Chlamydia pneumoniae
cgggatgtcgattcatcaag

SEQ ID NO: 4926 - DNA, 20 bp, Chlamydia pneumoniae
gcaatgtgactgatcctgtc

SEQ ID NO: 4927 - DNA, 20 bp, Chlamydia pneumoniae
ggaatcgcgggatcgatttt

SEQ ID NO: 4928 - DNA, 20 bp, Chlamydia pneumoniae
cgttcttcatcggaaggtga

SEQ ID NO: 4929 - DNA, 20 bp, Chlamydia pneumoniae
gagacgaggatctctgcgga

SEQ ID NO: 4930 - DNA, 20 bp, Chlamydia pneumoniae
gatcttgatggtcccgtaga

SEQ ID NO: 4931 - DNA, 20 bp, Chlamydia pneumoniae
ccctcctttagctactgtga

SEQ ID NO: 4932 - DNA, 20 bp, Chlamydia pneumoniae
gtgcgagtacttttccttcc

SEQ ID NO: 4933 - DNA, 20 bp, Chlamydia pneumoniae
gggatccttgcttctgaaga

SEQ ID NO: 4934 - DNA, 20 bp, Chlamydia pneumoniae
gtgcgagtacttttccttcc

SEQ ID NO: 4935 - DNA, 20 bp, Chlamydia pneumoniae
gtccaggggcgcatacggtt

SEQ ID NO: 4936 - DNA, 20 bp, Chlamydia pneumoniae
ggactttgtctatcgtctgg

SEQ ID NO: 4937 - DNA, 20 bp, Chlamydia pneumoniae
ctggattctgaaatccctgc

SEQ ID NO: 4938 - DNA, 20 bp, Chlamydia pneumoniae
cgtcgtcgtactaaggcata

SEQ ID NO: 4939 - DNA, 20 bp, Chlamydia pneumoniae
gcacagctgaaagctgtgat

SEQ ID NO: 4940 - DNA, 20 bp, Chlamydia pneumoniae
agcgtatcttcctaaggagc

SEQ ID NO: 4941 - DNA, 20 bp, Chlamydia pneumoniae
tgttagttgcaggggtttcc

SEQ ID NO: 4942 - DNA, 20 bp, Chlamydia pneumoniae
gatctctgtagctatgatgc

SEQ ID NO: 4943 - DNA, 20 bp, Chlamydia pneumoniae
gcagattcgtgagcagattc

SEQ ID NO: 4944 - DNA, 20 bp, Chlamydia pneumoniae
cgcagagataactaagcgtg

SEQ ID NO: 4945 - DNA, 20 bp, Chlamydia pneumoniae
ggatctccacgaatctctga

SEQ ID NO: 4946 - DNA, 20 bp, Chlamydia pneumoniae
cgtttgtttgcaaggcttgg

SEQ ID NO: 4947 - DNA, 20 bp, Chlamydia pneumoniae
gagaattcgctttcgatgct

SEQ ID NO: 4948 - DNA, 20 bp, Chlamydia pneumoniae
gttgccgttctagaaccctc

SEQ ID NO: 4949 - DNA, 20 bp, Chlamydia pneumoniae
ggcagatgttccaagagaag

SEQ ID NO: 4950 - DNA, 20 bp, Chlamydia pneumoniae
gagcagaacgtatcctatgg

SEQ ID NO: 4951 - DNA, 20 bp, Chlamydia pneumoniae
tgtgagagaccactgccttc

SEQ ID NO: 4952 - DNA, 20 bp, Chlamydia pneumoniae
gaagatccggattttgtgcg

SEQ ID NO: 4953 - DNA, 20 bp, Chlamydia pneumoniae
gcagctagcggagtcttttt

SEQ ID NO: 4954 - DNA, 20 bp, Chlamydia pneumoniae
gcgcggacgctataatgata

SEQ ID NO: 4955 - DNA, 20 bp, Chlamydia pneumoniae
gatatccacatgttcggcag

SEQ ID NO: 4956 - DNA, 20 bp, Chlamydia pneumoniae
gaagatccggattttgtgcg

SEQ ID NO: 4957 - DNA, 20 bp, Chlamydia pneumoniae
gcagctagcggagtcttttt

SEQ ID NO: 4958 - DNA, 20 bp, Chlamydia pneumoniae
gatcctcggaatacctgagc

SEQ ID NO: 4959 - DNA, 20 bp, Chlamydia pneumoniae
ccaatcacttccttgtgcga

SEQ ID NO: 4960 - DNA, 20 bp, Chlamydia pneumoniae
gccaatacagagcgcaaagt

SEQ ID NO: 4961 - DNA, 20 bp, Chlamydia pneumoniae
aagagcgtaagctcagagcc

SEQ ID NO: 4962 - DNA, 20 bp, Chlamydia pneumoniae
gaagaaaaaccacgcagttg

SEQ ID NO: 4963 - DNA, 20 bp, Chlamydia pneumoniae
ggcagaggctggaaagatcg

SEQ ID NO: 4964 - DNA, 20 bp, Chlamydia pneumoniae
gttgccagagactactgaga

SEQ ID NO: 4965 - DNA, 20 bp, Chlamydia pneumoniae
gcattggtactcacgatggt

SEQ ID NO: 4966 - DNA, 20 bp, Chlamydia pneumoniae
aacgtgctttgcggttaacg

SEQ ID NO: 4967 - DNA, 20 bp, Chlamydia pneumoniae
gcagaggctctgtctttatg

SEQ ID NO: 4968 - DNA, 20 bp, Chlamydia pneumoniae
ctcgcgaggaagaagaaact

SEQ ID NO: 4969 - DNA, 20 bp, Chlamydia pneumoniae
gaagggaagtagcgggaaaa

SEQ ID NO: 4970 - DNA, 20 bp, Chlamydia pneumoniae
ccttcctgcgatcaatggat

SEQ ID NO: 4971 - DNA, 20 bp, Chlamydia pneumoniae
gccttccggtatggattcaa

SEQ ID NO: 4972 - DNA, 20 bp, Chlamydia pneumoniae
gcgcttctaagactagcgtt

SEQ ID NO: 4973 - DNA, 20 bp, Chlamydia pneumoniae
gaagacgggaacaagagctt

SEQ ID NO: 4974 - DNA, 20 bp, Chlamydia pneumoniae
atgtgcagaggctctgtctt

SEQ ID NO: 4975 - DNA, 20 bp, Chlamydia pneumoniae
catcctgaatcgtgcatggt

SEQ ID NO: 4976 - DNA, 20 bp, Chlamydia pneumoniae
gcaggtaatagcgagagtag

SEQ ID NO: 4977 - DNA, 20 bp, Chlamydia pneumoniae
ccggatcatctctggaacta

SEQ ID NO: 4978 - DNA, 20 bp, Chlamydia pneumoniae
atctccacgcacaaccgatt

SEQ ID NO: 4979 - DNA, 20 bp, Chlamydia pneumoniae
gagtgctctgtagtttcggt

SEQ ID NO: 4980 - DNA, 20 bp, Chlamydia pneumoniae
gagatccctccttctcttca

SEQ ID NO: 4981 - DNA, 20 bp, Chlamydia pneumoniae
cagagcggagaaacgaacaa

SEQ ID NO: 4982 - DNA, 20 bp, Chlamydia pneumoniae
gataagggtcaatccttatg

SEQ ID NO: 4983 - DNA, 20 bp, Chlamydia pneumoniae
gtagctacggcttgtatagc

SEQ ID NO: 4984 - DNA, 20 bp, Chlamydia pneumoniae
gcgagcaattttcctagcct

SEQ ID NO: 4985 - DNA, 20 bp, Chlamydia pneumoniae
gttgtccttggtaacaagcg

SEQ ID NO: 4986 - DNA, 20 bp, Chlamydia pneumoniae
ctccaaaagccaaagagaac

SEQ ID NO: 4987 - DNA, 20 bp, Chlamydia pneumoniae
gcgaggctggaattatttcg

SEQ ID NO: 4988 - DNA, 20 bp, Chlamydia pneumoniae
gcgtttccgggacgcgtgtt

SEQ ID NO: 4989 - DNA, 20 bp, Chlamydia pneumoniae
ctgaaggtgtggggacctca

SEQ ID NO: 4990 - DNA, 20 bp, Chlamydia pneumoniae
gtgaggaagagacggagtta

SEQ ID NO: 4991 - DNA, 20 bp, Chlamydia pneumoniae
ggcgaatctcgtctcggaat

SEQ ID NO: 4992 - DNA, 20 bp, Chlamydia pneumoniae
gtgattgatcgtcaagagtc

SEQ ID NO: 4993 - DNA, 20 bp, Chlamydia pneumoniae
ggctgccctgtttttaggta

SEQ ID NO: 4994 - DNA, 20 bp, Chlamydia pneumoniae
ctacaggctgccctgttttt

SEQ ID NO: 4995 - DNA, 20 bp, Chlamydia pneumoniae
cttcagagtacttacggcca

SEQ ID NO: 4996 - DNA, 20 bp, Chlamydia pneumoniae
agtatcgcaagcttcaggca

SEQ ID NO: 4997 - DNA, 20 bp, Chlamydia pneumoniae
ttcatcaaagtcgtctccac

SEQ ID NO: 4998 - DNA, 20 bp, Chlamydia pneumoniae
gggctttctccatgctttct

SEQ ID NO: 4999 - DNA, 20 bp, Chlamydia pneumoniae
cggcatctcgaaccattctt

SEQ ID NO: 5000 - DNA, 20 bp, Chlamydia pneumoniae
actgcttgacgttttgctgg

SEQ ID NO: 5001 - DNA, 20 bp, Chlamydia pneumoniae
gcaactccttgatcagagaa

SEQ ID NO: 5002 - DNA, 20 bp, Chlamydia pneumoniae
gctgccgatgatgctgctgc

SEQ ID NO: 5003 - DNA, 20 bp, Chlamydia pneumoniae
gtagtcgagcttaagtccgt

SEQ ID NO: 5004 - DNA, 20 bp, Chlamydia pneumoniae
cactcgtgaactgagtggct

SEQ ID NO: 5005 - DNA, 20 bp, Chlamydia pneumoniae
ggatagattctggaagagcg

SEQ ID NO: 5006 - DNA, 20 bp, Chlamydia pneumoniae
agagagtgctgatggcaaca

SEQ ID NO: 5007 - DNA, 20 bp, Chlamydia pneumoniae
gggttgggttaggaagttca

SEQ ID NO: 5008 - DNA, 20 bp, Chlamydia pneumoniae
tcgaggtgcgtttggtctat

SEQ ID NO: 5009 - DNA, 20 bp, Chlamydia pneumoniae
cgccgagcttgtttactcat

SEQ ID NO: 5010 - DNA, 20 bp, Chlamydia pneumoniae
ggtaagcagagcctcttttc

SEQ ID NO: 5011 - DNA, 20 bp, Chlamydia pneumoniae
ggtttggggatgtgttctct

SEQ ID NO: 5012 - DNA, 20 bp, Chlamydia pneumoniae
gcgaaaaagagaccgaagag

SEQ ID NO: 5013 - DNA, 20 bp, Chlamydia pneumoniae
cggcgtctgtaaaagagcag

SEQ ID NO: 5014 - DNA, 20 bp, Chlamydia pneumoniae
ctggtgctcaatgcattcgt

SEQ ID NO: 5015 - DNA, 20 bp, Chlamydia pneumoniae
ggaaatcggtcctaggatgt

SEQ ID NO: 5016 - DNA, 20 bp, Chlamydia pneumoniae
gggtatagagttttgtcccg

SEQ ID NO: 5017 - DNA, 20 bp, Chlamydia pneumoniae
cgaaaagttgggctccgttc

SEQ ID NO: 5018 - DNA, 20 bp, Chlamydia pneumoniae
ccatcaagttttccgtggag

SEQ ID NO: 5019 - DNA, 20 bp, Chlamydia pneumoniae
ggctgaagtgatgttgaagc

SEQ ID NO: 5020 - DNA, 20 bp, Chlamydia pneumoniae
gggggcttcccaatctgtgg

SEQ ID NO: 5021 - DNA, 20 bp, Chlamydia pneumoniae
ggcacgtcgtcatttgatga

SEQ ID NO: 5022 - DNA, 20 bp, Chlamydia pneumoniae
ggtcatctcggaaataacgc

SEQ ID NO: 5023 - DNA, 20 bp, Chlamydia pneumoniae
cccagttgatgagccatctt

SEQ ID NO: 5024 - DNA, 20 bp, Chlamydia pneumoniae
ggcacgtcgtcatttgatga

SEQ ID NO: 5025 - DNA, 20 bp, Chlamydia pneumoniae
gtgcgatcatacttactcgc

SEQ ID NO: 5026 - DNA, 20 bp, Chlamydia pneumoniae
gcactgaggatacgttggtt

SEQ ID NO: 5027 - DNA, 20 bp, Chlamydia pneumoniae
ggtcggagaggctctataaa

SEQ ID NO: 5028 - DNA, 20 bp, Chlamydia pneumoniae
gtcgagcattgctgaggaaa

SEQ ID NO: 5029 - DNA, 20 bp, Chlamydia pneumoniae
cttcaaaggcgtccttttgc

SEQ ID NO: 5030 - DNA, 20 bp, Chlamydia pneumoniae
tcttcggatgaagagggtgc

SEQ ID NO: 5031 - DNA, 20 bp, Chlamydia pneumoniae
aagcccgctcgctccgttta

SEQ ID NO: 5032 - DNA, 20 bp, Chlamydia pneumoniae
ccgaacgagcctttggtgga

SEQ ID NO: 5033 - DNA, 20 bp, Chlamydia pneumoniae
gcttctgctcttgttgtgtc

SEQ ID NO: 5034 - DNA, 20 bp, Chlamydia pneumoniae
cgaggccgcaaaaaatcttc

SEQ ID NO: 5035 - DNA, 20 bp, Chlamydia pneumoniae
gcgacaaatcaacctcgaga

SEQ ID NO: 5036 - DNA, 20 bp, Chlamydia pneumoniae
gcttctgctcttgttgtgtc

SEQ ID NO: 5037 - DNA, 20 bp, Chlamydia pneumoniae
gggggagtgtttgttgatga

SEQ ID NO: 5038 - DNA, 20 bp, Chlamydia pneumoniae
ggaaggagatttgcaactcc

SEQ ID NO: 5039 - DNA, 20 bp, Chlamydia pneumoniae
ggcttcgtctttagaagtcc

SEQ ID NO: 5040 - DNA, 20 bp, Chlamydia pneumoniae
gactttgggtatgggtatcg

SEQ ID NO: 5041 - DNA, 20 bp, Chlamydia pneumoniae
agagaatgcgggctgaagag

SEQ ID NO: 5042 - DNA, 20 bp, Chlamydia pneumoniae
gcttggtatttacgagcggt

SEQ ID NO: 5043 - DNA, 20 bp, Chlamydia pneumoniae
tacgctagtaaagcttggcg

SEQ ID NO: 5044 - DNA, 20 bp, Chlamydia pneumoniae
cccaatagctatggtggtag

SEQ ID NO: 5045 - DNA, 20 bp, Chlamydia pneumoniae
gcgacgttctttgtttgctg

SEQ ID NO: 5046 - DNA, 20 bp, Chlamydia pneumoniae
gccaaaaatacagggttccc

SEQ ID NO: 5047 - DNA, 20 bp, Chlamydia pneumoniae
cctgagcattgacttgggat

SEQ ID NO: 5048 - DNA, 20 bp, Chlamydia pneumoniae
ggaatgcgatacatgtgaag

SEQ ID NO: 5049 - DNA, 20 bp, Chlamydia pneumoniae
atttagcggctctctcggac

SEQ ID NO: 5050 - DNA, 20 bp, Chlamydia pneumoniae
cagatagggtttgcatgcct

SEQ ID NO: 5051 - DNA, 20 bp, Chlamydia pneumoniae
ggagaagtgaatcgcattcc

SEQ ID NO: 5052 - DNA, 20 bp, Chlamydia pneumoniae
gcccatcatacgttatcctg

SEQ ID NO: 5053 - DNA, 20 bp, Chlamydia pneumoniae
cggccgttactgtcattgat

SEQ ID NO: 5054 - DNA, 20 bp, Chlamydia pneumoniae
gggatattgtaggtacaccc

SEQ ID NO: 5055 - DNA, 20 bp, Chlamydia pneumoniae
cgagtcggcaaaagaaactg

SEQ ID NO: 5056 - DNA, 20 bp, Chlamydia pneumoniae
ggaggtatgattactctggg

SEQ ID NO: 5057 - DNA, 20 bp, Chlamydia pneumoniae
tgtggttagcagaggctttg

SEQ ID NO: 5058 - DNA, 20 bp, Chlamydia pneumoniae
cctgatcacgcagcaataac

SEQ ID NO: 5059 - DNA, 20 bp, Chlamydia pneumoniae
tgggagccttgccttctggg

SEQ ID NO: 5060 - DNA, 20 bp, Chlamydia pneumoniae
gttgttcgtcaacgttgggt

SEQ ID NO: 5061 - DNA, 20 bp, Chlamydia pneumoniae
ctctctgggcatgtttttgg

SEQ ID NO: 5062 - DNA, 20 bp, Chlamydia pneumoniae
gcttttcctgagagacgtat

SEQ ID NO: 5063 - DNA, 20 bp, Chlamydia pneumoniae
gttcccttctagagtatgcg

SEQ ID NO: 5064 - DNA, 20 bp, Chlamydia pneumoniae
caagtgaacttagaggctgc

SEQ ID NO: 5065 - DNA, 20 bp, Chlamydia pneumoniae
gcgatagaagacggttcata

SEQ ID NO: 5066 - DNA, 20 bp, Chlamydia pneumoniae
cctcctaggttaaggtagtc

SEQ ID NO: 5067 - DNA, 20 bp, Chlamydia pneumoniae
cacgacaggggttttgaacg

SEQ ID NO: 5068 - DNA, 20 bp, Chlamydia pneumoniae
caaatcccgtaagaagactc

SEQ ID NO: 5069 - DNA, 20 bp, Chlamydia pneumoniae
gctgtgttttggctgaggaa

SEQ ID NO: 5070 - DNA, 20 bp, Chlamydia pneumoniae
caggaggccaagaatcacaa

SEQ ID NO: 5071 - DNA, 20 bp, Chlamydia pneumoniae
cgtcatcacgaaaatcgtgc

SEQ ID NO: 5072 - DNA, 20 bp, Chlamydia pneumoniae
ggatggacaccttgctttgt

SEQ ID NO: 5073 - DNA, 20 bp, Chlamydia pneumoniae
gacttggtatgttgcttgga

SEQ ID NO: 5074 - DNA, 20 bp, Chlamydia pneumoniae
gaaagcagatcgtcatcacg

SEQ ID NO: 5075 - DNA, 20 bp, Chlamydia pneumoniae
gctccttggatagtaatggc

SEQ ID NO: 5076 - DNA, 20 bp, Chlamydia pneumoniae
ggagaacatcgtttgctcgt

SEQ ID NO: 5077 - DNA, 20 bp, Chlamydia pneumoniae
gggaatgaaagatccacggc

SEQ ID NO: 5078 - DNA, 20 bp, Chlamydia pneumoniae
gctccttggatagtaatggc

SEQ ID NO: 5079 - DNA, 20 bp, Chlamydia pneumoniae
gcagcaaaaacagctgtagc

SEQ ID NO: 5080 - DNA, 20 bp, Chlamydia pneumoniae
agacgcgggatctccgaagg

SEQ ID NO: 5081 - DNA, 20 bp, Chlamydia pneumoniae
agagagcccacctccatgtt

SEQ ID NO: 5082 - DNA, 20 bp, Chlamydia pneumoniae
tcctgaggcgagagagagcc

SEQ ID NO: 5083 - DNA, 20 bp, Chlamydia pneumoniae
gtgggtggagctactgttgc

SEQ ID NO: 5084 - DNA, 20 bp, Chlamydia pneumoniae
gaagcggtgatcttaggaaa

SEQ ID NO: 5085 - DNA, 20 bp, Chlamydia pneumoniae
gccgatgcaaagagctagaa

SEQ ID NO: 5086 - DNA, 20 bp, Chlamydia pneumoniae
ggtttgtttccccgcggaat

SEQ ID NO: 5087 - DNA, 20 bp, Chlamydia pneumoniae
gagcccctacaaaagccacc

SEQ ID NO: 5088 - DNA, 20 bp, Chlamydia pneumoniae
gccgatgcaaagagctagaa

SEQ ID NO: 5089 - DNA, 20 bp, Chlamydia pneumoniae
caagccgaaacggtagagat

SEQ ID NO: 5090 - DNA, 20 bp, Chlamydia pneumoniae
gcaaggaaccgggtgtggca

SEQ ID NO: 5091 - DNA, 20 bp, Chlamydia pneumoniae
ggggaagttgcttcggataa

SEQ ID NO: 5092 - DNA, 20 bp, Chlamydia pneumoniae
ctctcccgaagaagacttag

SEQ ID NO: 5093 - DNA, 20 bp, Chlamydia pneumoniae
ggggaacctcattgtctcta

SEQ ID NO: 5094 - DNA, 20 bp, Chlamydia pneumoniae
gttcgtcagagagggacccg

SEQ ID NO: 5095 - DNA, 20 bp, Chlamydia pneumoniae
gcgaactacaggtcaacgat

SEQ ID NO: 5096 - DNA, 20 bp, Chlamydia pneumoniae
ggggaagttgcttcggataa

SEQ ID NO: 5097 - DNA, 20 bp, Chlamydia pneumoniae
caacgacccttgtcaacgta

SEQ ID NO: 5098 - DNA, 20 bp, Chlamydia pneumoniae
ggcgaagaattcgaaatctc

SEQ ID NO: 5099 - DNA, 20 bp, Chlamydia pneumoniae
cgttcgccacatgtggataa

SEQ ID NO: 5100 - DNA, 20 bp, Chlamydia pneumoniae
ccatgcagaagaggaaggaa

SEQ ID NO: 5101 - DNA, 20 bp, Chlamydia pneumoniae
ggacagaccatcatttctgg

SEQ ID NO: 5102 - DNA, 20 bp, Chlamydia pneumoniae
agcgatcccatctaccgcat

SEQ ID NO: 5103 - DNA, 20 bp, Chlamydia pneumoniae
ctcaaagagcgttgtgcaga

SEQ ID NO: 5104 - DNA, 20 bp, Chlamydia pneumoniae
taggaccaattcctctgcct

SEQ ID NO: 5105 - DNA, 20 bp, Chlamydia pneumoniae
ctgtagccgtatttgacgcc

SEQ ID NO: 5106 - DNA, 20 bp, Chlamydia pneumoniae
ggtagcagtaattaccccag

SEQ ID NO: 5107 - DNA, 20 bp, Chlamydia pneumoniae
catcgtatggcggaagcaaa

SEQ ID NO: 5108 - DNA, 20 bp, Chlamydia pneumoniae
gtgaagacacccatcgtatg

SEQ ID NO: 5109 - DNA, 20 bp, Chlamydia pneumoniae
ctgggaaacatcgacctgtt

SEQ ID NO: 5110 - DNA, 20 bp, Chlamydia pneumoniae
gctagcgaacgtaggaattg

SEQ ID NO: 5111 - DNA, 20 bp, Chlamydia pneumoniae
gcgtgattttccttcgtaca

SEQ ID NO: 5112 - DNA, 20 bp, Chlamydia pneumoniae
gcctatattggtggtgaagg

SEQ ID NO: 5113 - DNA, 20 bp, Chlamydia pneumoniae
ctacgcatagacggacaagt

SEQ ID NO: 5114 - DNA, 20 bp, Chlamydia pneumoniae
ggttacataaatcgcggctc

SEQ ID NO: 5115 - DNA, 20 bp, Chlamydia pneumoniae
gcgcgttgtctctgcttcac

SEQ ID NO: 5116 - DNA, 20 bp, Chlamydia pneumoniae
ggaagcagactcaatccaga

SEQ ID NO: 5117 - DNA, 20 bp, Chlamydia pneumoniae
ctcctagacgatcttcagca

SEQ ID NO: 5118 - DNA, 20 bp, Chlamydia pneumoniae
cgatcagcttgtccatcatc

SEQ ID NO: 5119 - DNA, 20 bp, Chlamydia pneumoniae
ccacgtacgagatcagatgt

SEQ ID NO: 5120 - DNA, 20 bp, Chlamydia pneumoniae
gctcgatgatgggatcctta

SEQ ID NO: 5121 - DNA, 20 bp, Chlamydia pneumoniae
caactcctacaagtgatggg

SEQ ID NO: 5122 - DNA, 20 bp, Chlamydia pneumoniae
ccgctctgctttaggatagc

SEQ ID NO: 5123 - DNA, 20 bp, Chlamydia pneumoniae
ggcagatgcaaacagtaagg

SEQ ID NO: 5124 - DNA, 20 bp, Chlamydia pneumoniae
gtgtaactctcaaagcccac

SEQ ID NO: 5125 - DNA, 20 bp, Chlamydia pneumoniae
ctcacgtcctcagaggggaa

SEQ ID NO: 5126 - DNA, 20 bp, Chlamydia pneumoniae
cctgatgacgcttccttttg

SEQ ID NO: 5127 - DNA, 20 bp, Chlamydia pneumoniae
cgttggtgcgggatccaatg

SEQ ID NO: 5128 - DNA, 20 bp, Chlamydia pneumoniae
gctccaaatttcgaacctcc

SEQ ID NO: 5129 - DNA, 20 bp, Chlamydia pneumoniae
cccatatgcagggactctaa

SEQ ID NO: 5130 - DNA, 20 bp, Chlamydia pneumoniae
gcgatattcagggcgtgttt

SEQ ID NO: 5131 - DNA, 20 bp, Chlamydia pneumoniae
ccaggtacgctatccaaaag

SEQ ID NO: 5132 - DNA, 20 bp, Chlamydia pneumoniae
agaccgctaactttcattcg

SEQ ID NO: 5133 - DNA, 20 bp, Chlamydia pneumoniae
gcaccacctctgttgttgtt

SEQ ID NO: 5134 - DNA, 20 bp, Chlamydia pneumoniae
ttcagccgcacggtaatgac

SEQ ID NO: 5135 - DNA, 20 bp, Chlamydia pneumoniae
ccttcgctagcgccttattt

SEQ ID NO: 5136 - DNA, 20 bp, Chlamydia pneumoniae
gacagtcgtttggctgttga

SEQ ID NO: 5137 - DNA, 20 bp, Chlamydia pneumoniae
cggatgctactatcatccag

SEQ ID NO: 5138 - DNA, 20 bp, Chlamydia pneumoniae
cccgcatagtgtaactccta

SEQ ID NO: 5139 - DNA, 20 bp, Chlamydia pneumoniae
gagcttggaaaggtctccta

SEQ ID NO: 5140 - DNA, 20 bp, Chlamydia pneumoniae
catgacgagcaaaggagtag

SEQ ID NO: 5141 - DNA, 20 bp, Chlamydia pneumoniae
gtgagtctaaggtatccagc

SEQ ID NO: 5142 - DNA, 20 bp, Chlamydia pneumoniae
cgatcgcactaaacgtgctt

SEQ ID NO: 5143 - DNA, 20 bp, Chlamydia pneumoniae
catgctttgagctcggcaat

SEQ ID NO: 5144 - DNA, 20 bp, Chlamydia pneumoniae
gcgttcgcaacttcttgagt

SEQ ID NO: 5145 - DNA, 20 bp, Chlamydia pneumoniae
gcatcgttggaaacagtgag

SEQ ID NO: 5146 - DNA, 20 bp, Chlamydia pneumoniae
cattgcttccataaccaggg

SEQ ID NO: 5147 - DNA, 20 bp, Chlamydia pneumoniae
aaagcttcggggaagcgtag

SEQ ID NO: 5148 - DNA, 20 bp, Chlamydia pneumoniae
aggctcttgaggaagctcag

SEQ ID NO: 5149 - DNA, 20 bp, Chlamydia pneumoniae
gatgttcatccagggttcct

SEQ ID NO: 5150 - DNA, 20 bp, Chlamydia pneumoniae
agcgctgtgattcatggggc

SEQ ID NO: 5151 - DNA, 20 bp, Chlamydia pneumoniae
gcctccttttggtctgcatt

SEQ ID NO: 5152 - DNA, 20 bp, Chlamydia pneumoniae
gctctcgaagctgaaatctt

SEQ ID NO: 5153 - DNA, 20 bp, Chlamydia pneumoniae
ggagtgccaggacctgtatg

SEQ ID NO: 5154 - DNA, 20 bp, Chlamydia pneumoniae
ggttgataggagctgccata

SEQ ID NO: 5155 - DNA, 20 bp, Chlamydia pneumoniae
ttcctgttcccgttcccgta

SEQ ID NO: 5156 - DNA, 20 bp, Chlamydia pneumoniae
caatccgagtggatggtttc

SEQ ID NO: 5157 - DNA, 20 bp, Chlamydia pneumoniae
gtagaacctggaagcgtact

SEQ ID NO: 5158 - DNA, 20 bp, Chlamydia pneumoniae
gtcagggtgcgacttgtagt

SEQ ID NO: 5159 - DNA, 20 bp, Chlamydia pneumoniae
ccttctggagtcgttgtttc

SEQ ID NO: 5160 - DNA, 20 bp, Chlamydia pneumoniae
cctaagtttcaggacctcgt

SEQ ID NO: 5161 - DNA, 20 bp, Chlamydia pneumoniae
agcgatgctcgacggcgagc

SEQ ID NO: 5162 - DNA, 20 bp, Chlamydia pneumoniae
cgttctttagatcggcagga

SEQ ID NO: 5163 - DNA, 20 bp, Chlamydia pneumoniae
gaggtctctttgacctcgat

SEQ ID NO: 5164 - DNA, 20 bp, Chlamydia pneumoniae
ccatcatgcgctgatttcca

SEQ ID NO: 5165 - DNA, 20 bp, Chlamydia pneumoniae
ctagagccaaagactttggc

SEQ ID NO: 5166 - DNA, 20 bp, Chlamydia pneumoniae
ccttctggagtcgttgtttc

SEQ ID NO: 5167 - DNA, 20 bp, Chlamydia pneumoniae
gcaaaggaggtcaccacaaa

SEQ ID NO: 5168 - DNA, 20 bp, Chlamydia pneumoniae
gacgaaacatcaatgggcct

SEQ ID NO: 5169 - DNA, 20 bp, Chlamydia pneumoniae
ttgtctagcgaacagatccc

SEQ ID NO: 5170 - DNA, 20 bp, Chlamydia pneumoniae
cgtcaaggggagtctttaga

SEQ ID NO: 5171 - DNA, 20 bp, Chlamydia pneumoniae
aaaaggacgtgctccatcgt

SEQ ID NO: 5172 - DNA, 20 bp, Chlamydia pneumoniae
caagaataggaagggtggct

SEQ ID NO: 5173 - DNA, 20 bp, Chlamydia pneumoniae
ggtaagatagcgtgcatgga

SEQ ID NO: 5174 - DNA, 20 bp, Chlamydia pneumoniae
gcgacgctctccaggaatgg

SEQ ID NO: 5175 - DNA, 20 bp, Chlamydia pneumoniae
cggtggagatccgtaaaatc

SEQ ID NO: 5176 - DNA, 20 bp, Chlamydia pneumoniae
gcgtttgcaaatagagggtg

SEQ ID NO: 5177 - DNA, 20 bp, Chlamydia pneumoniae
tgcgagccgagatcttgttg

SEQ ID NO: 5178 - DNA, 20 bp, Chlamydia pneumoniae
tctgggtcacccgagaaaat

SEQ ID NO: 5179 - DNA, 20 bp, Chlamydia pneumoniae
gggagaacatcggtaaagga

SEQ ID NO: 5180 - DNA, 20 bp, Chlamydia pneumoniae
caaggaaaaggcccttcttc

SEQ ID NO: 5181 - DNA, 20 bp, Chlamydia pneumoniae
gggtgccgctgctcctactg

SEQ ID NO: 5182 - DNA, 20 bp, Chlamydia pneumoniae
tagagaaccccttcgggagt

SEQ ID NO: 5183 - DNA, 20 bp, Chlamydia pneumoniae
ccaaaccatttccctctctc

SEQ ID NO: 5184 - DNA, 20 bp, Chlamydia pneumoniae
gggagaacatcggtaaagga

SEQ ID NO: 5185 - DNA, 20 bp, Chlamydia pneumoniae
gagaaggcttggcgtaagca

SEQ ID NO: 5186 - DNA, 20 bp, Chlamydia pneumoniae
ggctcagagaaaatgctgtg

SEQ ID NO: 5187 - DNA, 20 bp, Chlamydia pneumoniae
cccctggatggattcatttt

SEQ ID NO: 5188 - DNA, 20 bp, Chlamydia pneumoniae
ctgagacttactgggattgc

SEQ ID NO: 5189 - DNA, 20 bp, Chlamydia pneumoniae
caggaattgctgcgcagtta

SEQ ID NO: 5190 - DNA, 20 bp, Chlamydia pneumoniae
tatcgctcgacggcccatct

SEQ ID NO: 5191 - DNA, 20 bp, Chlamydia pneumoniae
caagctaaagcgagcatgtc

SEQ ID NO: 5192 - DNA, 20 bp, Chlamydia pneumoniae
gtgaggtaagaagttccgag

SEQ ID NO: 5193 - DNA, 20 bp, Chlamydia pneumoniae
tctagctggcggatagcctc

SEQ ID NO: 5194 - DNA, 20 bp, Chlamydia pneumoniae
gggttacgtgatgctttagg

SEQ ID NO: 5195 - DNA, 20 bp, Chlamydia pneumoniae
cctcttgtagcgagtcaaac

SEQ ID NO: 5196 - DNA, 20 bp, Chlamydia pneumoniae
cctttacgcataagcagagg

SEQ ID NO: 5197 - DNA, 20 bp, Chlamydia pneumoniae
gtgatgtccccctcctttat

SEQ ID NO: 5198 - DNA, 20 bp, Chlamydia pneumoniae
ggtcagtttaggaaggcgtg

SEQ ID NO: 5199 - DNA, 20 bp, Chlamydia pneumoniae
tttaccgattgcgccagacc

SEQ ID NO: 5200 - DNA, 20 bp, Chlamydia pneumoniae
gggttggggtgtatggaata

SEQ ID NO: 5201 - DNA, 20 bp, Chlamydia pneumoniae
ggacggggattctttatggt

SEQ ID NO: 5202 - DNA, 20 bp, Chlamydia pneumoniae
gtaggcagtgcaacgcataa

SEQ ID NO: 5203 - DNA, 20 bp, Chlamydia pneumoniae
ctcaagcatctttggacgac

SEQ ID NO: 5204 - DNA, 20 bp, Chlamydia pneumoniae
ctaagagaggggagataagc

SEQ ID NO: 5205 - DNA, 20 bp, Chlamydia pneumoniae
agtgacgtggcagatttctc

SEQ ID NO: 5206 - DNA, 20 bp, Chlamydia pneumoniae
gcattaggatggggaatcgt

SEQ ID NO: 5207 - DNA, 20 bp, Chlamydia pneumoniae
aggtctaagttgagttctgc

SEQ ID NO: 5208 - DNA, 20 bp, Chlamydia pneumoniae
tgaaggaggcctccagaata

SEQ ID NO: 5209 - DNA, 20 bp, Chlamydia pneumoniae
gctttggtagtcgcaggtat

SEQ ID NO: 5210 - DNA, 20 bp, Chlamydia pneumoniae
ggcatagcgagaacaccata

SEQ ID NO: 5211 - DNA, 20 bp, Chlamydia pneumoniae
cctggcatggagagatcttt

SEQ ID NO: 5212 - DNA, 20 bp, Chlamydia pneumoniae
tgaggcagggctgacctttt

SEQ ID NO: 5213 - DNA, 20 bp, Chlamydia pneumoniae
gcacagtcacgattaagtcg

SEQ ID NO: 5214 - DNA, 20 bp, Chlamydia pneumoniae
cctttactagtcacctggca

SEQ ID NO: 5215 - DNA, 20 bp, Chlamydia pneumoniae
ggttcagcgaatgttgtagg

SEQ ID NO: 5216 - DNA, 20 bp, Chlamydia pneumoniae
cagactcagctacgaatacg

SEQ ID NO: 5217 - DNA, 20 bp, Chlamydia pneumoniae
cggagggagagtggtcacat

SEQ ID NO: 5218 - DNA, 20 bp, Chlamydia pneumoniae
ccatgtttgcagccagtgaa

SEQ ID NO: 5219 - DNA, 20 bp, Chlamydia pneumoniae
gggaaaacagtcattccagc

SEQ ID NO: 5220 - DNA, 20 bp, Chlamydia pneumoniae
acgcacaactcgcttatagc

SEQ ID NO: 5221 - DNA, 20 bp, Chlamydia pneumoniae
agcggtatcgtcttccctaa

SEQ ID NO: 5222 - DNA, 20 bp, Chlamydia pneumoniae
gcctatgcagtactctggga

SEQ ID NO: 5223 - DNA, 20 bp, Chlamydia pneumoniae
cctccgatgaagagattgct

SEQ ID NO: 5224 - DNA, 20 bp, Chlamydia pneumoniae
cgctcttctagctcctgtaa

SEQ ID NO: 5225 - DNA, 20 bp, Chlamydia pneumoniae
gatattgttctcctcccagg

SEQ ID NO: 5226 - DNA, 20 bp, Chlamydia pneumoniae
ggcgaagaagaaaacttggg

SEQ ID NO: 5227 - DNA, 20 bp, Chlamydia pneumoniae
taatgggtattgggccgaca

SEQ ID NO: 5228 - DNA, 20 bp, Chlamydia pneumoniae
gagcttttgctgcccttcct

SEQ ID NO: 5229 - DNA, 20 bp, Chlamydia pneumoniae
cggaggcctcaaattttgag

SEQ ID NO: 5230 - DNA, 20 bp, Chlamydia pneumoniae
gggaaagactgtgagattcg

SEQ ID NO: 5231 - DNA, 20 bp, Chlamydia pneumoniae
cggtcaagctgtagcaattc

SEQ ID NO: 5232 - DNA, 20 bp, Chlamydia pneumoniae
gggcaaaaggttatctcctc

SEQ ID NO: 5233 - DNA, 20 bp, Chlamydia pneumoniae
cacacgcgattgctgtgaat

SEQ ID NO: 5234 - DNA, 20 bp, Chlamydia pneumoniae
cacttggtccacagggaata

SEQ ID NO: 5235 - DNA, 20 bp, Chlamydia pneumoniae
ctccagctcagattcgtaga

SEQ ID NO: 5236 - DNA, 20 bp, Chlamydia pneumoniae
tggcgtgcttcctatgagta

SEQ ID NO: 5237 - DNA, 20 bp, Chlamydia pneumoniae
caagccatagcagccaaagt

SEQ ID NO: 5238 - DNA, 20 bp, Chlamydia pneumoniae
gaacctaccccgctattgat

SEQ ID NO: 5239 - DNA, 20 bp, Chlamydia pneumoniae
actagtgagagagaagatgg

SEQ ID NO: 5240 - DNA, 20 bp, Chlamydia pneumoniae
gtggtttgattcagtgatcc

SEQ ID NO: 5241 - DNA, 20 bp, Chlamydia pneumoniae
ggcacgaagatactccctat

SEQ ID NO: 5242 - DNA, 20 bp, Chlamydia pneumoniae
ccacgatgttaggtcgagaa

SEQ ID NO: 5243 - DNA, 20 bp, Chlamydia pneumoniae
gctgacgatgtgattgcaag

SEQ ID NO: 5244 - DNA, 20 bp, Chlamydia pneumoniae
gaaggccaaacaagaaggct

SEQ ID NO: 5245 - DNA, 20 bp, Chlamydia pneumoniae
tgtgattcctggcactctgt

SEQ ID NO: 5246 - DNA, 20 bp, Chlamydia pneumoniae
ctgatgctgtagcaaccttg

SEQ ID NO: 5247 - DNA, 20 bp, Chlamydia pneumoniae
gggcaagatctttacagtag

SEQ ID NO: 5248 - DNA, 20 bp, Chlamydia pneumoniae
cgtggctctcggttttctat

SEQ ID NO: 5249 - DNA, 20 bp, Chlamydia pneumoniae
cttcggatcgagagcaaatc

SEQ ID NO: 5250 - DNA, 20 bp, Chlamydia pneumoniae
ccctctctttccgaataacc

SEQ ID NO: 5251 - DNA, 20 bp, Chlamydia pneumoniae
gttcaataggatgcagacgc

SEQ ID NO: 5252 - DNA, 20 bp, Chlamydia pneumoniae
cgtatcgatttgacatcccc

SEQ ID NO: 5253 - DNA, 20 bp, Chlamydia pneumoniae
atgcccgatattctcgatgc

SEQ ID NO: 5254 - DNA, 20 bp, Chlamydia pneumoniae
cgtcccccctccactatagc

SEQ ID NO: 5255 - DNA, 20 bp, Chlamydia pneumoniae
gctatggtcctagaaacgca

SEQ ID NO: 5256 - DNA, 20 bp, Chlamydia pneumoniae
caaatcctgcagaagctgct

SEQ ID NO: 5257 - DNA, 20 bp, Chlamydia pneumoniae
cagagatcaaccgtttgaag

SEQ ID NO: 5258 - DNA, 20 bp, Chlamydia pneumoniae
ggcattcaggctttagcagc

SEQ ID NO: 5259 - DNA, 20 bp, Chlamydia pneumoniae
gtctgtagcagaatgagtgg

SEQ ID NO: 5260 - DNA, 20 bp, Chlamydia pneumoniae
gctcagcgtgatatcctcat

SEQ ID NO: 5261 - DNA, 20 bp, Chlamydia pneumoniae
gctatcggcagatgatgcta

SEQ ID NO: 5262 - DNA, 20 bp, Chlamydia pneumoniae
gagaaaggtatggctatgcc

SEQ ID NO: 5263 - DNA, 20 bp, Chlamydia pneumoniae
gaggttatggaagtccgtga

SEQ ID NO: 5264 - DNA, 20 bp, Chlamydia pneumoniae
gtcttttcgtgctcagatgg

SEQ ID NO: 5265 - DNA, 20 bp, Chlamydia pneumoniae
ttcgactctacacatggacg

SEQ ID NO: 5266 - DNA, 20 bp, Chlamydia pneumoniae
gacttgaccgtcaggttaga

SEQ ID NO: 5267 - DNA, 20 bp, Chlamydia pneumoniae
cagttggaagtcgatctacg

SEQ ID NO: 5268 - DNA, 20 bp, Chlamydia pneumoniae
gacaagctaaaggtggagac

SEQ ID NO: 5269 - DNA, 20 bp, Chlamydia pneumoniae
cgaggtcagagacatagact

SEQ ID NO: 5270 - DNA, 20 bp, Chlamydia pneumoniae
gagactattggcgaacttgt

SEQ ID NO: 5271 - DNA, 20 bp, Chlamydia pneumoniae
cggtactgcaatgcttatcg

SEQ ID NO: 5272 - DNA, 20 bp, Chlamydia pneumoniae
cgtgctttgatatctgctgg

SEQ ID NO: 5273 - DNA, 20 bp, Chlamydia pneumoniae
ctgggtgtggttccttacat

SEQ ID NO: 5274 - DNA, 20 bp, Chlamydia pneumoniae
gcatcagcaggtaaagtagg

SEQ ID NO: 5275 - DNA, 20 bp, Chlamydia pneumoniae
ttacggcctgtagagtgggt

SEQ ID NO: 5276 - DNA, 20 bp, Chlamydia pneumoniae
cgactgaactctctgctaca

SEQ ID NO: 5277 - DNA, 20 bp, Chlamydia pneumoniae
agggggaggagttcctttat

SEQ ID NO: 5278 - DNA, 20 bp, Chlamydia pneumoniae
tgtctgcttcgtgtggattc

SEQ ID NO: 5279 - DNA, 20 bp, Chlamydia pneumoniae
gaagttcttgtccatcacga

SEQ ID NO: 5280 - DNA, 20 bp, Chlamydia pneumoniae
gaagagttcctacaagaggg

SEQ ID NO: 5281 - DNA, 20 bp, Chlamydia pneumoniae
cgcgctatgcgtgtgttttt

SEQ ID NO: 5282 - DNA, 20 bp, Chlamydia pneumoniae
catcacgatggagcacagtt

SEQ ID NO: 5283 - DNA, 20 bp, Chlamydia pneumoniae
cccttcgtggaattcgtatg

SEQ ID NO: 5284 - DNA, 20 bp, Chlamydia pneumoniae
cttcccgtttccactctatc

SEQ ID NO: 5285 - DNA, 20 bp, Chlamydia pneumoniae
cgaaggtgtaaacgttcgca

SEQ ID NO: 5286 - DNA, 20 bp, Chlamydia pneumoniae
ggctcgagaacctattctac

SEQ ID NO: 5287 - DNA, 20 bp, Chlamydia pneumoniae
cgttgttcgagtagaaagga

SEQ ID NO: 5288 - DNA, 20 bp, Chlamydia pneumoniae
cgcgctatgcgtgtgttttt

SEQ ID NO: 5289 - DNA, 20 bp, Chlamydia pneumoniae
cgacgacgatttagatgcgt

SEQ ID NO: 5290 - DNA, 20 bp, Chlamydia pneumoniae
cgacttccgcggattttcta

SEQ ID NO: 5291 - DNA, 20 bp, Chlamydia pneumoniae
gcaggattaagtaagggagc

SEQ ID NO: 5292 - DNA, 20 bp, Chlamydia pneumoniae
cgaaggtgtaaacgttcgca

SEQ ID NO: 5293 - DNA, 20 bp, Chlamydia pneumoniae
gtcctgggttggtaattgga

SEQ ID NO: 5294 - DNA, 20 bp, Chlamydia pneumoniae
gggagacgttatcaaagctg

SEQ ID NO: 5295 - DNA, 20 bp, Chlamydia pneumoniae
gccgggcctgtctacaagcg

SEQ ID NO: 5296 - DNA, 20 bp, Chlamydia pneumoniae
ggtgttgttgtctcggcaaa

SEQ ID NO: 5297 - DNA, 20 bp, Chlamydia pneumoniae
gatgatcggccatacgtttg

SEQ ID NO: 5298 - DNA, 20 bp, Chlamydia pneumoniae
gttaagcgagtggaaagggt

SEQ ID NO: 5299 - DNA, 20 bp, Chlamydia pneumoniae
gaaccctgtagatcatcccc

SEQ ID NO: 5300 - DNA, 20 bp, Chlamydia pneumoniae
ccgagattgctcgttctgaa

SEQ ID NO: 5301 - DNA, 20 bp, Chlamydia pneumoniae
gtggtgagttgcgcggtacg

SEQ ID NO: 5302 - DNA, 20 bp, Chlamydia pneumoniae
ggaacagctgggattttctc

SEQ ID NO: 5303 - DNA, 20 bp, Chlamydia pneumoniae
ctcctaaaactcagtcagcg

SEQ ID NO: 5304 - DNA, 20 bp, Chlamydia pneumoniae
gtttgttgatcaccacctcc

SEQ ID NO: 5305 - DNA, 20 bp, Chlamydia pneumoniae
gcgaagttgaagtagcagac

SEQ ID NO: 5306 - DNA, 20 bp, Chlamydia pneumoniae
gtgtagatggcaaagctgga

SEQ ID NO: 5307 - DNA, 20 bp, Chlamydia pneumoniae
ctcctggtcgttgtttccct

SEQ ID NO: 5308 - DNA, 20 bp, Chlamydia pneumoniae
ggagagggaaagaaaaaggg

SEQ ID NO: 5309 - DNA, 20 bp, Chlamydia pneumoniae
ttgctccgctgcaatttctg

SEQ ID NO: 5310 - DNA, 20 bp, Chlamydia pneumoniae
gcaatgttgagtgtcgtagc

SEQ ID NO: 5311 - DNA, 20 bp, Chlamydia pneumoniae
cattcggtgttttacgtccg

SEQ ID NO: 5312 - DNA, 20 bp, Chlamydia pneumoniae
gcgatcgactcctggtcgtt

SEQ ID NO: 5313 - DNA, 20 bp, Chlamydia pneumoniae
gcaagggttctacgaactca

SEQ ID NO: 5314 - DNA, 20 bp, Chlamydia pneumoniae
ggcagaaaacaaagtctggc

SEQ ID NO: 5315 - DNA, 20 bp, Chlamydia pneumoniae
agtaaagcgtcagaccccca

SEQ ID NO: 5316 - DNA, 20 bp, Chlamydia pneumoniae
cattcggtgttttacgtccg

SEQ ID NO: 5317 - DNA, 20 bp, Chlamydia pneumoniae
accattggaagtggaaaccc

SEQ ID NO: 5318 - DNA, 20 bp, Chlamydia pneumoniae
agggagccatttgcttgcac

SEQ ID NO: 5319 - DNA, 20 bp, Chlamydia pneumoniae
ctgctggtgtattgataggc

SEQ ID NO: 5320 - DNA, 20 bp, Chlamydia pneumoniae
tttgctacgcgattagccct

SEQ ID NO: 5321 - DNA, 20 bp, Chlamydia pneumoniae
cgctattctggagtgggaat

SEQ ID NO: 5322 - DNA, 20 bp, Chlamydia pneumoniae
ctgctggtgtattgataggc

SEQ ID NO: 5323 - DNA, 20 bp, Chlamydia pneumoniae
cttcccgaaggtaaggcatt

SEQ ID NO: 5324 - DNA, 20 bp, Chlamydia pneumoniae
gggggatgtttggataatgc

SEQ ID NO: 5325 - DNA, 20 bp, Chlamydia pneumoniae
cgctatcgagatgcttcgat

SEQ ID NO: 5326 - DNA, 20 bp, Chlamydia pneumoniae
cagtctgcctcaggtaacta

SEQ ID NO: 5327 - DNA, 20 bp, Chlamydia pneumoniae
acaaccagcccattcctgtc

SEQ ID NO: 5328 - DNA, 20 bp, Chlamydia pneumoniae
actgtggattctctaggtcg

SEQ ID NO: 5329 - DNA, 20 bp, Chlamydia pneumoniae
aaacccgtctcgtttagctg

SEQ ID NO: 5330 - DNA, 20 bp, Chlamydia pneumoniae
tacttccctagaagtcgggg

SEQ ID NO: 5331 - DNA, 20 bp, Chlamydia pneumoniae
gaccctggaagaagtgcaaa

SEQ ID NO: 5332 - DNA, 20 bp, Chlamydia pneumoniae
gcctatcttcaatgggcatc

SEQ ID NO: 5333 - DNA, 20 bp, Chlamydia pneumoniae
cttttctatctggaacaggc

SEQ ID NO: 5334 - DNA, 20 bp, Chlamydia pneumoniae
gcctaagccacgattttgtg

SEQ ID NO: 5335 - DNA, 20 bp, Chlamydia pneumoniae
tgcgcattcccatgcaacaa

SEQ ID NO: 5336 - DNA, 20 bp, Chlamydia pneumoniae
cagtcccaccaaaagaacct

SEQ ID NO: 5337 - DNA, 20 bp, Chlamydia pneumoniae
agggttccttcatcaatggc

SEQ ID NO: 5338 - DNA, 20 bp, Chlamydia pneumoniae
cgtgaggtaagacaacccat

SEQ ID NO: 5339 - DNA, 20 bp, Chlamydia pneumoniae
catgtagcatagtcgttgcc

SEQ ID NO: 5340 - DNA, 20 bp, Chlamydia pneumoniae
cttgccatcttcaggcacct

SEQ ID NO: 5341 - DNA, 20 bp, Chlamydia pneumoniae
cggaggtacgatcaaaggtt

SEQ ID NO: 5342 - DNA, 20 bp, Chlamydia pneumoniae
gagcctatcttgcttcctct

SEQ ID NO: 5343 - DNA, 20 bp, Chlamydia pneumoniae
ggatgctcaaggattcacag

SEQ ID NO: 5344 - DNA, 20 bp, Chlamydia pneumoniae
gggattgccttagggttaga

SEQ ID NO: 5345 - DNA, 20 bp, Chlamydia pneumoniae
gctcaaaagcgtattgagcc

SEQ ID NO: 5346 - DNA, 20 bp, Chlamydia pneumoniae
gaatggtcgcaacatttgcg

SEQ ID NO: 5347 - DNA, 20 bp, Chlamydia pneumoniae
taatgtgctttggaggttgg

SEQ ID NO: 5348 - DNA, 20 bp, Chlamydia pneumoniae
gcgcggtttttctccaatac

SEQ ID NO: 5349 - DNA, 20 bp, Chlamydia pneumoniae
aagctatggatgcacaggct

SEQ ID NO: 5350 - DNA, 20 bp, Chlamydia pneumoniae
gaaaaaccctttccaccccc

SEQ ID NO: 5351 - DNA, 20 bp, Chlamydia pneumoniae
actctccacgggtttcatag

SEQ ID NO: 5352 - DNA, 20 bp, Chlamydia pneumoniae
acactcgcaaccaatgatgg

SEQ ID NO: 5353 - DNA, 20 bp, Chlamydia pneumoniae
ctttgccatgcttgcggtta

SEQ ID NO: 5354 - DNA, 20 bp, Chlamydia pneumoniae
cgaagatcgtgtgcgtcatt

SEQ ID NO: 5355 - DNA, 20 bp, Chlamydia pneumoniae
gcatgacgaaagtgctagag

SEQ ID NO: 5356 - DNA, 20 bp, Chlamydia pneumoniae
caaaacgctgggtggaaagc

SEQ ID NO: 5357 - DNA, 20 bp, Chlamydia pneumoniae
ctctgcgttctttccgcttt

SEQ ID NO: 5358 - DNA, 20 bp, Chlamydia pneumoniae
ggatggttaggatgctgctt

SEQ ID NO: 5359 - DNA, 20 bp, Chlamydia pneumoniae
ggaaagagagtcctgcatgt

SEQ ID NO: 5360 - DNA, 20 bp, Chlamydia pneumoniae
gaactccttccagagatagc

SEQ ID NO: 5361 - DNA, 20 bp, Chlamydia pneumoniae
gatgatgtaacccatgggga

SEQ ID NO: 5362 - DNA, 20 bp, Chlamydia pneumoniae
ttctaagtctcctctatggg

SEQ ID NO: 5363 - DNA, 20 bp, Chlamydia pneumoniae
acaaggggcatagaaaggct

SEQ ID NO: 5364 - DNA, 20 bp, Chlamydia pneumoniae
tttggctcgttcctgagctt

SEQ ID NO: 5365 - DNA, 20 bp, Chlamydia pneumoniae
cgatcctgttcccctgaaaa

SEQ ID NO: 5366 - DNA, 20 bp, Chlamydia pneumoniae
aataccttcccagagtcggc

SEQ ID NO: 5367 - DNA, 20 bp, Chlamydia pneumoniae
gcgagtgcaaaagagcatct

SEQ ID NO: 5368 - DNA, 20 bp, Chlamydia pneumoniae
gtggtatgcttttccttctg

SEQ ID NO: 5369 - DNA, 20 bp, Chlamydia pneumoniae
gccgaggatttccaaacgat

SEQ ID NO: 5370 - DNA, 20 bp, Chlamydia pneumoniae
cgccctgtgggataaaatga

SEQ ID NO: 5371 - DNA, 20 bp, Chlamydia pneumoniae
ctgcggaacctccatacttt

SEQ ID NO: 5372 - DNA, 20 bp, Chlamydia pneumoniae
aagactatcgctcgcatccc

SEQ ID NO: 5373 - DNA, 20 bp, Chlamydia pneumoniae
cacctcaacctcctacggcg

SEQ ID NO: 5374 - DNA, 20 bp, Chlamydia pneumoniae
gaagctgcagttgcatttgc

SEQ ID NO: 5375 - DNA, 20 bp, Chlamydia pneumoniae
cttacagaggtagtacgcac

SEQ ID NO: 5376 - DNA, 20 bp, Chlamydia pneumoniae
gagaactcggtgcggctgta

SEQ ID NO: 5377 - DNA, 20 bp, Chlamydia pneumoniae
ctccctgaactttagatgtt

SEQ ID NO: 5378 - DNA, 20 bp, Chlamydia pneumoniae
ctcaggcctgtctctctaag

SEQ ID NO: 5379 - DNA, 20 bp, Chlamydia pneumoniae
ccgcagaactctcttcctac

SEQ ID NO: 5380 - DNA, 20 bp, Chlamydia pneumoniae
cccaggctttggtctatctt

SEQ ID NO: 5381 - DNA, 20 bp, Chlamydia pneumoniae
cgaggcggaaattatggaag

SEQ ID NO: 5382 - DNA, 20 bp, Chlamydia pneumoniae
ggatgggctcagcattaaca

SEQ ID NO: 5383 - DNA, 20 bp, Chlamydia pneumoniae
tggggtactgttggcgttgt

SEQ ID NO: 5384 - DNA, 20 bp, Chlamydia pneumoniae
ccataccaagcactgttcct

SEQ ID NO: 5385 - DNA, 20 bp, Chlamydia pneumoniae
agagagttggtgggggtaga

SEQ ID NO: 5386 - DNA, 20 bp, Chlamydia pneumoniae
ggcagataaagcacgcttgc

SEQ ID NO: 5387 - DNA, 20 bp, Chlamydia pneumoniae
ctcctcagataaccctacca

SEQ ID NO: 5388 - DNA, 20 bp, Chlamydia pneumoniae
taagaacccagaggtgagag

SEQ ID NO: 5389 - DNA, 20 bp, Chlamydia pneumoniae
cctgtacgtccaggatttca

SEQ ID NO: 5390 - DNA, 20 bp, Chlamydia pneumoniae
ccgtaagtaagttgtggcct

SEQ ID NO: 5391 - DNA, 20 bp, Chlamydia pneumoniae
ctaggctaagagcgtcttct

SEQ ID NO: 5392 - DNA, 20 bp, Chlamydia pneumoniae
gagcgccatggcaatgcaaa

SEQ ID NO: 5393 - DNA, 20 bp, Chlamydia pneumoniae
tcgatagagttgaagcccac

SEQ ID NO: 5394 - DNA, 20 bp, Chlamydia pneumoniae
ctaggctaagagcgtcttct

SEQ ID NO: 5395 - DNA, 20 bp, Chlamydia pneumoniae
cgatcacacgtagtagggtt

SEQ ID NO: 5396 - DNA, 20 bp, Chlamydia pneumoniae
cctgtacgtccaggatttca

SEQ ID NO: 5397 - DNA, 20 bp, Chlamydia pneumoniae
ggaaagaataggggtagtga

SEQ ID NO: 5398 - DNA, 20 bp, Chlamydia pneumoniae
ggaagctctacccgtcgtta

SEQ ID NO: 5399 - DNA, 20 bp, Chlamydia pneumoniae
cgtctgcgataggatcttct

SEQ ID NO: 5400 - DNA, 20 bp, Chlamydia pneumoniae
aactgggaacgagagtggga

SEQ ID NO: 5401 - DNA, 20 bp, Chlamydia pneumoniae
gcaaaagagaacgagccttt

SEQ ID NO: 5402 - DNA, 20 bp, Chlamydia pneumoniae
cccatcctttggatctaggt

SEQ ID NO: 5403 - DNA, 20 bp, Chlamydia pneumoniae
tcctgaagagatgcagacga

SEQ ID NO: 5404 - DNA, 20 bp, Chlamydia pneumoniae
ggtgatagatgccgttgcta

SEQ ID NO: 5405 - DNA, 20 bp, Chlamydia pneumoniae
ccagagattcctggagtcaa

SEQ ID NO: 5406 - DNA, 20 bp, Chlamydia pneumoniae
gatagaaacagacgaggtga

SEQ ID NO: 5407 - DNA, 20 bp, Chlamydia pneumoniae
gatccatggtttttgtcggg

SEQ ID NO: 5408 - DNA, 20 bp, Chlamydia pneumoniae
tcttggagaaataccgagag

SEQ ID NO: 5409 - DNA, 20 bp, Chlamydia pneumoniae
gctgctctacgtaatgaacc

SEQ ID NO: 5410 - DNA, 20 bp, Chlamydia pneumoniae
gcctatacggatccgaagat

SEQ ID NO: 5411 - DNA, 20 bp, Chlamydia pneumoniae
cgacctgatttgtctgatgg

SEQ ID NO: 5412 - DNA, 20 bp, Chlamydia pneumoniae
gcatgtaagcgccttagtgt

SEQ ID NO: 5413 - DNA, 20 bp, Chlamydia pneumoniae
gatgtctagcaacccgtact

SEQ ID NO: 5414 - DNA, 20 bp, Chlamydia pneumoniae
gactggatcgggaatatggt

SEQ ID NO: 5415 - DNA, 20 bp, Chlamydia pneumoniae
gcggaagattctaaagcggt

SEQ ID NO: 5416 - DNA, 20 bp, Chlamydia pneumoniae
ggaggagccattattgcgtt

SEQ ID NO: 5417 - DNA, 20 bp, Chlamydia pneumoniae
ggtcgaaaacatagtctccg

SEQ ID NO: 5418 - DNA, 20 bp, Chlamydia pneumoniae
caagaaagcgtggcttcaga

SEQ ID NO: 5419 - DNA, 20 bp, Chlamydia pneumoniae
caacgcctttatagcccttg

SEQ ID NO: 5420 - DNA, 20 bp, Chlamydia pneumoniae
cctcactaccttctcaagtc

SEQ ID NO: 5421 - DNA, 20 bp, Chlamydia pneumoniae
gggattccaagctttgtacc

SEQ ID NO: 5422 - DNA, 20 bp, Chlamydia pneumoniae
cgcaaactggattaaggggt

SEQ ID NO: 5423 - DNA, 20 bp, Chlamydia pneumoniae
ccagtcgggataaacgcatt

SEQ ID NO: 5424 - DNA, 20 bp, Chlamydia pneumoniae
attaatgcagtgccgttggc

SEQ ID NO: 5425 - DNA, 20 bp, Chlamydia pneumoniae
cagagggaaaagaaaaaccc

SEQ ID NO: 5426 - DNA, 20 bp, Chlamydia pneumoniae
cccatttgatctgccgatac

SEQ ID NO: 5427 - DNA, 20 bp, Chlamydia pneumoniae
tgatctcggattactgctgc

SEQ ID NO: 5428 - DNA, 20 bp, Chlamydia pneumoniae
cttcgacttcaggctgtaag

SEQ ID NO: 5429 - DNA, 20 bp, Chlamydia pneumoniae
gagcttggaagcagtaatcc

SEQ ID NO: 5430 - DNA, 20 bp, Chlamydia pneumoniae
ctaaccgctgagctaaagac

SEQ ID NO: 5431 - DNA, 20 bp, Chlamydia pneumoniae
gtaagagtcggccgtataac

SEQ ID NO: 5432 - DNA, 20 bp, Chlamydia pneumoniae
ggggagtgtcttttagagga

SEQ ID NO: 5433 - DNA, 20 bp, Chlamydia pneumoniae
atcctggttcgatccctctt

SEQ ID NO: 5434 - DNA, 20 bp, Chlamydia pneumoniae
gccgtggaatagcttctgac

SEQ ID NO: 5435 - DNA, 20 bp, Chlamydia pneumoniae
tgtcacgatcgtttcccacg

SEQ ID NO: 5436 - DNA, 20 bp, Chlamydia pneumoniae
gagttgttgcagttcgtaag

SEQ ID NO: 5437 - DNA, 20 bp, Chlamydia pneumoniae
ctcatcactcctcagggtaa

SEQ ID NO: 5438 - DNA, 20 bp, Chlamydia pneumoniae
cttttccccaggattaggga

SEQ ID NO: 5439 - DNA, 20 bp, Chlamydia pneumoniae
cgtagatatttctctgcgcc

SEQ ID NO: 5440 - DNA, 20 bp, Chlamydia pneumoniae
ccctcaacgctcattagctt

SEQ ID NO: 5441 - DNA, 20 bp, Chlamydia pneumoniae
tcctgaaaccgaagaaagcg

SEQ ID NO: 5442 - DNA, 20 bp, Chlamydia pneumoniae
ccctggatacagtagactcg

SEQ ID NO: 5443 - DNA, 20 bp, Chlamydia pneumoniae
gaagagaaaacacgactcca

SEQ ID NO: 5444 - DNA, 20 bp, Chlamydia pneumoniae
gctgcagaccttgtaacgaa

SEQ ID NO: 5445 - DNA, 20 bp, Chlamydia pneumoniae
gccgacgttaatgtaatcgc

SEQ ID NO: 5446 - DNA, 20 bp, Chlamydia pneumoniae
gcagtacagctttcggaaga

SEQ ID NO: 5447 - DNA, 20 bp, Chlamydia pneumoniae
cacacacaacaagatgctcg

SEQ ID NO: 5448 - DNA, 20 bp, Chlamydia pneumoniae
cggatcatagggaaagcaag

SEQ ID NO: 5449 - DNA, 20 bp, Chlamydia pneumoniae
gagctcttgctcaatctgtc

SEQ ID NO: 5450 - DNA, 20 bp, Chlamydia pneumoniae
gagggttcggtaactaggaa

SEQ ID NO: 5451 - DNA, 20 bp, Chlamydia pneumoniae
gccatcttcttcaaggaggt

SEQ ID NO: 5452 - DNA, 20 bp, Chlamydia pneumoniae
cagtgcgctgataaaaggca

SEQ ID NO: 5453 - DNA, 20 bp, Chlamydia pneumoniae
gttgtggctttaggaacgac

SEQ ID NO: 5454 - DNA, 20 bp, Chlamydia pneumoniae
cggcgtatgtacttacgtga

SEQ ID NO: 5455 - DNA, 20 bp, Chlamydia pneumoniae
gacacggcaagtgaccatac

SEQ ID NO: 5456 - DNA, 20 bp, Chlamydia pneumoniae
cgcgatctttttagagaagg

SEQ ID NO: 5457 - DNA, 20 bp, Chlamydia pneumoniae
ccaaagtcagcagaaccctc

SEQ ID NO: 5458 - DNA, 20 bp, Chlamydia pneumoniae
gctgtcttactcccagctga

SEQ ID NO: 5459 - DNA, 20 bp, Chlamydia pneumoniae
gcctcggcaaacttcggaaa

SEQ ID NO: 5460 - DNA, 20 bp, Chlamydia pneumoniae
gatgcaaatgacgacacggc

SEQ ID NO: 5461 - DNA, 20 bp, Chlamydia pneumoniae
gcaatgcaccaaagaaggag

SEQ ID NO: 5462 - DNA, 20 bp, Chlamydia pneumoniae
cagggaagtagcgatccaat

SEQ ID NO: 5463 - DNA, 20 bp, Chlamydia pneumoniae
ggacaggtaaaacgagccta

SEQ ID NO: 5464 - DNA, 20 bp, Chlamydia pneumoniae
ctccatctgctgatacagca

SEQ ID NO: 5465 - DNA, 20 bp, Chlamydia pneumoniae
actccccgaggagctcaaaa

SEQ ID NO: 5466 - DNA, 20 bp, Chlamydia pneumoniae
catcgcttgacatatacagc

SEQ ID NO: 5467 - DNA, 20 bp, Chlamydia pneumoniae
cagccctacagagaaatgga

SEQ ID NO: 5468 - DNA, 20 bp, Chlamydia pneumoniae
ggcctgccttcttcattgat

SEQ ID NO: 5469 - DNA, 20 bp, Chlamydia pneumoniae
gcctgcatcttttcttgctc

SEQ ID NO: 5470 - DNA, 20 bp, Chlamydia pneumoniae
gagcgtagtcgttttgtttc

SEQ ID NO: 5471 - DNA, 20 bp, Chlamydia pneumoniae
gagcttttggagtctctggt

SEQ ID NO: 5472 - DNA, 20 bp, Chlamydia pneumoniae
gatgcctagagcagttgcta

SEQ ID NO: 5473 - DNA, 20 bp, Chlamydia pneumoniae
ccatacgtactacaatggtt

SEQ ID NO: 5474 - DNA, 20 bp, Chlamydia pneumoniae
aacaataggggcatcgccat

SEQ ID NO: 5475 - DNA, 20 bp, Chlamydia pneumoniae
ggcgcaataaaggtcgttca

SEQ ID NO: 5476 - DNA, 20 bp, Chlamydia pneumoniae
ggaccctcgaaggtaggagt

SEQ ID NO: 5477 - DNA, 20 bp, Chlamydia pneumoniae
ggcggtccactagattctta

SEQ ID NO: 5478 - DNA, 20 bp, Chlamydia pneumoniae
cagttaaggatctagcgatt

SEQ ID NO: 5479 - DNA, 20 bp, Chlamydia pneumoniae
ggactgtaatttccctgcga

SEQ ID NO: 5480 - DNA, 20 bp, Chlamydia pneumoniae
ctttgccaatgatcttcccg

SEQ ID NO: 5481 - DNA, 20 bp, Chlamydia pneumoniae
catttgtcacgggcttcttg

SEQ ID NO: 5482 - DNA, 20 bp, Chlamydia pneumoniae
ctttgctcgctttcgtgctc

SEQ ID NO: 5483 - DNA, 20 bp, Chlamydia pneumoniae
ggcaggaacctagttgcaaa

SEQ ID NO: 5484 - DNA, 20 bp, Chlamydia pneumoniae
ccgggtgaggtattctttac

SEQ ID NO: 5485 - DNA, 20 bp, Chlamydia pneumoniae
ctctctgatgacgaacctct

SEQ ID NO: 5486 - DNA, 20 bp, Chlamydia pneumoniae
gtgcacgatggtccatagtt

SEQ ID NO: 5487 - DNA, 20 bp, Chlamydia pneumoniae
tagtgtccgggttagtagga

SEQ ID NO: 5488 - DNA, 20 bp, Chlamydia pneumoniae
gcgctaccctggatatcaaa

SEQ ID NO: 5489 - DNA, 20 bp, Chlamydia pneumoniae
cgaatctacggcacgaagtt

SEQ ID NO: 5490 - DNA, 20 bp, Chlamydia pneumoniae
gcggagatgttggcatgttt

SEQ ID NO: 5491 - DNA, 20 bp, Chlamydia pneumoniae
cagttggcaggcaaatatgg

SEQ ID NO: 5492 - DNA, 20 bp, Chlamydia pneumoniae
cagaccagcaatcttttgcg

SEQ ID NO: 5493 - DNA, 20 bp, Chlamydia pneumoniae
ccactatcatggcctcagtt

SEQ ID NO: 5494 - DNA, 20 bp, Chlamydia pneumoniae
gcggctttaggatcctttga

SEQ ID NO: 5495 - DNA, 20 bp, Chlamydia pneumoniae
gctgaatcgcgttctcattc

SEQ ID NO: 5496 - DNA, 20 bp, Chlamydia pneumoniae
gtccagcttgatgattcgag

SEQ ID NO: 5497 - DNA, 20 bp, Chlamydia pneumoniae
cgctgcgaggttattgaagt

SEQ ID NO: 5498 - DNA, 20 bp, Chlamydia pneumoniae
gcccctggaagagagttaat

SEQ ID NO: 5499 - DNA, 20 bp, Chlamydia pneumoniae
gcaatcgctactgctaagac

SEQ ID NO: 5500 - DNA, 20 bp, Chlamydia pneumoniae
ggccttaccaacacactaga

SEQ ID NO: 5501 - DNA, 20 bp, Chlamydia pneumoniae
tagagcgatggagcatcttg

SEQ ID NO: 5502 - DNA, 20 bp, Chlamydia pneumoniae
ctgaaaatgagaccgcttcc

SEQ ID NO: 5503 - DNA, 20 bp, Chlamydia pneumoniae
ctcgagaactttctaaggac

SEQ ID NO: 5504 - DNA, 20 bp, Chlamydia pneumoniae
ggcatcacagattctctatc

SEQ ID NO: 5505 - DNA, 20 bp, Chlamydia pneumoniae
cgtgtcctttatgaacacgg

SEQ ID NO: 5506 - DNA, 20 bp, Chlamydia pneumoniae
ctccataacggctcaagcaa

SEQ ID NO: 5507 - DNA, 20 bp, Chlamydia pneumoniae
gctgctcatttcttgaggct

SEQ ID NO: 5508 - DNA, 20 bp, Chlamydia pneumoniae
gcgctttgcttcactgtgaa

SEQ ID NO: 5509 - DNA, 20 bp, Chlamydia pneumoniae
ctgtatatcagtatggcgtt

SEQ ID NO: 5510 - DNA, 20 bp, Chlamydia pneumoniae
gacaggtatcgtttacggtg

SEQ ID NO: 5511 - DNA, 20 bp, Chlamydia pneumoniae
gctcgatattgtggccctaa

SEQ ID NO: 5512 - DNA, 20 bp, Chlamydia pneumoniae
gacgaaagttctctgccttc

SEQ ID NO: 5513 - DNA, 20 bp, Chlamydia pneumoniae
ccgactcggaaatatgctga

SEQ ID NO: 5514 - DNA, 20 bp, Chlamydia pneumoniae
gtggattatccacacgagta

SEQ ID NO: 5515 - DNA, 20 bp, Chlamydia pneumoniae
cccttgtttattgggggatg

SEQ ID NO: 5516 - DNA, 20 bp, Chlamydia pneumoniae
ccgactcggaaatatgctga

SEQ ID NO: 5517 - DNA, 20 bp, Chlamydia pneumoniae
caccttggtgagtttcaaag

SEQ ID NO: 5518 - DNA, 20 bp, Chlamydia pneumoniae
gagtcttgtactcctttagg

SEQ ID NO: 5519 - DNA, 20 bp, Chlamydia pneumoniae
tgccctgtagtagcatttgc

SEQ ID NO: 5520 - DNA, 20 bp, Chlamydia pneumoniae
ctgaagcttgctcgacaatg

SEQ ID NO: 5521 - DNA, 20 bp, Chlamydia pneumoniae
gaattgcgctgccgatgata

SEQ ID NO: 5522 - DNA, 20 bp, Chlamydia pneumoniae
gaggtctcttcgggagataa

SEQ ID NO: 5523 - DNA, 20 bp, Chlamydia pneumoniae
gacatctgatctagagtagc

SEQ ID NO: 5524 - DNA, 20 bp, Chlamydia pneumoniae
gctgagagtttagaaccgct

SEQ ID NO: 5525 - DNA, 20 bp, Chlamydia pneumoniae
ctcgtgcaagcaacgtacat

SEQ ID NO: 5526 - DNA, 20 bp, Chlamydia pneumoniae
gtagtcttagcgcttctgag

SEQ ID NO: 5527 - DNA, 20 bp, Chlamydia pneumoniae
ccaagctctcctaagaggaa

SEQ ID NO: 5528 - DNA, 20 bp, Chlamydia pneumoniae
ccacagctcttggttctcta

SEQ ID NO: 5529 - DNA, 20 bp, Chlamydia pneumoniae
gtggaaagaactcgccatct

SEQ ID NO: 5530 - DNA, 20 bp, Chlamydia pneumoniae
ggattctactttagcgaggg

SEQ ID NO: 5531 - DNA, 20 bp, Chlamydia pneumoniae
ccaacattttctccggatgc

SEQ ID NO: 5532 - DNA, 20 bp, Chlamydia pneumoniae
cgttggggtgtagaaattgt

SEQ ID NO: 5533 - DNA, 20 bp, Chlamydia pneumoniae
ccctgagctgtttgtttggt

SEQ ID NO: 5534 - DNA, 20 bp, Chlamydia pneumoniae
cgcagaacatgttagggaag

SEQ ID NO: 5535 - DNA, 20 bp, Chlamydia pneumoniae
cgtcgttcctctttgggaaa

SEQ ID NO: 5536 - DNA, 20 bp, Chlamydia pneumoniae
ctcttttgtctagctcttgg

SEQ ID NO: 5537 - DNA, 20 bp, Chlamydia pneumoniae
cagcctttcaacaaggttgg

SEQ ID NO: 5538 - DNA, 20 bp, Chlamydia pneumoniae
gcatctccttgctctacctt

SEQ ID NO: 5539 - DNA, 20 bp, Chlamydia pneumoniae
cgcatttcctcacctatgtc

SEQ ID NO: 5540 - DNA, 20 bp, Chlamydia pneumoniae
cctgcaggactctatcttga

SEQ ID NO: 5541 - DNA, 20 bp, Chlamydia pneumoniae
ggcacgaacttgagggatta

SEQ ID NO: 5542 - DNA, 20 bp, Chlamydia pneumoniae
gatcacagtttctacacaac

SEQ ID NO: 5543 - DNA, 20 bp, Chlamydia pneumoniae
ggtcgttggttcttttcgca

SEQ ID NO: 5544 - DNA, 20 bp, Chlamydia pneumoniae
gcagatgcgggtgttttaga

SEQ ID NO: 5545 - DNA, 20 bp, Chlamydia pneumoniae
cgaggtcaagaacacgtaca

SEQ ID NO: 5546 - DNA, 20 bp, Chlamydia pneumoniae
cggaagataaatccgcagag

SEQ ID NO: 5547 - DNA, 20 bp, Chlamydia pneumoniae
gcgcatccaatcgaagagta

SEQ ID NO: 5548 - DNA, 20 bp, Chlamydia pneumoniae
tctaggtgctggagtacgtt

SEQ ID NO: 5549 - DNA, 20 bp, Chlamydia pneumoniae
gcgctcgagttttctcttct

SEQ ID NO: 5550 - DNA, 20 bp, Chlamydia pneumoniae
tcgcaacgtggatgtccata

SEQ ID NO: 5551 - DNA, 20 bp, Chlamydia pneumoniae
gggcaacacattgtttagcc

SEQ ID NO: 5552 - DNA, 20 bp, Chlamydia pneumoniae
cccgccagaagaaaaacacg

SEQ ID NO: 5553 - DNA, 20 bp, Chlamydia pneumoniae
ccatccctactttgattccg

SEQ ID NO: 5554 - DNA, 20 bp, Chlamydia pneumoniae
gggatatcacctgctgatgt

SEQ ID NO: 5555 - DNA, 20 bp, Chlamydia pneumoniae
cagccctaactatcacagga

SEQ ID NO: 5556 - DNA, 20 bp, Chlamydia pneumoniae
cagaaccccccaagggccat

SEQ ID NO: 5557 - DNA, 20 bp, Chlamydia pneumoniae
cgttaccaccggaagaaagt

SEQ ID NO: 5558 - DNA, 20 bp, Chlamydia pneumoniae
gcatggcttggagatgtagt

SEQ ID NO: 5559 - DNA, 20 bp, Chlamydia pneumoniae
ccaatgtagatctgccgctt

SEQ ID NO: 5560 - DNA, 20 bp, Chlamydia pneumoniae
gacttctgctgaaaaacgca

SEQ ID NO: 5561 - DNA, 20 bp, Chlamydia pneumoniae
tggtcaatttgctccggagt

SEQ ID NO: 5562 - DNA, 20 bp, Chlamydia pneumoniae
ctcttcatagccataagttc

SEQ ID NO: 5563 - DNA, 20 bp, Chlamydia pneumoniae
ccgctaatcaaatagtgggc

SEQ ID NO: 5564 - DNA, 20 bp, Chlamydia pneumoniae
gcaagagcaacaagctcttc

SEQ ID NO: 5565 - DNA, 20 bp, Chlamydia pneumoniae
gccaggtgctctattaaagc

SEQ ID NO: 5566 - DNA, 20 bp, Chlamydia pneumoniae
gcatctgaaagcttgtcgga

SEQ ID NO: 5567 - DNA, 20 bp, Chlamydia pneumoniae
gctcaccaccaccgattaaa

SEQ ID NO: 5568 - DNA, 20 bp, Chlamydia pneumoniae
cctaccaccttctctatctg

SEQ ID NO: 5569 - DNA, 20 bp, Chlamydia pneumoniae
cacggaaagcaaaacatccc

SEQ ID NO: 5570 - DNA, 20 bp, Chlamydia pneumoniae
cgacgactgctctatcaaca

SEQ ID NO: 5571 - DNA, 20 bp, Chlamydia pneumoniae
gcagcgaataaaactccctc

SEQ ID NO: 5572 - DNA, 20 bp, Chlamydia pneumoniae
cgctgaaggaatgagtatcc

SEQ ID NO: 5573 - DNA, 20 bp, Chlamydia pneumoniae
atcggtgatgtacacgtagg

SEQ ID NO: 5574 - DNA, 20 bp, Chlamydia pneumoniae
ccagcttcttcatccatgag

SEQ ID NO: 5575 - DNA, 20 bp, Chlamydia pneumoniae
ggtccttgtattctagtgct

SEQ ID NO: 5576 - DNA, 20 bp, Chlamydia pneumoniae
gcagcgaataaaactccctc

SEQ ID NO: 5577 - DNA, 20 bp, Chlamydia pneumoniae
cggcaaacctttgctcaact

SEQ ID NO: 5578 - DNA, 20 bp, Chlamydia pneumoniae
ggtccttgtattctagtgct

SEQ ID NO: 5579 - DNA, 20 bp, Chlamydia pneumoniae
ccatgagtcccatttatggg

SEQ ID NO: 5580 - DNA, 20 bp, Chlamydia pneumoniae
ccgggttactgaccatttac

SEQ ID NO: 5581 - DNA, 20 bp, Chlamydia pneumoniae
cttgggaaaagcagcccctc

SEQ ID NO: 5582 - DNA, 20 bp, Chlamydia pneumoniae
gctcgtctggaactgcgaac

SEQ ID NO: 5583 - DNA, 20 bp, Chlamydia pneumoniae
gggacccaagaagcaaagat

SEQ ID NO: 5584 - DNA, 20 bp, Chlamydia pneumoniae
ttgcccttgggaaaagcagc

SEQ ID NO: 5585 - DNA, 20 bp, Chlamydia pneumoniae
ccaataagctctggcgtctt

SEQ ID NO: 5586 - DNA, 20 bp, Chlamydia pneumoniae
cacacttggaaaccaactgg

SEQ ID NO: 5587 - DNA, 20 bp, Chlamydia pneumoniae
cagcagaaaaagaagctgtc

SEQ ID NO: 5588 - DNA, 20 bp, Chlamydia pneumoniae
ctccgttaccaaaaactggg

SEQ ID NO: 5589 - DNA, 20 bp, Chlamydia pneumoniae
gatgacgcaagatgctcacg

SEQ ID NO: 5590 - DNA, 20 bp, Chlamydia pneumoniae
gggaaaagcaaaaagctcgg

SEQ ID NO: 5591 - DNA, 20 bp, Chlamydia pneumoniae
cttgaccgcattgtgggata

SEQ ID NO: 5592 - DNA, 20 bp, Chlamydia pneumoniae
gaaactaagagcaccgactc

SEQ ID NO: 5593 - DNA, 20 bp, Chlamydia pneumoniae
ctctctttatccgaacttcg

SEQ ID NO: 5594 - DNA, 20 bp, Chlamydia pneumoniae
tgttctacaatggatccgcc

SEQ ID NO: 5595 - DNA, 20 bp, Chlamydia pneumoniae
ctccttctacaagcgtaagg

SEQ ID NO: 5596 - DNA, 20 bp, Chlamydia pneumoniae
cgcgtgaatttgatgaccct

SEQ ID NO: 5597 - DNA, 20 bp, Chlamydia pneumoniae
cctcagggtaaacagtatgc

SEQ ID NO: 5598 - DNA, 20 bp, Chlamydia pneumoniae
cctcagggtaaacagtatgc

SEQ ID NO: 5599 - DNA, 20 bp, Chlamydia pneumoniae
gtttctgtaggtgtggctcc

SEQ ID NO: 5600 - DNA, 20 bp, Chlamydia pneumoniae
gggactagtgttcgcaaaga

SEQ ID NO: 5601 - DNA, 20 bp, Chlamydia pneumoniae
caggaatgcgctctatggat

SEQ ID NO: 5602 - DNA, 20 bp, Chlamydia pneumoniae
gtctcccctaatcaggagat

SEQ ID NO: 5603 - DNA, 20 bp, Chlamydia pneumoniae
gcttctgccatgaaaaggtc

SEQ ID NO: 5604 - DNA, 20 bp, Chlamydia pneumoniae
cacaccctacgtaagggaaa

SEQ ID NO: 5605 - DNA, 20 bp, Chlamydia pneumoniae
ggacgcgtaacaaaataggg

SEQ ID NO: 5606 - DNA, 20 bp, Chlamydia pneumoniae
acgttataccctcgaggtcc

SEQ ID NO: 5607 - DNA, 20 bp, Chlamydia pneumoniae
ccgtaggacacacgtaagta

SEQ ID NO: 5608 - DNA, 20 bp, Chlamydia pneumoniae
ggtgcctattttcgctcaac

SEQ ID NO: 5609 - DNA, 20 bp, Chlamydia pneumoniae
ggaatctctgcagatcgtct

SEQ ID NO: 5610 - DNA, 20 bp, Chlamydia pneumoniae
cgagaagaaggctactgtgt

SEQ ID NO: 5611 - DNA, 20 bp, Chlamydia pneumoniae
gccgtccgcgtctttatatt

SEQ ID NO: 5612 - DNA, 20 bp, Chlamydia pneumoniae
cggatcctgttcctgagaat

SEQ ID NO: 5613 - DNA, 20 bp, Chlamydia pneumoniae
ctggaatcagtgctgggaaa

SEQ ID NO: 5614 - DNA, 20 bp, Chlamydia pneumoniae
gcgattctcacgaacttggt

SEQ ID NO: 5615 - DNA, 20 bp, Chlamydia pneumoniae
agcaactcaagaagacgagc

SEQ ID NO: 5616 - DNA, 20 bp, Chlamydia pneumoniae
ggagaggattaccaactcac

SEQ ID NO: 5617 - DNA, 20 bp, Chlamydia pneumoniae
cacgtagccctacagaattg

SEQ ID NO: 5618 - DNA, 20 bp, Chlamydia pneumoniae
cctctaaagggtatgtgcgt

SEQ ID NO: 5619 - DNA, 20 bp, Chlamydia pneumoniae
ggtgctatcaatgcggtttg

SEQ ID NO: 5620 - DNA, 20 bp, Chlamydia pneumoniae
ggggtttcacgaacttcacg

SEQ ID NO: 5621 - DNA, 20 bp, Chlamydia pneumoniae
caaaccatgctttcgtagcg

SEQ ID NO: 5622 - DNA, 20 bp, Chlamydia pneumoniae
ctgagcagcgaaaacgattc

SEQ ID NO: 5623 - DNA, 20 bp, Chlamydia pneumoniae
gcagatcctgtttgaccaag

SEQ ID NO: 5624 - DNA, 20 bp, Chlamydia pneumoniae
caacgatcagcttagctcct

SEQ ID NO: 5625 - DNA, 20 bp, Chlamydia pneumoniae
gtcgtgactagcgtagctaa

SEQ ID NO: 5626 - DNA, 20 bp, Chlamydia pneumoniae
ccgcttggctctataacgaa

SEQ ID NO: 5627 - DNA, 20 bp, Chlamydia pneumoniae
ctgctgaggttcagcaaagt

SEQ ID NO: 5628 - DNA, 20 bp, Chlamydia pneumoniae
ccagataacgctgggaaaga

SEQ ID NO: 5629 - DNA, 20 bp, Chlamydia pneumoniae
ggtccaatctgcctctaaag

SEQ ID NO: 5630 - DNA, 20 bp, Chlamydia pneumoniae
cttctcttcgtagggcagtg

SEQ ID NO: 5631 - DNA, 20 bp, Chlamydia pneumoniae
cattcagggcaagaattccc

SEQ ID NO: 5632 - DNA, 20 bp, Chlamydia pneumoniae
aacacagcgaactcccgaga

SEQ ID NO: 5633 - DNA, 20 bp, Chlamydia pneumoniae
ttccaaaccgcactcactcc

SEQ ID NO: 5634 - DNA, 20 bp, Chlamydia pneumoniae
cccgctaaggagtgaataca

SEQ ID NO: 5635 - DNA, 20 bp, Chlamydia pneumoniae
aggaaccgtattggggtcct

SEQ ID NO: 5636 - DNA, 20 bp, Chlamydia pneumoniae
ctgcaagaaaatccccacct

SEQ ID NO: 5637 - DNA, 20 bp, Chlamydia pneumoniae
cgaggaactccattcacaag

SEQ ID NO: 5638 - DNA, 20 bp, Chlamydia pneumoniae
ggatccgcagacctcttcta

SEQ ID NO: 5639 - DNA, 20 bp, Chlamydia pneumoniae
catggacgcacccatccgaa

SEQ ID NO: 5640 - DNA, 20 bp, Chlamydia pneumoniae
cagacagtaactggccttct

SEQ ID NO: 5641 - DNA, 20 bp, Chlamydia pneumoniae
cttggggattctgaagcaca

SEQ ID NO: 5642 - DNA, 20 bp, Chlamydia pneumoniae
agagactcaccaagctctac

SEQ ID NO: 5643 - DNA, 20 bp, Chlamydia pneumoniae
cgagacttcttggctattcc

SEQ ID NO: 5644 - DNA, 20 bp, Chlamydia pneumoniae
ccgaagttgcgaacatcact

SEQ ID NO: 5645 - DNA, 20 bp, Chlamydia pneumoniae
cctccgctcttttttagtag

SEQ ID NO: 5646 - DNA, 20 bp, Chlamydia pneumoniae
ctccgctcttttttagtaga

SEQ ID NO: 5647 - DNA, 20 bp, Chlamydia pneumoniae
gcgtgtgcctacatgtaaag

SEQ ID NO: 5648 - DNA, 20 bp, Chlamydia pneumoniae
gccgcacctacaatcacggt

SEQ ID NO: 5649 - DNA, 20 bp, Chlamydia pneumoniae
tctgcagaaactgccgatgc

SEQ ID NO: 5650 - DNA, 20 bp, Chlamydia pneumoniae
tgccaactgccatcagcaat

SEQ ID NO: 5651 - DNA, 20 bp, Chlamydia pneumoniae
gcatgagtctgagaatctgc

SEQ ID NO: 5652 - DNA, 20 bp, Chlamydia pneumoniae
tccgaggctcttaccatacc

SEQ ID NO: 5653 - DNA, 20 bp, Chlamydia pneumoniae
ccatgaacttgggaacggta

SEQ ID NO: 5654 - DNA, 20 bp, Chlamydia pneumoniae
gatcctggaattgctgtcag

SEQ ID NO: 5655 - DNA, 20 bp, Chlamydia pneumoniae
gctactttggcttactaagc

SEQ ID NO: 5656 - DNA, 20 bp, Chlamydia pneumoniae
cgtcaaatgacctagaacct

SEQ ID NO: 5657 - DNA, 20 bp, Chlamydia pneumoniae
tgttcaccgtccttccagta

SEQ ID NO: 5658 - DNA, 20 bp, Chlamydia pneumoniae
tcctcctagagtgccgagat

SEQ ID NO: 5659 - DNA, 20 bp, Chlamydia pneumoniae
ggctgtcaaatctgtagcga

SEQ ID NO: 5660 - DNA, 20 bp, Chlamydia pneumoniae
gcgtctgtgttgtaagaacg

SEQ ID NO: 5661 - DNA, 20 bp, Chlamydia pneumoniae
ggggaaagacaactctctca

SEQ ID NO: 5662 - DNA, 20 bp, Chlamydia pneumoniae
gtccacaacagcaaatggga

SEQ ID NO: 5663 - DNA, 20 bp, Chlamydia pneumoniae
catgggtgctgacgtttttc

SEQ ID NO: 5664 - DNA, 20 bp, Chlamydia pneumoniae
ggattctgaggaatagaggg

SEQ ID NO: 5665 - DNA, 20 bp, Chlamydia pneumoniae
gatgctgacaaagagggctt

SEQ ID NO: 5666 - DNA, 20 bp, Chlamydia pneumoniae
ggaggcactatgaagagcaa

SEQ ID NO: 5667 - DNA, 20 bp, Chlamydia pneumoniae
gattccgtttcccctcaggc

SEQ ID NO: 5668 - DNA, 20 bp, Chlamydia pneumoniae
gcaagcttgcaaagaacagc

SEQ ID NO: 5669 - DNA, 20 bp, Chlamydia pneumoniae
agaggcgattgctcggctgt

SEQ ID NO: 5670 - DNA, 20 bp, Chlamydia pneumoniae
ggattctgcaagggcataga

SEQ ID NO: 5671 - DNA, 20 bp, Chlamydia pneumoniae
agggaaactccatttagggc

SEQ ID NO: 5672 - DNA, 20 bp, Chlamydia pneumoniae
cgctatcgtcaaggttgcat

SEQ ID NO: 5673 - DNA, 20 bp, Chlamydia pneumoniae
gctctgtactctttctgctg

SEQ ID NO: 5674 - DNA, 20 bp, Chlamydia pneumoniae
cttacccaacaagagcgttg

SEQ ID NO: 5675 - DNA, 20 bp, Chlamydia pneumoniae
ccgagataaccgagtgatta

SEQ ID NO: 5676 - DNA, 20 bp, Chlamydia pneumoniae
aggggaaagaaaaagcgagc

SEQ ID NO: 5677 - DNA, 20 bp, Chlamydia pneumoniae
gtccaggagaaggtgctttt

SEQ ID NO: 5678 - DNA, 20 bp, Chlamydia pneumoniae
ccttttggaattgcagaggg

SEQ ID NO: 5679 - DNA, 20 bp, Chlamydia pneumoniae
cttattggcgaggggatcct

SEQ ID NO: 5680 - DNA, 20 bp, Chlamydia pneumoniae
gtcgtcaccttagacgattc

SEQ ID NO: 5681 - DNA, 20 bp, Chlamydia pneumoniae
gcgacatatgcaaaccagtt

SEQ ID NO: 5682 - DNA, 20 bp, Chlamydia pneumoniae
ctccacacgtccagaaaaag

SEQ ID NO: 5683 - DNA, 20 bp, Chlamydia pneumoniae
ggtccaaggctgagaatcgt

SEQ ID NO: 5684 - DNA, 20 bp, Chlamydia pneumoniae
ctggcgctttggaacttgta

SEQ ID NO: 5685 - DNA, 20 bp, Chlamydia pneumoniae
aagtcgaatccgctcctgct

SEQ ID NO: 5686 - DNA, 20 bp, Chlamydia pneumoniae
gcaaatatcggagctgaagc

SEQ ID NO: 5687 - DNA, 20 bp, Chlamydia pneumoniae
tgactcacccagccttccta

SEQ ID NO: 5688 - DNA, 20 bp, Chlamydia pneumoniae
ggctcaagcagaagtcttga

SEQ ID NO: 5689 - DNA, 20 bp, Chlamydia pneumoniae
gcggtttctgttgccattac

SEQ ID NO: 5690 - DNA, 20 bp, Chlamydia pneumoniae
ggaggtgctgcttccaaagc

SEQ ID NO: 5691 - DNA, 20 bp, Chlamydia pneumoniae
ctctattgaagaggcgagca

SEQ ID NO: 5692 - DNA, 20 bp, Chlamydia pneumoniae
aaatgggtcacggttggggt

SEQ ID NO: 5693 - DNA, 20 bp, Chlamydia pneumoniae
cctgctaccaccaattgcat

SEQ ID NO: 5694 - DNA, 20 bp, Chlamydia pneumoniae
gctcagacatttgccagtct

SEQ ID NO: 5695 - DNA, 20 bp, Chlamydia pneumoniae
cgtccccaaccttcttagaa

SEQ ID NO: 5696 - DNA, 20 bp, Chlamydia pneumoniae
ctacagcaacccgaagaatc

SEQ ID NO: 5697 - DNA, 20 bp, Chlamydia pneumoniae
ccatttgggacttaggtcct

SEQ ID NO: 5698 - DNA, 20 bp, Chlamydia pneumoniae
cgttaaatttccgagccagc

SEQ ID NO: 5699 - DNA, 20 bp, Chlamydia pneumoniae
caatcgcttcatcatgcagg

SEQ ID NO: 5700 - DNA, 20 bp, Chlamydia pneumoniae
gcaacaacatcctgagtgag

SEQ ID NO: 5701 - DNA, 20 bp, Chlamydia pneumoniae
ccagtgaactcgatttcacg

SEQ ID NO: 5702 - DNA, 20 bp, Chlamydia pneumoniae
ctcggcactcaaagaaatcc

SEQ ID NO: 5703 - DNA, 20 bp, Chlamydia pneumoniae
gattggtatgcgcatctacg

SEQ ID NO: 5704 - DNA, 20 bp, Chlamydia pneumoniae
tccttccacagagcttcatc

SEQ ID NO: 5705 - DNA, 20 bp, Chlamydia pneumoniae
cactagctgctaaagcctga

SEQ ID NO: 5706 - DNA, 20 bp, Chlamydia pneumoniae
ccagtgaactcgatttcacg

SEQ ID NO: 5707 - DNA, 20 bp, Chlamydia pneumoniae
gtacccccggcccaagacac

SEQ ID NO: 5708 - DNA, 20 bp, Chlamydia pneumoniae
gctgtagagctgctgtaagc

SEQ ID NO: 5709 - DNA, 20 bp, Chlamydia pneumoniae
tatgcggagagacagtcgct

SEQ ID NO: 5710 - DNA, 20 bp, Chlamydia pneumoniae
agggcttccaaatatcctcg

SEQ ID NO: 5711 - DNA, 20 bp, Chlamydia pneumoniae
ctgcttgtttctgatctggg

SEQ ID NO: 5712 - DNA, 20 bp, Chlamydia pneumoniae
cagagcgtaggaggaggagg

SEQ ID NO: 5713 - DNA, 20 bp, Chlamydia pneumoniae
aggctcggctttcttcgata

SEQ ID NO: 5714 - DNA, 20 bp, Chlamydia pneumoniae
gaagatccccccgtggcata

SEQ ID NO: 5715 - DNA, 20 bp, Chlamydia pneumoniae
ttcccaaatgccatcgcgca

SEQ ID NO: 5716 - DNA, 20 bp, Chlamydia pneumoniae
gccatttgctgacgcatctt

SEQ ID NO: 5717 - DNA, 20 bp, Chlamydia pneumoniae
tgtgaggacgattctttgga

SEQ ID NO: 5718 - DNA, 20 bp, Chlamydia pneumoniae
ggctcctcgtaagatgaaga

SEQ ID NO: 5719 - DNA, 20 bp, Chlamydia pneumoniae
gagggcttcaacattttgcc

SEQ ID NO: 5720 - DNA, 20 bp, Chlamydia pneumoniae
gctttggagtgactttgcct

SEQ ID NO: 5721 - DNA, 20 bp, Chlamydia pneumoniae
gtgccccgatttggattact

SEQ ID NO: 5722 - DNA, 20 bp, Chlamydia pneumoniae
cgcaagctcgatgagaaaga

SEQ ID NO: 5723 - DNA, 20 bp, Chlamydia pneumoniae
cgttcttgtagcgatgcaga

SEQ ID NO: 5724 - DNA, 20 bp, Chlamydia pneumoniae
gagggcttcaacattttgcc

SEQ ID NO: 5725 - DNA, 20 bp, Chlamydia pneumoniae
cgcaaggaaatcgaagccaa

SEQ ID NO: 5726 - DNA, 20 bp, Chlamydia pneumoniae
gatgcgctcacttacgaatc

SEQ ID NO: 5727 - DNA, 20 bp, Chlamydia pneumoniae
gaccatctgtcagatggaag

SEQ ID NO: 5728 - DNA, 20 bp, Chlamydia pneumoniae
gccgtgttagcatttttcgc

SEQ ID NO: 5729 - DNA, 20 bp, Chlamydia pneumoniae
cgagcatatatcgtcgagca

SEQ ID NO: 5730 - DNA, 20 bp, Chlamydia pneumoniae
ctgcctccgactttgtaatc

SEQ ID NO: 5731 - DNA, 20 bp, Chlamydia pneumoniae
caggtcctgtaaagatcgct

SEQ ID NO: 5732 - DNA, 20 bp, Chlamydia pneumoniae
ggtcatgttgctcacttcgt

SEQ ID NO: 5733 - DNA, 20 bp, Chlamydia pneumoniae
ctcatcccgaagaaatccct

SEQ ID NO: 5734 - DNA, 20 bp, Chlamydia pneumoniae
ctctctgtcaatcccaaaga

SEQ ID NO: 5735 - DNA, 20 bp, Chlamydia pneumoniae
gtcgatgcctcagtacagat

SEQ ID NO: 5736 - DNA, 20 bp, Chlamydia pneumoniae
gcctatgttgcagagacaga

SEQ ID NO: 5737 - DNA, 20 bp, Chlamydia pneumoniae
cggttccgtcagcacaaatc

SEQ ID NO: 5738 - DNA, 20 bp, Chlamydia pneumoniae
gcatatatcgtcgagcagac

SEQ ID NO: 5739 - DNA, 20 bp, Chlamydia pneumoniae
acaccatgccgagaggtatg

SEQ ID NO: 5740 - DNA, 20 bp, Chlamydia pneumoniae
gtctcctttgggtcatttgg

SEQ ID NO: 5741 - DNA, 20 bp, Chlamydia pneumoniae
gaggaaatgtctgggcttct

SEQ ID NO: 5742 - DNA, 20 bp, Chlamydia pneumoniae
gtcttgttccttccgagctt

SEQ ID NO: 5743 - DNA, 20 bp, Chlamydia pneumoniae
caccaacagtggtatgatag

SEQ ID NO: 5744 - DNA, 20 bp, Chlamydia pneumoniae
caacaaaggtagagagcttc

SEQ ID NO: 5745 - DNA, 20 bp, Chlamydia pneumoniae
gtcaaaatgtgctcggacag

SEQ ID NO: 5746 - DNA, 20 bp, Chlamydia pneumoniae
cctccccttttgtcctaagt

SEQ ID NO: 5747 - DNA, 20 bp, Chlamydia pneumoniae
gaaagaactggggttgaagc

SEQ ID NO: 5748 - DNA, 20 bp, Chlamydia pneumoniae
cccctagaactaagttcaac

SEQ ID NO: 5749 - DNA, 20 bp, Chlamydia pneumoniae
ccacccagaaattgctatgg

SEQ ID NO: 5750 - DNA, 20 bp, Chlamydia pneumoniae
gcatctgatggttttgctgc

SEQ ID NO: 5751 - DNA, 20 bp, Chlamydia pneumoniae
gctagcaagcctatgcctaa

SEQ ID NO: 5752 - DNA, 20 bp, Chlamydia pneumoniae
gcatttatgaaggggggttc

SEQ ID NO: 5753 - DNA, 20 bp, Chlamydia pneumoniae
gggaactcccatagagaaca

SEQ ID NO: 5754 - DNA, 20 bp, Chlamydia pneumoniae
cgacctcttaggtcgctaaa

SEQ ID NO: 5755 - DNA, 20 bp, Chlamydia pneumoniae
gctacctcctgctgatatct

SEQ ID NO: 5756 - DNA, 20 bp, Chlamydia pneumoniae
cacttgaagagcgcatccat

SEQ ID NO: 5757 - DNA, 20 bp, Chlamydia pneumoniae
aggggaaagccgttgttggc

SEQ ID NO: 5758 - DNA, 20 bp, Chlamydia pneumoniae
gcgaccttgcaaagagagaa

SEQ ID NO: 5759 - DNA, 20 bp, Chlamydia pneumoniae
cgtcactcctggggatttag

SEQ ID NO: 5760 - DNA, 20 bp, Chlamydia pneumoniae
agcgtgtttacctccgattc

SEQ ID NO: 5761 - DNA, 20 bp, Chlamydia pneumoniae
cggtgagtgttgtctccacc

SEQ ID NO: 5762 - DNA, 20 bp, Chlamydia pneumoniae
ggattgcaccctttacacga

SEQ ID NO: 5763 - DNA, 20 bp, Chlamydia pneumoniae
aagcccctccgctgctgaaa

SEQ ID NO: 5764 - DNA, 20 bp, Chlamydia pneumoniae
gtactcttatccccacctat

SEQ ID NO: 5765 - DNA, 20 bp, Chlamydia pneumoniae
gggatgctttctggcaaaga

SEQ ID NO: 5766 - DNA, 20 bp, Chlamydia pneumoniae
cacgacagtattgtcctgct

SEQ ID NO: 5767 - DNA, 20 bp, Chlamydia pneumoniae
tgccactcctccaggggaag

SEQ ID NO: 5768 - DNA, 20 bp, Chlamydia pneumoniae
caagaggctggaaaaacctc

SEQ ID NO: 5769 - DNA, 20 bp, Chlamydia pneumoniae
tcgagtacagtaaccgtccg

SEQ ID NO: 5770 - DNA, 20 bp, Chlamydia pneumoniae
gcttcttccctagcttagag

SEQ ID NO: 5771 - DNA, 20 bp, Chlamydia pneumoniae
gccttgcacgctgttaaaca

SEQ ID NO: 5772 - DNA, 20 bp, Chlamydia pneumoniae
tgctgttctgcaagcgccca

SEQ ID NO: 5773 - DNA, 20 bp, Chlamydia pneumoniae
ccaaactcagatgctgtacc

SEQ ID NO: 5774 - DNA, 20 bp, Chlamydia pneumoniae
gagaggaaccaaagaagcgt

SEQ ID NO: 5775 - DNA, 20 bp, Chlamydia pneumoniae
acatggagaccgcctacgat

SEQ ID NO: 5776 - DNA, 20 bp, Chlamydia pneumoniae
cgcccctaaggattttccta

SEQ ID NO: 5777 - DNA, 20 bp, Chlamydia pneumoniae
cctacttttacaacccttag

SEQ ID NO: 5778 - DNA, 20 bp, Chlamydia pneumoniae
cttggcgatctactcagaga

SEQ ID NO: 5779 - DNA, 20 bp, Chlamydia pneumoniae
atgtcgcccgtgcagaacga

SEQ ID NO: 5780 - DNA, 20 bp, Chlamydia pneumoniae
cgcagaagaaaacgtcaagt

SEQ ID NO: 5781 - DNA, 20 bp, Chlamydia pneumoniae
gaactgttggcttcaactcc

SEQ ID NO: 5782 - DNA, 20 bp, Chlamydia pneumoniae
gcaggttatgtcggtgaaga

SEQ ID NO: 5783 - DNA, 20 bp, Chlamydia pneumoniae
cctcccctgaaattcaatcc

SEQ ID NO: 5784 - DNA, 20 bp, Chlamydia pneumoniae
agacatccaactccaagcag

SEQ ID NO: 5785 - DNA, 20 bp, Chlamydia pneumoniae
gtagtctctccaatgagcag

SEQ ID NO: 5786 - DNA, 20 bp, Chlamydia pneumoniae
tggtgaaagggccatggata

SEQ ID NO: 5787 - DNA, 20 bp, Chlamydia pneumoniae
gccccctgctcaaaaagttt

SEQ ID NO: 5788 - DNA, 20 bp, Chlamydia pneumoniae
cggctgacctatagcaaagc

SEQ ID NO: 5789 - DNA, 20 bp, Chlamydia pneumoniae
cgttgatctcgtgatccgtt

SEQ ID NO: 5790 - DNA, 20 bp, Chlamydia pneumoniae
gctcgtcaactacaagcaga

SEQ ID NO: 5791 - DNA, 20 bp, Chlamydia pneumoniae
ggaggcatcaaatacgcaga

SEQ ID NO: 5792 - DNA, 20 bp, Chlamydia pneumoniae
cacttccaggattccgcaaa

SEQ ID NO: 5793 - DNA, 20 bp, Chlamydia pneumoniae
cctcttccaacatcttacgc

SEQ ID NO: 5794 - DNA, 20 bp, Chlamydia pneumoniae
ctcctctggaataagagtgg

SEQ ID NO: 5795 - DNA, 20 bp, Chlamydia pneumoniae
ctgcaccacaggagcaattt

SEQ ID NO: 5796 - DNA, 20 bp, Chlamydia pneumoniae
ggatacaacctcatcatcag

SEQ ID NO: 5797 - DNA, 20 bp, Chlamydia pneumoniae
gccctgagattttgccatgt

SEQ ID NO: 5798 - DNA, 20 bp, Chlamydia pneumoniae
aagcactgcatgcgtctgtg

SEQ ID NO: 5799 - DNA, 20 bp, Chlamydia pneumoniae
gcagtcaaggcaacattcgt

SEQ ID NO: 5800 - DNA, 20 bp, Chlamydia pneumoniae
agcgacatcatcagcagacg

SEQ ID NO: 5801 - DNA, 20 bp, Chlamydia pneumoniae
cttgggcgggacgaagtgcc

SEQ ID NO: 5802 - DNA, 20 bp, Chlamydia pneumoniae
gagcgctgcaagaaagttcg

SEQ ID NO: 5803 - DNA, 20 bp, Chlamydia pneumoniae
cctcatacgtagcattaggg

SEQ ID NO: 5804 - DNA, 20 bp, Chlamydia pneumoniae
cacagaaaggaagcatggca

SEQ ID NO: 5805 - DNA, 20 bp, Chlamydia pneumoniae
cccatccaaagccgtaatag

SEQ ID NO: 5806 - DNA, 20 bp, Chlamydia pneumoniae
gcaagttccgtacccgtatt

SEQ ID NO: 5807 - DNA, 20 bp, Chlamydia pneumoniae
gaaaccctgcagctccagta

SEQ ID NO: 5808 - DNA, 20 bp, Chlamydia pneumoniae
cttccctatgcatccgtatc

SEQ ID NO: 5809 - DNA, 20 bp, Chlamydia pneumoniae
aagggatatcctgttgtggc

SEQ ID NO: 5810 - DNA, 20 bp, Chlamydia pneumoniae
gggaatctatcgcgttctct

SEQ ID NO: 5811 - DNA, 20 bp, Chlamydia pneumoniae
cgtgctgcaagtaaacttgc

SEQ ID NO: 5812 - DNA, 20 bp, Chlamydia pneumoniae
gagtgctttgctcccctaaa

SEQ ID NO: 5813 - DNA, 20 bp, Chlamydia pneumoniae
ccataacagctctgtatgcg

SEQ ID NO: 5814 - DNA, 20 bp, Chlamydia pneumoniae
cacctggaacgttatgagca

SEQ ID NO: 5815 - DNA, 20 bp, Chlamydia pneumoniae
ccttgggatacagaacctac

SEQ ID NO: 5816 - DNA, 20 bp, Chlamydia pneumoniae
cttccccatcattatgcagc

SEQ ID NO: 5817 - DNA, 20 bp, Chlamydia pneumoniae
ccctttcgctcgtttacaga

SEQ ID NO: 5818 - DNA, 20 bp, Chlamydia pneumoniae
ctcatccacatgatccttgg

SEQ ID NO: 5819 - DNA, 20 bp, Chlamydia pneumoniae
gaggctgtctgcaatcttgt

SEQ ID NO: 5820 - DNA, 20 bp, Chlamydia pneumoniae
cgctccaaagacatacgaca

SEQ ID NO: 5821 - DNA, 20 bp, Chlamydia pneumoniae
gaagctctcactcacgaaca

SEQ ID NO: 5822 - DNA, 20 bp, Chlamydia pneumoniae
gcaagacacgcttatgagag

SEQ ID NO: 5823 - DNA, 20 bp, Chlamydia pneumoniae
ccctacctctagaaccaatg

SEQ ID NO: 5824 - DNA, 20 bp, Chlamydia pneumoniae
cctctgcatctctctgtcat

SEQ ID NO: 5825 - DNA, 20 bp, Chlamydia pneumoniae
ggggggatcttcattcgtaa

SEQ ID NO: 5826 - DNA, 20 bp, Chlamydia pneumoniae
ggctttcatttcacgtgttc

SEQ ID NO: 5827 - DNA, 20 bp, Chlamydia pneumoniae
ccccggctccgcgttaaaat

SEQ ID NO: 5828 - DNA, 20 bp, Chlamydia pneumoniae
ccttccatctccaccagcaa

SEQ ID NO: 5829 - DNA, 20 bp, Chlamydia pneumoniae
tgaacagaggttcctcccac

SEQ ID NO: 5830 - DNA, 20 bp, Chlamydia pneumoniae
aaacagccgaacagttcgga

SEQ ID NO: 5831 - DNA, 20 bp, Chlamydia pneumoniae
cccttcaagagattcttggc

SEQ ID NO: 5832 - DNA, 20 bp, Chlamydia pneumoniae
tcacacttccttcgagaagc

SEQ ID NO: 5833 - DNA, 20 bp, Chlamydia pneumoniae
cgctgtaggatccattgaag

SEQ ID NO: 5834 - DNA, 20 bp, Chlamydia pneumoniae
cgtcttcttcgcctacaagt

SEQ ID NO: 5835 - DNA, 20 bp, Chlamydia pneumoniae
aatgccagcagcgaggagtt

SEQ ID NO: 5836 - DNA, 20 bp, Chlamydia pneumoniae
cttcccgatagcttagctac

SEQ ID NO: 5837 - DNA, 20 bp, Chlamydia pneumoniae
ccctcccttggatcattcaa

SEQ ID NO: 5838 - DNA, 20 bp, Chlamydia pneumoniae
ctgtggagttcttccagaga

SEQ ID NO: 5839 - DNA, 20 bp, Chlamydia pneumoniae
cagtgctgaaaatacagcgg

SEQ ID NO: 5840 - DNA, 20 bp, Chlamydia pneumoniae
ttgttctcctgcacgactcc

SEQ ID NO: 5841 - DNA, 20 bp, Chlamydia pneumoniae
caggggtcttttctgctctt

SEQ ID NO: 5842 - DNA, 20 bp, Chlamydia pneumoniae
cccatcctagagcgaaatgc

SEQ ID NO: 5843 - DNA, 20 bp, Chlamydia pneumoniae
ggcggtgtgttttagatcgt

SEQ ID NO: 5844 - DNA, 20 bp, Chlamydia pneumoniae
gacggagaaatccttcatgg

SEQ ID NO: 5845 - DNA, 20 bp, Chlamydia pneumoniae
gctgcgtgcactccgtgctt

SEQ ID NO: 5846 - DNA, 20 bp, Chlamydia pneumoniae
ctgttccgattctaccctac

SEQ ID NO: 5847 - DNA, 20 bp, Chlamydia pneumoniae
ggggggctgtgattctaccc

SEQ ID NO: 5848 - DNA, 20 bp, Chlamydia pneumoniae
tggttgccaggacaaaaagc

SEQ ID NO: 5849 - DNA, 20 bp, Chlamydia pneumoniae
gatggggtagattctgtgag

SEQ ID NO: 5850 - DNA, 20 bp, Chlamydia pneumoniae
ggatcaggatcaacaagagc

SEQ ID NO: 5851 - DNA, 20 bp, Chlamydia pneumoniae
cgggaaatcccatagctaag

SEQ ID NO: 5852 - DNA, 20 bp, Chlamydia pneumoniae
gctggagaagaaacgtcatc

SEQ ID NO: 5853 - DNA, 20 bp, Chlamydia pneumoniae
tcgtggtcttcccagtttag

SEQ ID NO: 5854 - DNA, 20 bp, Chlamydia pneumoniae
cgcatgcaacaatagcatcg

SEQ ID NO: 5855 - DNA, 20 bp, Chlamydia pneumoniae
cagggaacaactactcaaac

SEQ ID NO: 5856 - DNA, 20 bp, Chlamydia pneumoniae
ggatctacggtaagtccaga

SEQ ID NO: 5857 - DNA, 20 bp, Chlamydia pneumoniae
ccttctatcaaggcagggtt

SEQ ID NO: 5858 - DNA, 20 bp, Chlamydia pneumoniae
gatccagggaacaactactc

SEQ ID NO: 5859 - DNA, 20 bp, Chlamydia pneumoniae
ctcgtcttcctgggatcata

SEQ ID NO: 5860 - DNA, 20 bp, Chlamydia pneumoniae
gtggaactgtaaaccgcgta

SEQ ID NO: 5861 - DNA, 20 bp, Chlamydia pneumoniae
tgcggaagctatcggggttt

SEQ ID NO: 5862 - DNA, 20 bp, Chlamydia pneumoniae
cctgcacagaaggctgtcat

SEQ ID NO: 5863 - DNA, 20 bp, Chlamydia pneumoniae
cgagcgagtgaacttcttca

SEQ ID NO: 5864 - DNA, 20 bp, Chlamydia pneumoniae
gctccttcggcaagattagt

SEQ ID NO: 5865 - DNA, 20 bp, Chlamydia pneumoniae
gatcctttatttgctcaggc

SEQ ID NO: 5866 - DNA, 20 bp, Chlamydia pneumoniae
gcgggccaagaaatttgcta

SEQ ID NO: 5867 - DNA, 20 bp, Chlamydia pneumoniae
gagctgtagggattcatctg

SEQ ID NO: 5868 - DNA, 20 bp, Chlamydia pneumoniae
cgtcaatctcaacgtcctga

SEQ ID NO: 5869 - DNA, 20 bp, Chlamydia pneumoniae
gctgagctagagagaaaagc

SEQ ID NO: 5870 - DNA, 20 bp, Chlamydia pneumoniae
gtgattccttctttccatgc

SEQ ID NO: 5871 - DNA, 20 bp, Chlamydia pneumoniae
ctccccttttgttctgcgat

SEQ ID NO: 5872 - DNA, 20 bp, Chlamydia pneumoniae
ctttgcggcaggcattgctt

SEQ ID NO: 5873 - DNA, 20 bp, Chlamydia pneumoniae
ccttttccccatctatcctc

SEQ ID NO: 5874 - DNA, 20 bp, Chlamydia pneumoniae
ccctgtcctggttttctatt

SEQ ID NO: 5875 - DNA, 20 bp, Chlamydia pneumoniae
cccatgatgtgacgggcggt

SEQ ID NO: 5876 - DNA, 20 bp, Chlamydia pneumoniae
ctcggctatgcttttggcaa

SEQ ID NO: 5877 - DNA, 20 bp, Chlamydia pneumoniae
gagattcattccgcttccca

SEQ ID NO: 5878 - DNA, 20 bp, Chlamydia pneumoniae
ggatccgtaaacgagatcca

SEQ ID NO: 5879 - DNA, 20 bp, Chlamydia pneumoniae
cctgggggctacttacaaat

SEQ ID NO: 5880 - DNA, 20 bp, Chlamydia pneumoniae
tcttggtgactatggggtcg

SEQ ID NO: 5881 - DNA, 20 bp, Chlamydia pneumoniae
ctctgggggatatcgcataa

SEQ ID NO: 5882 - DNA, 20 bp, Chlamydia pneumoniae
acggtcatggaaactcctcc

SEQ ID NO: 5883 - DNA, 20 bp, Chlamydia pneumoniae
cctttagaaacggaccgttc

SEQ ID NO: 5884 - DNA, 20 bp, Chlamydia pneumoniae
cccattgattccgaagaagc

SEQ ID NO: 5885 - DNA, 20 bp, Chlamydia pneumoniae
cttgcaggtgtgatccttct

SEQ ID NO: 5886 - DNA, 20 bp, Chlamydia pneumoniae
ccgtgagcacacggtaattt

SEQ ID NO: 5887 - DNA, 20 bp, Chlamydia pneumoniae
ctgctgcagctaaaactagc

SEQ ID NO: 5888 - DNA, 20 bp, Chlamydia pneumoniae
gcgcggacctaatctctggg

SEQ ID NO: 5889 - DNA, 20 bp, Chlamydia pneumoniae
cccaaatcctctcttaaagt

SEQ ID NO: 5890 - DNA, 20 bp, Chlamydia pneumoniae
gatttcgtttagagggtggg

SEQ ID NO: 5891 - DNA, 20 bp, Chlamydia pneumoniae
gcgctctcgtatttcccttt

SEQ ID NO: 5892 - DNA, 20 bp, Chlamydia pneumoniae
cccaaatcctctcttaaagt

SEQ ID NO: 5893 - DNA, 20 bp, Chlamydia pneumoniae
ttgtgattccggcttcatcc

SEQ ID NO: 5894 - DNA, 20 bp, Chlamydia pneumoniae
cgatagcagctctctcagaa

SEQ ID NO: 5895 - DNA, 20 bp, Chlamydia pneumoniae
gccaatcgcatgaggaatct

SEQ ID NO: 5896 - DNA, 20 bp, Chlamydia pneumoniae
ccttccatggggactttgat

SEQ ID NO: 5897 - DNA, 20 bp, Chlamydia pneumoniae
gctcttctagcgttccaaag

SEQ ID NO: 5898 - DNA, 20 bp, Chlamydia pneumoniae
gctgatgtgcacgtttacga

SEQ ID NO: 5899 - DNA, 20 bp, Chlamydia pneumoniae
ctcctggtccgcgcatacaa

SEQ ID NO: 5900 - DNA, 20 bp, Chlamydia pneumoniae
ccgatacactccatcctgat

SEQ ID NO: 5901 - DNA, 20 bp, Chlamydia pneumoniae
agcgctatcccatgattgac

SEQ ID NO: 5902 - DNA, 20 bp, Chlamydia pneumoniae
gctctatctccaactcctga

SEQ ID NO: 5903 - DNA, 20 bp, Chlamydia pneumoniae
cgcactcacttttcagtgac

SEQ ID NO: 5904 - DNA, 20 bp, Chlamydia pneumoniae
gcagtacgcacaatgtttgc

SEQ ID NO: 5905 - DNA, 20 bp, Chlamydia pneumoniae
acttctggagcatggcaaac

SEQ ID NO: 5906 - DNA, 20 bp, Chlamydia pneumoniae
gggagaatgagcctgtagat

SEQ ID NO: 5907 - DNA, 20 bp, Chlamydia pneumoniae
ctctcctataatggcaagga

SEQ ID NO: 5908 - DNA, 20 bp, Chlamydia pneumoniae
ccgagctcctctttgatcgt

SEQ ID NO: 5909 - DNA, 20 bp, Chlamydia pneumoniae
ccaagttccatctgagcttg

SEQ ID NO: 5910 - DNA, 20 bp, Chlamydia pneumoniae
cacaatgatccctcgatcct

SEQ ID NO: 5911 - DNA, 20 bp, Chlamydia pneumoniae
cctgtgtgctttaatcctgc

SEQ ID NO: 5912 - DNA, 20 bp, Chlamydia pneumoniae
ccctggagaccttctatgta

SEQ ID NO: 5913 - DNA, 20 bp, Chlamydia pneumoniae
gctcctgagtatccgaatct

SEQ ID NO: 5914 - DNA, 20 bp, Chlamydia pneumoniae
ctgcccattggagcgttatt

SEQ ID NO: 5915 - DNA, 20 bp, Chlamydia pneumoniae
tgcggacacttcgccctctt

SEQ ID NO: 5916 - DNA, 20 bp, Chlamydia pneumoniae
caagtagggctgaccatcaa

SEQ ID NO: 5917 - DNA, 20 bp, Chlamydia pneumoniae
gcgattctcgttctctcttc

SEQ ID NO: 5918 - DNA, 20 bp, Chlamydia pneumoniae
ttgaggagtttctacgcgct

SEQ ID NO: 5919 - DNA, 20 bp, Chlamydia pneumoniae
ttgcaagggctcttgcaagt

SEQ ID NO: 5920 - DNA, 20 bp, Chlamydia pneumoniae
caattgtgcggacacttcgc

SEQ ID NO: 5921 - DNA, 20 bp, Chlamydia pneumoniae
ctccatcactaaggagagag

SEQ ID NO: 5922 - DNA, 20 bp, Chlamydia pneumoniae
caagcctaggaatcagtgtg

SEQ ID NO: 5923 - DNA, 20 bp, Chlamydia pneumoniae
gcatcagagagacccaatct

SEQ ID NO: 5924 - DNA, 20 bp, Chlamydia pneumoniae
gtctctagaattatgcgcac

SEQ ID NO: 5925 - DNA, 20 bp, Chlamydia pneumoniae
ccatgtccctgtttccgttt

SEQ ID NO: 5926 - DNA, 20 bp, Chlamydia pneumoniae
cgtaggaacctcggctttat

SEQ ID NO: 5927 - DNA, 20 bp, Chlamydia pneumoniae
attgtctgtcgacactcacc

SEQ ID NO: 5928 - DNA, 20 bp, Chlamydia pneumoniae
ccacggatgatacggtttga

SEQ ID NO: 5929 - DNA, 20 bp, Chlamydia pneumoniae
agataggtcacctggcggat

SEQ ID NO: 5930 - DNA, 20 bp, Chlamydia pneumoniae
ctgcgactacaggcttttct

SEQ ID NO: 5931 - DNA, 20 bp, Chlamydia pneumoniae
ccaaatcctatgaccaggtc

SEQ ID NO: 5932 - DNA, 20 bp, Chlamydia pneumoniae
ctgaaagcaacacaggactg

SEQ ID NO: 5933 - DNA, 20 bp, Chlamydia pneumoniae
gatactgaggagttcccttc

SEQ ID NO: 5934 - DNA, 20 bp, Chlamydia pneumoniae
agagtggtagctcccaaatc

SEQ ID NO: 5935 - DNA, 20 bp, Chlamydia pneumoniae
ccggcactatagacatctgt

SEQ ID NO: 5936 - DNA, 20 bp, Chlamydia pneumoniae
gagctataaacaacgacggc

SEQ ID NO: 5937 - DNA, 20 bp, Chlamydia pneumoniae
cgctctgcaagttctctaac

SEQ ID NO: 5938 - DNA, 20 bp, Chlamydia pneumoniae
ggaactgatgtgattgctga

SEQ ID NO: 5939 - DNA, 20 bp, Chlamydia pneumoniae
gtcgcattcaggagaagaag

SEQ ID NO: 5940 - DNA, 20 bp, Chlamydia pneumoniae
ttacagagcgtcttgcttcc

SEQ ID NO: 5941 - DNA, 20 bp, Chlamydia pneumoniae
gctttgggaacgatatccca

SEQ ID NO: 5942 - DNA, 20 bp, Chlamydia pneumoniae
ctctgaatctccctcagatt

SEQ ID NO: 5943 - DNA, 20 bp, Chlamydia pneumoniae
cctaatgtcggaagttctcg

SEQ ID NO: 5944 - DNA, 20 bp, Chlamydia pneumoniae
ctcccaagctctgaaccaat

SEQ ID NO: 5945 - DNA, 20 bp, Chlamydia pneumoniae
ggggttaggcatcgattatc

SEQ ID NO: 5946 - DNA, 20 bp, Chlamydia pneumoniae
ctgagacgatctctccatca

SEQ ID NO: 5947 - DNA, 20 bp, Chlamydia pneumoniae
ggtgtggggcttgacaaata

SEQ ID NO: 5948 - DNA, 20 bp, Chlamydia pneumoniae
cgcattttagctttgggcag

SEQ ID NO: 5949 - DNA, 20 bp, Chlamydia pneumoniae
gagaagagacctcagctaac

SEQ ID NO: 5950 - DNA, 20 bp, Chlamydia pneumoniae
ctgttaaggcttccctcatc

SEQ ID NO: 5951 - DNA, 20 bp, Chlamydia pneumoniae
cgataacacgacgcatacca

SEQ ID NO: 5952 - DNA, 20 bp, Chlamydia pneumoniae
gcatggcccgatcaaaatct

SEQ ID NO: 5953 - DNA, 20 bp, Chlamydia pneumoniae
gacaaagccatcacgatctc

SEQ ID NO: 5954 - DNA, 20 bp, Chlamydia pneumoniae
ccggtcagagtcgatacaaa

SEQ ID NO: 5955 - DNA, 20 bp, Chlamydia pneumoniae
acctccagcagctccaagac

SEQ ID NO: 5956 - DNA, 20 bp, Chlamydia pneumoniae
cctccacatgaagaggacta

SEQ ID NO: 5957 - DNA, 20 bp, Chlamydia pneumoniae
gggttccctctccttgaaaa

SEQ ID NO: 5958 - DNA, 20 bp, Chlamydia pneumoniae
gacacgacgtgcttgctttt

SEQ ID NO: 5959 - DNA, 20 bp, Chlamydia pneumoniae
cctctggatgtctgtgttct

SEQ ID NO: 5960 - DNA, 20 bp, Chlamydia pneumoniae
ggtgacttctttgcgaacga

SEQ ID NO: 5961 - DNA, 20 bp, Chlamydia pneumoniae
cgttcgtggagcatcattcc

SEQ ID NO: 5962 - DNA, 20 bp, Chlamydia pneumoniae
ctgtccaggcacagtattag

SEQ ID NO: 5963 - DNA, 20 bp, Chlamydia pneumoniae
tgattctcccgctcgtgctt

SEQ ID NO: 5964 - DNA, 20 bp, Chlamydia pneumoniae
gtcctactgccgtttgatga

SEQ ID NO: 5965 - DNA, 20 bp, Chlamydia pneumoniae
cgttgagtctgtagttacgg

SEQ ID NO: 5966 - DNA, 20 bp, Chlamydia pneumoniae
cgctcgtgcttgggatcacg

SEQ ID NO: 5967 - DNA, 20 bp, Chlamydia pneumoniae
ctatagatgcgggcatcatc

SEQ ID NO: 5968 - DNA, 20 bp, Chlamydia pneumoniae
tcaacttgcatacggtagcg

SEQ ID NO: 5969 - DNA, 20 bp, Chlamydia pneumoniae
cccacctaaggagacaaaac

SEQ ID NO: 5970 - DNA, 20 bp, Chlamydia pneumoniae
caccccaactctatcttcag

SEQ ID NO: 5971 - DNA, 20 bp, Chlamydia pneumoniae
gagcttatcctgtaacactg

SEQ ID NO: 5972 - DNA, 20 bp, Chlamydia pneumoniae
gaagaaggccctaccataag

SEQ ID NO: 5973 - DNA, 20 bp, Chlamydia pneumoniae
gctgctcatcccgcaaaaat

SEQ ID NO: 5974 - DNA, 20 bp, Chlamydia pneumoniae
gaactctgtgagtatcctcc

SEQ ID NO: 5975 - DNA, 20 bp, Chlamydia pneumoniae
cgaagtcatcgtaggctcta

SEQ ID NO: 5976 - DNA, 20 bp, Chlamydia pneumoniae
cgaagatcccctgctctatt

SEQ ID NO: 5977 - DNA, 20 bp, Chlamydia pneumoniae
gccgatcgtgtggttataca

SEQ ID NO: 5978 - DNA, 20 bp, Chlamydia pneumoniae
gtcttcgtgcagcacaacaa

SEQ ID NO: 5979 - DNA, 20 bp, Chlamydia pneumoniae
ccggagtttactcttgctca

SEQ ID NO: 5980 - DNA, 20 bp, Chlamydia pneumoniae
cgaaagggatcttctccatc

SEQ ID NO: 5981 - DNA, 20 bp, Chlamydia pneumoniae
gcgtcttgaaaacctgcttt

SEQ ID NO: 5982 - DNA, 20 bp, Chlamydia pneumoniae
ccggagtttactcttgctca

SEQ ID NO: 5983 - DNA, 20 bp, Chlamydia pneumoniae
cgagttcctatcctccagga

SEQ ID NO: 5984 - DNA, 20 bp, Chlamydia pneumoniae
cgacagcaaaacaagagtgg

SEQ ID NO: 5985 - DNA, 20 bp, Chlamydia pneumoniae
atctcaggaagaggctccag

SEQ ID NO: 5986 - DNA, 20 bp, Chlamydia pneumoniae
tctcttagaattcggtcctg

SEQ ID NO: 5987 - DNA, 20 bp, Chlamydia pneumoniae
cacggttgaacatcacttgg

SEQ ID NO: 5988 - DNA, 20 bp, Chlamydia pneumoniae
agaagatgggtagtcacagc

SEQ ID NO: 5989 - DNA, 20 bp, Chlamydia pneumoniae
ccaagagttctctttgacgg

SEQ ID NO: 5990 - DNA, 20 bp, Chlamydia pneumoniae
ggcacttttctaaagccgac

SEQ ID NO: 5991 - DNA, 20 bp, Chlamydia pneumoniae
gatactccacttccacacag

SEQ ID NO: 5992 - DNA, 20 bp, Chlamydia pneumoniae
tacacgcagccatataccga

SEQ ID NO: 5993 - DNA, 20 bp, Chlamydia pneumoniae
gggacttgtaggatgggtat

SEQ ID NO: 5994 - DNA, 20 bp, Chlamydia pneumoniae
gcgactcttgttgtatagtc

SEQ ID NO: 5995 - DNA, 20 bp, Chlamydia pneumoniae
ccagactgtcatctctcgaa

SEQ ID NO: 5996 - DNA, 20 bp, Chlamydia pneumoniae
gctcttcagcaagtcggtaa

SEQ ID NO: 5997 - DNA, 20 bp, Chlamydia pneumoniae
ctcatcgggagatcttcaag

SEQ ID NO: 5998 - DNA, 20 bp, Chlamydia pneumoniae
gggacttgtaggatgggtat

SEQ ID NO: 5999 - DNA, 20 bp, Chlamydia pneumoniae
cctcctccaatgagctctat

SEQ ID NO: 6000 - DNA, 20 bp, Chlamydia pneumoniae
ggaagaaagccgatgtcttc

SEQ ID NO: 6001 - DNA, 20 bp, Chlamydia pneumoniae
ggccacatgaagtcctgtat

SEQ ID NO: 6002 - DNA, 20 bp, Chlamydia pneumoniae
ctcatcgggagatcttcaag

SEQ ID NO: 6003 - DNA, 20 bp, Chlamydia pneumoniae
acttccttcatcaagctccc

SEQ ID NO: 6004 - DNA, 20 bp, Chlamydia pneumoniae
ctaccgctctgctagtaaag

SEQ ID NO: 6005 - DNA, 20 bp, Chlamydia pneumoniae
tgtgtcggctattgcactcc

SEQ ID NO: 6006 - DNA, 20 bp, Chlamydia pneumoniae
gcacatcgctttgcgattag

SEQ ID NO: 6007 - DNA, 20 bp, Chlamydia pneumoniae
gctgttgtagagtacctcct

SEQ ID NO: 6008 - DNA, 20 bp, Chlamydia pneumoniae
ccattgtccgcacgttgaaa

SEQ ID NO: 6009 - DNA, 20 bp, Chlamydia pneumoniae
ccctgctccaggaaaaattc

SEQ ID NO: 6010 - DNA, 20 bp, Chlamydia pneumoniae
ctggaggccttctctcttat

SEQ ID NO: 6011 - DNA, 20 bp, Chlamydia pneumoniae
acttacccccttgggagttt

SEQ ID NO: 6012 - DNA, 20 bp, Chlamydia pneumoniae
tctcaaggggaccggctcgt

SEQ ID NO: 6013 - DNA, 20 bp, Chlamydia pneumoniae
ctctcgccatctcctatctg

SEQ ID NO: 6014 - DNA, 20 bp, Chlamydia pneumoniae
cttgagctgccactgtacaa

SEQ ID NO: 6015 - DNA, 20 bp, Chlamydia pneumoniae
ggtcgctcagagaaaaagac

SEQ ID NO: 6016 - DNA, 20 bp, Chlamydia pneumoniae
gagagtaggtttccacagca

SEQ ID NO: 6017 - DNA, 20 bp, Chlamydia pneumoniae
ggaaacttcagcacatgcct

SEQ ID NO: 6018 - DNA, 20 bp, Chlamydia pneumoniae
ggagagaaaatgagaagtgc

SEQ ID NO: 6019 - DNA, 20 bp, Chlamydia pneumoniae
ctagtatccgcctctcggct

SEQ ID NO: 6020 - DNA, 20 bp, Chlamydia pneumoniae
gtagagatagtgcgatacgc

SEQ ID NO: 6021 - DNA, 20 bp, Chlamydia pneumoniae
gtgggcaattttccgagcaa

SEQ ID NO: 6022 - DNA, 20 bp, Chlamydia pneumoniae
ggaaacttcagcacatgcct

SEQ ID NO: 6023 - DNA, 20 bp, Chlamydia pneumoniae
cttcctgcgacttttgttcc

SEQ ID NO: 6024 - DNA, 20 bp, Chlamydia pneumoniae
ctgctcacaggattgttctt

SEQ ID NO: 6025 - DNA, 20 bp, Chlamydia pneumoniae
cgatccgcaaacttctgttc

SEQ ID NO: 6026 - DNA, 20 bp, Chlamydia pneumoniae
caattgctcgcatgatccat

SEQ ID NO: 6027 - DNA, 20 bp, Chlamydia pneumoniae
cgtttctctgcttttgcagc

SEQ ID NO: 6028 - DNA, 20 bp, Chlamydia pneumoniae
ggcacagttcctttagttcg

SEQ ID NO: 6029 - DNA, 20 bp, Chlamydia pneumoniae
ggacgatcttctacgagttc

SEQ ID NO: 6030 - DNA, 20 bp, Chlamydia pneumoniae
aaggagaagaaaaggactct

SEQ ID NO: 6031 - DNA, 20 bp, Chlamydia pneumoniae
gaaacgggaagaaacacctg

SEQ ID NO: 6032 - DNA, 20 bp, Chlamydia pneumoniae
ccacggctttaccgcttaaa

SEQ ID NO: 6033 - DNA, 20 bp, Chlamydia pneumoniae
gagcgtagagggctgtggct

SEQ ID NO: 6034 - DNA, 20 bp, Chlamydia pneumoniae
cataggcgccttcgtaaagt

SEQ ID NO: 6035 - DNA, 20 bp, Chlamydia pneumoniae
taggctatggatttgggagg

SEQ ID NO: 6036 - DNA, 20 bp, Chlamydia pneumoniae
ggcgagctcttttgattgct

SEQ ID NO: 6037 - DNA, 20 bp, Chlamydia pneumoniae
agagtatggaggcaggatca

SEQ ID NO: 6038 - DNA, 20 bp, Chlamydia pneumoniae
gcaatcctttcggaatctgc

SEQ ID NO: 6039 - DNA, 20 bp, Chlamydia pneumoniae
ggcgggactctagtaaaatg

SEQ ID NO: 6040 - DNA, 20 bp, Chlamydia pneumoniae
gagattcgagggggaaagca

SEQ ID NO: 6041 - DNA, 20 bp, Chlamydia pneumoniae
caagggtgtggatcgtgata

SEQ ID NO: 6042 - DNA, 20 bp, Chlamydia pneumoniae
gactccacatcctctctaac

SEQ ID NO: 6043 - DNA, 20 bp, Chlamydia pneumoniae
agctccgagaaacaaccatc

SEQ ID NO: 6044 - DNA, 20 bp, Chlamydia pneumoniae
ctggttttcttctcgtagag

SEQ ID NO: 6045 - DNA, 20 bp, Chlamydia pneumoniae
tctcctgaagagcttcttgc

SEQ ID NO: 6046 - DNA, 20 bp, Chlamydia pneumoniae
gcggcgcctattttcaaaga

SEQ ID NO: 6047 - DNA, 20 bp, Chlamydia pneumoniae
ctgcaaacgggatgctctta

SEQ ID NO: 6048 - DNA, 20 bp, Chlamydia pneumoniae
gacatgatgaactcggcgtt

SEQ ID NO: 6049 - DNA, 20 bp, Chlamydia pneumoniae
ctccgctctctaaagcaaag

SEQ ID NO: 6050 - DNA, 20 bp, Chlamydia pneumoniae
ctcttccaaagccgaatctg

SEQ ID NO: 6051 - DNA, 20 bp, Chlamydia pneumoniae
ccgggaagaaaagcttcttc

SEQ ID NO: 6052 - DNA, 20 bp, Chlamydia pneumoniae
gtcatcgagattgagaggga

SEQ ID NO: 6053 - DNA, 20 bp, Chlamydia pneumoniae
cgaacctacctcatcatgag

SEQ ID NO: 6054 - DNA, 20 bp, Chlamydia pneumoniae
gaaccaaggctttttgagga

SEQ ID NO: 6055 - DNA, 20 bp, Chlamydia pneumoniae
caaaagcaatgcctgctgac

SEQ ID NO: 6056 - DNA, 20 bp, Chlamydia pneumoniae
ggtcccctcccattaaatct

SEQ ID NO: 6057 - DNA, 20 bp, Chlamydia pneumoniae
ggcagagccatcttctaaag

SEQ ID NO: 6058 - DNA, 20 bp, Chlamydia pneumoniae
gcacgccttaccatgacatt

SEQ ID NO: 6059 - DNA, 20 bp, Chlamydia pneumoniae
ccaccagcataatcttcagc

SEQ ID NO: 6060 - DNA, 20 bp, Chlamydia pneumoniae
gagctgtgtaaggaatgtgc

SEQ ID NO: 6061 - DNA, 20 bp, Chlamydia pneumoniae
ggcacttcctcttctacagt

SEQ ID NO: 6062 - DNA, 20 bp, Chlamydia pneumoniae
gcagatccagaaaccaaagc

SEQ ID NO: 6063 - DNA, 20 bp, Chlamydia pneumoniae
gcagaaggatgtcagcatag

SEQ ID NO: 6064 - DNA, 20 bp, Chlamydia pneumoniae
cagaagaaactgctaccgct

SEQ ID NO: 6065 - DNA, 20 bp, Chlamydia pneumoniae
ctcccctgatccctacaaaa

SEQ ID NO: 6066 - DNA, 20 bp, Chlamydia pneumoniae
gactcgttcacaagttgctc

SEQ ID NO: 6067 - DNA, 20 bp, Chlamydia pneumoniae
cgctgctcaagaacatcaga

SEQ ID NO: 6068 - DNA, 20 bp, Chlamydia pneumoniae
ttaagagctctctaccgggt

SEQ ID NO: 6069 - DNA, 20 bp, Chlamydia pneumoniae
catccacatgtggatgagca

SEQ ID NO: 6070 - DNA, 20 bp, Chlamydia pneumoniae
cgggtatggccaataactga

SEQ ID NO: 6071 - DNA, 20 bp, Chlamydia pneumoniae
ccgccatagaaagcatgttc

SEQ ID NO: 6072 - DNA, 20 bp, Chlamydia pneumoniae
cgaagcatcttcactacagg

SEQ ID NO: 6073 - DNA, 20 bp, Chlamydia pneumoniae
gagacagcacctaaaaccac

SEQ ID NO: 6074 - DNA, 20 bp, Chlamydia pneumoniae
gacgagctttaacctccatc

SEQ ID NO: 6075 - DNA, 20 bp, Chlamydia pneumoniae
catcataggattgcgaggtc

SEQ ID NO: 6076 - DNA, 20 bp, Chlamydia pneumoniae
aagaaggcaaaggcctgagg

SEQ ID NO: 6077 - DNA, 20 bp, Chlamydia pneumoniae
caaaacctagagggccaagg

SEQ ID NO: 6078 - DNA, 20 bp, Chlamydia pneumoniae
cctgcactcgagaatcttgt

SEQ ID NO: 6079 - DNA, 20 bp, Chlamydia pneumoniae
gaaacaccacacccaccaaa

SEQ ID NO: 6080 - DNA, 20 bp, Chlamydia pneumoniae
ggccatagaaaaaagccagg

SEQ ID NO: 6081 - DNA, 20 bp, Chlamydia pneumoniae
gactgaaaatccccacaaag

SEQ ID NO: 6082 - DNA, 20 bp, Chlamydia pneumoniae
ccgagagcaactcctacaaa

SEQ ID NO: 6083 - DNA, 20 bp, Chlamydia pneumoniae
atgaagcagattttggtact

SEQ ID NO: 6084 - DNA, 20 bp, Chlamydia pneumoniae
caccacacccaccaaaaaga

SEQ ID NO: 6085 - DNA, 20 bp, Chlamydia pneumoniae
gcgacctcttcgatatccat

SEQ ID NO: 6086 - DNA, 20 bp, Chlamydia pneumoniae
agcaggtgcgggtatttcat

SEQ ID NO: 6087 - DNA, 20 bp, Chlamydia pneumoniae
cctgtgtgatgatgggagta

SEQ ID NO: 6088 - DNA, 20 bp, Chlamydia pneumoniae
agagcttagctacggcttgc

SEQ ID NO: 6089 - DNA, 20 bp, Chlamydia pneumoniae
ccccaagcacaagatcttca

SEQ ID NO: 6090 - DNA, 20 bp, Chlamydia pneumoniae
ggtcgcgcgacaccctgtag

SEQ ID NO: 6091 - DNA, 20 bp, Chlamydia pneumoniae
ccctccaatacctgcttcta

SEQ ID NO: 6092 - DNA, 20 bp, Chlamydia pneumoniae
ccacccttggctagttctta

SEQ ID NO: 6093 - DNA, 20 bp, Chlamydia pneumoniae
ggatagcttctggaatctcc

SEQ ID NO: 6094 - DNA, 20 bp, Chlamydia pneumoniae
cctgcttctagaacagttcg

SEQ ID NO: 6095 - DNA, 20 bp, Chlamydia pneumoniae
ctgtcgttgaaataggcacg

SEQ ID NO: 6096 - DNA, 20 bp, Chlamydia pneumoniae
cgaagttcttactgaagggg

SEQ ID NO: 6097 - DNA, 20 bp, Chlamydia pneumoniae
ggagctcctggttatcagtt

SEQ ID NO: 6098 - DNA, 20 bp, Chlamydia pneumoniae
cttaccgcaggtgaaaacta

SEQ ID NO: 6099 - DNA, 20 bp, Chlamydia pneumoniae
gtggtcggagtttccaaaag

SEQ ID NO: 6100 - DNA, 20 bp, Chlamydia pneumoniae
cacaggttctgctacctagt

SEQ ID NO: 6101 - DNA, 20 bp, Chlamydia pneumoniae
gctgctcaccaagttatcca

SEQ ID NO: 6102 - DNA, 20 bp, Chlamydia pneumoniae
catctgtgactaaagcgcca

SEQ ID NO: 6103 - DNA, 20 bp, Chlamydia pneumoniae
ctgctctgggaaacctatga

SEQ ID NO: 6104 - DNA, 20 bp, Chlamydia pneumoniae
tcccctattaggggaagcag

SEQ ID NO: 6105 - DNA, 20 bp, Chlamydia pneumoniae
ttagagcctcagagagccgt

SEQ ID NO: 6106 - DNA, 20 bp, Chlamydia pneumoniae
ctcagggttacgaagcttct

SEQ ID NO: 6107 - DNA, 20 bp, Chlamydia pneumoniae
gcagcgcaagaagttcttgt

SEQ ID NO: 6108 - DNA, 20 bp, Chlamydia pneumoniae
ccgttagaagtttgtgggca

SEQ ID NO: 6109 - DNA, 20 bp, Chlamydia pneumoniae
gacatcgcccctgttataga

SEQ ID NO: 6110 - DNA, 20 bp, Chlamydia pneumoniae
cctacaggtagtgttcacac

SEQ ID NO: 6111 - DNA, 20 bp, Chlamydia pneumoniae
gacaagaggactgcaaaaac

SEQ ID NO: 6112 - DNA, 20 bp, Chlamydia pneumoniae
ccaacttcgggtaggtctat

SEQ ID NO: 6113 - DNA, 20 bp, Chlamydia pneumoniae
caaggaactcgtgaggagtt

SEQ ID NO: 6114 - DNA, 20 bp, Chlamydia pneumoniae
cactagaaaatcaggactcc

SEQ ID NO: 6115 - DNA, 20 bp, Chlamydia pneumoniae
ctaaagagtgtccacatgcc

SEQ ID NO: 6116 - DNA, 20 bp, Chlamydia pneumoniae
cgttcgtcttcagacagttc

SEQ ID NO: 6117 - DNA, 20 bp, Chlamydia pneumoniae
cgttaccgtttccgcaggtc

SEQ ID NO: 6118 - DNA, 20 bp, Chlamydia pneumoniae
ggaacatagagaactccatc

SEQ ID NO: 6119 - DNA, 20 bp, Chlamydia pneumoniae
gggtctttcctttgcagctt

SEQ ID NO: 6120 - DNA, 20 bp, Chlamydia pneumoniae
caggtcgcatcaatgactgt

SEQ ID NO: 6121 - DNA, 20 bp, Chlamydia pneumoniae
gctaaggacctctttagcag

SEQ ID NO: 6122 - DNA, 20 bp, Chlamydia pneumoniae
gcaatcggaggggcacaaat

SEQ ID NO: 6123 - DNA, 20 bp, Chlamydia pneumoniae
cgtacgcgcttgctttaact

SEQ ID NO: 6124 - DNA, 20 bp, Chlamydia pneumoniae
ggcggggccatttttatgaa

SEQ ID NO: 6125 - DNA, 20 bp, Chlamydia pneumoniae
cttccctggacgagttcttt

SEQ ID NO: 6126 - DNA, 20 bp, Chlamydia pneumoniae
ctcgtagctttaaaccagac

SEQ ID NO: 6127 - DNA, 20 bp, Chlamydia pneumoniae
ccttaagatctgcaagtgcc

SEQ ID NO: 6128 - DNA, 20 bp, Chlamydia pneumoniae
ggctatcttagggtattagg

SEQ ID NO: 6129 - DNA, 20 bp, Chlamydia pneumoniae
tgcagtcaagtccgaaaacg

SEQ ID NO: 6130 - DNA, 20 bp, Chlamydia pneumoniae
agaagctaccgaacctgttg

SEQ ID NO: 6131 - DNA, 20 bp, Chlamydia pneumoniae
cacagctgatttcgagtaga

SEQ ID NO: 6132 - DNA, 20 bp, Chlamydia pneumoniae
gaagcaagaagcacaaggct

SEQ ID NO: 6133 - DNA, 20 bp, Chlamydia pneumoniae
gccatgactgcgttatgaac

SEQ ID NO: 6134 - DNA, 20 bp, Chlamydia pneumoniae
ctcgatggaaccaaaaaagt

SEQ ID NO: 6135 - DNA, 20 bp, Chlamydia pneumoniae
gaaaagaacgcaaatcccgc

SEQ ID NO: 6136 - DNA, 20 bp, Chlamydia pneumoniae
gacacaagtgccacaaagga

SEQ ID NO: 6137 - DNA, 20 bp, Chlamydia pneumoniae
ccaggtaagccatgcctatt

SEQ ID NO: 6138 - DNA, 20 bp, Chlamydia pneumoniae
gctgacgtatgctggcatga

SEQ ID NO: 6139 - DNA, 20 bp, Chlamydia pneumoniae
ctatcactactactccaggt

SEQ ID NO: 6140 - DNA, 20 bp, Chlamydia pneumoniae
gcttcctccagaaagagcaa

SEQ ID NO: 6141 - DNA, 20 bp, Chlamydia pneumoniae
cgcgcttccaccaatttatg

SEQ ID NO: 6142 - DNA, 20 bp, Chlamydia pneumoniae
caccaaaaaccacgccaaac

SEQ ID NO: 6143 - DNA, 20 bp, Chlamydia pneumoniae
ctgctaataaggcagcctca

SEQ ID NO: 6144 - DNA, 20 bp, Chlamydia pneumoniae
ggaaggcgatatcattgatg

SEQ ID NO: 6145 - DNA, 20 bp, Chlamydia pneumoniae
gcgctgtagatcttgatgac

SEQ ID NO: 6146 - DNA, 20 bp, Chlamydia pneumoniae
gcgctgtagatcttgatgac

SEQ ID NO: 6147 - DNA, 20 bp, Chlamydia pneumoniae
acctaccccctaatcacagc

SEQ ID NO: 6148 - DNA, 20 bp, Chlamydia pneumoniae
caggatcggcagatgtacaa

SEQ ID NO: 6149 - DNA, 20 bp, Chlamydia pneumoniae
catgctctctaccctaaagg

SEQ ID NO: 6150 - DNA, 20 bp, Chlamydia pneumoniae
ctagttctcttgagagagcg

SEQ ID NO: 6151 - DNA, 20 bp, Chlamydia pneumoniae
gaagcaccgtaaaccaactg

SEQ ID NO: 6152 - DNA, 20 bp, Chlamydia pneumoniae
ctcccaatctttcttcggtc

SEQ ID NO: 6153 - DNA, 20 bp, Chlamydia pneumoniae
cgacaacaaacagttctgac

SEQ ID NO: 6154 - DNA, 20 bp, Chlamydia pneumoniae
caaagagcacaggcaaacca

SEQ ID NO: 6155 - DNA, 20 bp, Chlamydia pneumoniae
gcacgtacatcggtttcaac

SEQ ID NO: 6156 - DNA, 20 bp, Chlamydia pneumoniae
tgaacgataactcctctagc

SEQ ID NO: 6157 - DNA, 20 bp, Chlamydia pneumoniae
caactgttcttttggtccgc

SEQ ID NO: 6158 - DNA, 20 bp, Chlamydia pneumoniae
ctggagcaaaagaagacgag

SEQ ID NO: 6159 - DNA, 20 bp, Chlamydia pneumoniae
aatacttctcctgaaccgca

SEQ ID NO: 6160 - DNA, 20 bp, Chlamydia pneumoniae
cttctcctctccagctaaag

SEQ ID NO: 6161 - DNA, 20 bp, Chlamydia pneumoniae
gcatggtcatgatcggagag

SEQ ID NO: 6162 - DNA, 20 bp, Chlamydia pneumoniae
ccaatttgtaggacatggcg

SEQ ID NO: 6163 - DNA, 20 bp, Chlamydia pneumoniae
ccgaagtatcctctagagga

SEQ ID NO: 6164 - DNA, 20 bp, Chlamydia pneumoniae
gctacatggaagagggaatc

SEQ ID NO: 6165 - DNA, 20 bp, Chlamydia pneumoniae
gctgttccccacgttctatt

SEQ ID NO: 6166 - DNA, 20 bp, Chlamydia pneumoniae
gctgtacactcatagcgaga

SEQ ID NO: 6167 - DNA, 20 bp, Chlamydia pneumoniae
cctgactatctatcagggca

SEQ ID NO: 6168 - DNA, 20 bp, Chlamydia pneumoniae
ccttgtagacaaactcctcg

SEQ ID NO: 6169 - DNA, 20 bp, Chlamydia pneumoniae
cggcagcagcaacaatcata

SEQ ID NO: 6170 - DNA, 20 bp, Chlamydia pneumoniae
ccgtactcgccttaattcct

SEQ ID NO: 6171 - DNA, 20 bp, Chlamydia pneumoniae
gatccacagactgcaggaaa

SEQ ID NO: 6172 - DNA, 20 bp, Chlamydia pneumoniae
tttccctgctatttctttgg

SEQ ID NO: 6173 - DNA, 20 bp, Chlamydia pneumoniae
cctttcttcttcggaattgc

SEQ ID NO: 6174 - DNA, 20 bp, Chlamydia pneumoniae
gattcgcctgagcagcacat

SEQ ID NO: 6175 - DNA, 20 bp, Chlamydia pneumoniae
cctcgctgccgttttgattt

SEQ ID NO: 6176 - DNA, 20 bp, Chlamydia pneumoniae
ccccttgctgacctgaaacg

SEQ ID NO: 6177 - DNA, 20 bp, Chlamydia pneumoniae
cacatcagtcctcccatagc

SEQ ID NO: 6178 - DNA, 20 bp, Chlamydia pneumoniae
attggtgtcggagtctcccc

SEQ ID NO: 6179 - DNA, 20 bp, Chlamydia pneumoniae
ccttccatggtaaaggagca

SEQ ID NO: 6180 - DNA, 20 bp, Chlamydia pneumoniae
gtttcagcatggtcacctct

SEQ ID NO: 6181 - DNA, 20 bp, Chlamydia pneumoniae
cactccctcgtccaaagcga

SEQ ID NO: 6182 - DNA, 20 bp, Chlamydia pneumoniae
cttccatggtaaaggagcat

SEQ ID NO: 6183 - DNA, 20 bp, Chlamydia pneumoniae
ccagagcaaaatcctctagg

SEQ ID NO: 6184 - DNA, 20 bp, Chlamydia pneumoniae
cccttggctcgtaaagcatt

SEQ ID NO: 6185 - DNA, 20 bp, Chlamydia pneumoniae
cgctggctagggatcgcgac

SEQ ID NO: 6186 - DNA, 20 bp, Chlamydia pneumoniae
ctccgtagacgtttccttct

SEQ ID NO: 6187 - DNA, 20 bp, Chlamydia pneumoniae
ggaaatgccactgaagaagc

SEQ ID NO: 6188 - DNA, 20 bp, Chlamydia pneumoniae
gcgactgcgaaaaccttctt

SEQ ID NO: 6189 - DNA, 20 bp, Chlamydia pneumoniae
caaggtcagcatcgagaaag

SEQ ID NO: 6190 - DNA, 20 bp, Chlamydia pneumoniae
ccctgcaggagagcaatatg

SEQ ID NO: 6191 - DNA, 20 bp, Chlamydia pneumoniae
gcctctctacatatgtccga

SEQ ID NO: 6192 - DNA, 20 bp, Chlamydia pneumoniae
ggctgctttaagatgcgcta

SEQ ID NO: 6193 - DNA, 20 bp, Chlamydia pneumoniae
catcaagcgcgctctaatgt

SEQ ID NO: 6194 - DNA, 20 bp, Chlamydia pneumoniae
gcctctctacatatgtccga

SEQ ID NO: 6195 - DNA, 20 bp, Chlamydia pneumoniae
gggcagagcatctttgtcaa

SEQ ID NO: 6196 - DNA, 20 bp, Chlamydia pneumoniae
gtagacacactcacagtcct

SEQ ID NO: 6197 - DNA, 20 bp, Chlamydia pneumoniae
cacgtagccgcggattctct

SEQ ID NO: 6198 - DNA, 20 bp, Chlamydia pneumoniae
gacccaacaagaactgctct

SEQ ID NO: 6199 - DNA, 20 bp, Chlamydia pneumoniae
gctgttaggtctaggggatt

SEQ ID NO: 6200 - DNA, 20 bp, Chlamydia pneumoniae
cttgaacctacatgcccgaa

SEQ ID NO: 6201 - DNA, 20 bp, Chlamydia pneumoniae
gcgccattgtcaggatctat

SEQ ID NO: 6202 - DNA, 20 bp, Chlamydia pneumoniae
ggcgccgtattcacaattac

SEQ ID NO: 6203 - DNA, 20 bp, Chlamydia pneumoniae
ccctgatgaaggcattggaa

SEQ ID NO: 6204 - DNA, 20 bp, Chlamydia pneumoniae
ctatccatgcgcccgcagta

SEQ ID NO: 6205 - DNA, 20 bp, Chlamydia pneumoniae
catacgcacccccttcaaaa

SEQ ID NO: 6206 - DNA, 20 bp, Chlamydia pneumoniae
ctcggtagcaaagctaaagg

SEQ ID NO: 6207 - DNA, 20 bp, Chlamydia pneumoniae
aggaagagctcctaaagcac

SEQ ID NO: 6208 - DNA, 20 bp, Chlamydia pneumoniae
catacgcacccccttcaaaa

SEQ ID NO: 6209 - DNA, 20 bp, Chlamydia pneumoniae
gctcaggcagttctacgaaa

SEQ ID NO: 6210 - DNA, 20 bp, Chlamydia pneumoniae
gcgcaaatcacactaaaggc

SEQ ID NO: 6211 - DNA, 20 bp, Chlamydia pneumoniae
cactgacagcgatcttccta

SEQ ID NO: 6212 - DNA, 20 bp, Chlamydia pneumoniae
gcaacagagactgcagaaaa

SEQ ID NO: 6213 - DNA, 20 bp, Chlamydia pneumoniae
ccccctgttcttttatccct

SEQ ID NO: 6214 - DNA, 20 bp, Chlamydia pneumoniae
acatgctcgctcaggcagtt

SEQ ID NO: 6215 - DNA, 20 bp, Chlamydia pneumoniae
ggcaagctacagtcttagga

SEQ ID NO: 6216 - DNA, 20 bp, Chlamydia pneumoniae
ctctcgctatttccaggact

SEQ ID NO: 6217 - DNA, 20 bp, Chlamydia pneumoniae
agcccaaccgagtttaggat

SEQ ID NO: 6218 - DNA, 20 bp, Chlamydia pneumoniae
tgcgtatagccgttttagga

SEQ ID NO: 6219 - DNA, 20 bp, Chlamydia pneumoniae
ggatgggcagcagaatatgt

SEQ ID NO: 6220 - DNA, 20 bp, Chlamydia pneumoniae
ccttctatatagacgcaggg

SEQ ID NO: 6221 - DNA, 20 bp, Chlamydia pneumoniae
ccatacagggggcattggtg

SEQ ID NO: 6222 - DNA, 20 bp, Chlamydia pneumoniae
cactgacagcgatcttccta

SEQ ID NO: 6223 - DNA, 20 bp, Chlamydia pneumoniae
ctgctacgattctgctcttc

SEQ ID NO: 6224 - DNA, 20 bp, Chlamydia pneumoniae
ggatgggcagcagaatatgt

SEQ ID NO: 6225 - DNA, 20 bp, Chlamydia pneumoniae
gcactccctgacgtttactt

SEQ ID NO: 6226 - DNA, 20 bp, Chlamydia pneumoniae
cgccactctcaagatcttct

SEQ ID NO: 6227 - DNA, 20 bp, Chlamydia pneumoniae
ttgggaggctgtagttcctt

SEQ ID NO: 6228 - DNA, 20 bp, Chlamydia pneumoniae
ggacaatacagcctctatgc

SEQ ID NO: 6229 - DNA, 20 bp, Chlamydia pneumoniae
gaagtgaccttcccttggag

SEQ ID NO: 6230 - DNA, 20 bp, Chlamydia pneumoniae
gcatcggtgatctatgccaa

SEQ ID NO: 6231 - DNA, 20 bp, Chlamydia pneumoniae
ccctagcaaaacttgaaccc

SEQ ID NO: 6232 - DNA, 20 bp, Chlamydia pneumoniae
ctccctccggaagtgacctt

SEQ ID NO: 6233 - DNA, 20 bp, Chlamydia pneumoniae
cggggggaaaaatggaatca

SEQ ID NO: 6234 - DNA, 20 bp, Chlamydia pneumoniae
ccgtaagtgtcggtatgatg

SEQ ID NO: 6235 - DNA, 20 bp, Chlamydia pneumoniae
ctccttagaacaagcgtctc

SEQ ID NO: 6236 - DNA, 20 bp, Chlamydia pneumoniae
gcacactaggaggcataact

SEQ ID NO: 6237 - DNA, 20 bp, Chlamydia pneumoniae
ctgcagctgctctactttca

SEQ ID NO: 6238 - DNA, 20 bp, Chlamydia pneumoniae
gagcgattcaaactagggga

SEQ ID NO: 6239 - DNA, 20 bp, Chlamydia pneumoniae
ccctatcgggacaaacgtta

SEQ ID NO: 6240 - DNA, 20 bp, Chlamydia pneumoniae
cgcattcttgcaatcaccga

SEQ ID NO: 6241 - DNA, 20 bp, Chlamydia pneumoniae
cctgcagaagctacaggata

SEQ ID NO: 6242 - DNA, 20 bp, Chlamydia pneumoniae
cgctctgcttatagcgatgt

SEQ ID NO: 6243 - DNA, 20 bp, Chlamydia pneumoniae
gccattgcccaagcaaaaac

SEQ ID NO: 6244 - DNA, 20 bp, Chlamydia pneumoniae
aaggccatctgcaagagatg

SEQ ID NO: 6245 - DNA, 20 bp, Chlamydia pneumoniae
ggtggtaaatgggtatccag

SEQ ID NO: 6246 - DNA, 20 bp, Chlamydia pneumoniae
ggccataccttcacaggaaa

SEQ ID NO: 6247 - DNA, 20 bp, Chlamydia pneumoniae
gctgctattgcaggaagttc

SEQ ID NO: 6248 - DNA, 20 bp, Chlamydia pneumoniae
ggaaacctatacaagcaggg

SEQ ID NO: 6249 - DNA, 20 bp, Chlamydia pneumoniae
ggcgcaatgctaaggacgat

SEQ ID NO: 6250 - DNA, 20 bp, Chlamydia pneumoniae
gggacttcagctaatgaaag

SEQ ID NO: 6251 - DNA, 20 bp, Chlamydia pneumoniae
taccccctaggcaaaacaca

SEQ ID NO: 6252 - DNA, 20 bp, Chlamydia pneumoniae
cggcacgggttgttttcccc

SEQ ID NO: 6253 - DNA, 20 bp, Chlamydia pneumoniae
gccgttcttatcagttctcc

SEQ ID NO: 6254 - DNA, 20 bp, Chlamydia pneumoniae
cgcaagtttttagggatgcc

SEQ ID NO: 6255 - DNA, 20 bp, Chlamydia pneumoniae
cttctttacacttcccaggg

SEQ ID NO: 6256 - DNA, 20 bp, Chlamydia pneumoniae
ggaacttggacacgctttca

SEQ ID NO: 6257 - DNA, 20 bp, Chlamydia pneumoniae
catctccatacgattgccca

SEQ ID NO: 6258 - DNA, 20 bp, Chlamydia pneumoniae
aacagccaatcactccaacg

SEQ ID NO: 6259 - DNA, 20 bp, Chlamydia pneumoniae
cgaaaatctcctccgtaggt

SEQ ID NO: 6260 - DNA, 20 bp, Chlamydia pneumoniae
cgcattcctttcctttctcc

SEQ ID NO: 6261 - DNA, 20 bp, Chlamydia pneumoniae
cccacatcctaggacagtat

SEQ ID NO: 6262 - DNA, 20 bp, Chlamydia pneumoniae
caggaaaaggaatcgctagg

SEQ ID NO: 6263 - DNA, 20 bp, Chlamydia pneumoniae
cagcaggagatacattctcc

SEQ ID NO: 6264 - DNA, 20 bp, Chlamydia pneumoniae
cccgaagtcccaacaaaaag

SEQ ID NO: 6265 - DNA, 20 bp, Chlamydia pneumoniae
catactaccatgcacggaca

SEQ ID NO: 6266 - DNA, 20 bp, Chlamydia pneumoniae
gttgaatcgatttcggagtc

SEQ ID NO: 6267 - DNA, 20 bp, Chlamydia pneumoniae
ctttgtcaaggttgtgcgag

SEQ ID NO: 6268 - DNA, 20 bp, Chlamydia pneumoniae
ctgtttgggccattgaaaac

SEQ ID NO: 6269 - DNA, 20 bp, Chlamydia pneumoniae
aggcagctgagctaaagtct

SEQ ID NO: 6270 - DNA, 20 bp, Chlamydia pneumoniae
tcactcgtaacggagtccta

SEQ ID NO: 6271 - DNA, 20 bp, Chlamydia pneumoniae
ctctcccctgctttctgaaa

SEQ ID NO: 6272 - DNA, 20 bp, Chlamydia pneumoniae
ctcaaaccctgtattgtggg

SEQ ID NO: 6273 - DNA, 20 bp, Chlamydia pneumoniae
gctcctcaggagaaagaatc

SEQ ID NO: 6274 - DNA, 20 bp, Chlamydia pneumoniae
ccatcgcgatcaaacacata

SEQ ID NO: 6275 - DNA, 20 bp, Chlamydia pneumoniae
ctccaacatctctgcgcagc

SEQ ID NO: 6276 - DNA, 20 bp, Chlamydia pneumoniae
gtcagaaagagagctcctga

SEQ ID NO: 6277 - DNA, 20 bp, Chlamydia pneumoniae
agctccccaaggataccaat

SEQ ID NO: 6278 - DNA, 20 bp, Chlamydia pneumoniae
gaaggctcctggaatctctt

SEQ ID NO: 6279 - DNA, 20 bp, Chlamydia pneumoniae
ttgggctctaatccccttta

SEQ ID NO: 6280 - DNA, 20 bp, Chlamydia pneumoniae
ataccacccctcttgatcca

SEQ ID NO: 6281 - DNA, 20 bp, Chlamydia pneumoniae
cacccctctaaaaacgacgc

SEQ ID NO: 6282 - DNA, 20 bp, Chlamydia pneumoniae
gaggctcaggcatagcaaaa

SEQ ID NO: 6283 - DNA, 20 bp, Chlamydia pneumoniae
cttcttgatcccctaaaggg

SEQ ID NO: 6284 - DNA, 20 bp, Chlamydia pneumoniae
caatacctcgcaaggtctga

SEQ ID NO: 6285 - DNA, 20 bp, Chlamydia pneumoniae
ccgcttgcatcttatggaag

SEQ ID NO: 6286 - DNA, 20 bp, Chlamydia pneumoniae
acctgagctcctgcagctat

SEQ ID NO: 6287 - DNA, 20 bp, Chlamydia pneumoniae
cacagtcggagactttcaca

SEQ ID NO: 6288 - DNA, 20 bp, Chlamydia pneumoniae
gaggattagcgtccgagttt

SEQ ID NO: 6289 - DNA, 20 bp, Chlamydia pneumoniae
gctacatatgaggccatgtt

SEQ ID NO: 6290 - DNA, 20 bp, Chlamydia pneumoniae
cacagtcggagactttcaca

SEQ ID NO: 6291 - DNA, 20 bp, Chlamydia pneumoniae
ctcgactctattgagatcgc

SEQ ID NO: 6292 - DNA, 20 bp, Chlamydia pneumoniae
ccatcacaaagacccctcat

SEQ ID NO: 6293 - DNA, 20 bp, Chlamydia pneumoniae
gcatccctaactgaacgcat

SEQ ID NO: 6294 - DNA, 20 bp, Chlamydia pneumoniae
ccccttcgaaaatgcaatgc

SEQ ID NO: 6295 - DNA, 20 bp, Chlamydia pneumoniae
agagaaaagctcccgtagtg

SEQ ID NO: 6296 - DNA, 20 bp, Chlamydia pneumoniae
tgcccgctactctgcgctaa

SEQ ID NO: 6297 - DNA, 20 bp, Chlamydia pneumoniae
cctgagctacagactttacc

SEQ ID NO: 6298 - DNA, 20 bp, Chlamydia pneumoniae
agagaaaagctcccgtagtg

SEQ ID NO: 6299 - DNA, 20 bp, Chlamydia pneumoniae
ctccatcctcagtctctcta

SEQ ID NO: 6300 - DNA, 20 bp, Chlamydia pneumoniae
cagcgagttgcagcatttga

SEQ ID NO: 6301 - DNA, 20 bp, Chlamydia pneumoniae
cagctgcctaaggaattgga

SEQ ID NO: 6302 - DNA, 20 bp, Chlamydia pneumoniae
ccttgggaagaggataagga

SEQ ID NO: 6303 - DNA, 20 bp, Chlamydia pneumoniae
ggagcaattcgaccatggtt

SEQ ID NO: 6304 - DNA, 20 bp, Chlamydia pneumoniae
cgtcaaggaggagtttcaag

SEQ ID NO: 6305 - DNA, 20 bp, Chlamydia pneumoniae
ggagctgatacttgctgcgt

SEQ ID NO: 6306 - DNA, 20 bp, Chlamydia pneumoniae
agtctctgtagtagagacgg

SEQ ID NO: 6307 - DNA, 20 bp, Chlamydia pneumoniae
ctgtcgagagcagcttaaag

SEQ ID NO: 6308 - DNA, 20 bp, Chlamydia pneumoniae
gggtgtatcatcatcggaga

SEQ ID NO: 6309 - DNA, 20 bp, Chlamydia pneumoniae
gcccaagggtaatatagctc

SEQ ID NO: 6310 - DNA, 20 bp, Chlamydia pneumoniae
gcgcttggcatcgctggagc

SEQ ID NO: 6311 - DNA, 20 bp, Chlamydia pneumoniae
gaatccgcaaggaatttcca

SEQ ID NO: 6312 - DNA, 20 bp, Chlamydia pneumoniae
cgaggacgtctcgaggtagc

SEQ ID NO: 6313 - DNA, 20 bp, Chlamydia pneumoniae
ctacgagtgatcccgactat

SEQ ID NO: 6314 - DNA, 20 bp, Chlamydia pneumoniae
aaggggactgctggctaaat

SEQ ID NO: 6315 - DNA, 20 bp, Chlamydia pneumoniae
ttatgggagtcccagcgcat

SEQ ID NO: 6316 - DNA, 20 bp, Chlamydia pneumoniae
ggagcaactactctcgtcat

SEQ ID NO: 6317 - DNA, 20 bp, Chlamydia pneumoniae
ggtgattgatgataacgggg

SEQ ID NO: 6318 - DNA, 20 bp, Chlamydia pneumoniae
gcactccaaaactcaaggag

SEQ ID NO: 6319 - DNA, 20 bp, Chlamydia pneumoniae
ggtagccaaagaagctccta

SEQ ID NO: 6320 - DNA, 20 bp, Chlamydia pneumoniae
gaccacatgtggatagagac

SEQ ID NO: 6321 - DNA, 20 bp, Chlamydia pneumoniae
ccacaccaaaacactatgcc

SEQ ID NO: 6322 - DNA, 20 bp, Chlamydia pneumoniae
caacatgcccatatcggctc

SEQ ID NO: 6323 - DNA, 20 bp, Chlamydia pneumoniae
ggggacaaagtcacagacta

SEQ ID NO: 6324 - DNA, 20 bp, Chlamydia pneumoniae
aagccatctgttttgctgga

SEQ ID NO: 6325 - DNA, 20 bp, Chlamydia pneumoniae
gccactcttcattcagagac

SEQ ID NO: 6326 - DNA, 20 bp, Chlamydia pneumoniae
ggggagctgttttatgttcg

SEQ ID NO: 6327 - DNA, 20 bp, Chlamydia pneumoniae
gcccgggaagctccataaat

SEQ ID NO: 6328 - DNA, 20 bp, Chlamydia pneumoniae
gcaggagttgctaatctagg

SEQ ID NO: 6329 - DNA, 20 bp, Chlamydia pneumoniae
cctgagggtctaaatacaac

SEQ ID NO: 6330 - DNA, 20 bp, Chlamydia pneumoniae
ggaagctcttcctttgctca

SEQ ID NO: 6331 - DNA, 20 bp, Chlamydia pneumoniae
gaaggtcgcttccaaactga

SEQ ID NO: 6332 - DNA, 20 bp, Chlamydia pneumoniae
ccgttttcgaagttgatggc

SEQ ID NO: 6333 - DNA, 20 bp, Chlamydia pneumoniae
gcagaacttgaagctgaagg

SEQ ID NO: 6334 - DNA, 20 bp, Chlamydia pneumoniae
ccatccacggtttgcagaat

SEQ ID NO: 6335 - DNA, 20 bp, Chlamydia pneumoniae
atctgagccactgtgggagg

SEQ ID NO: 6336 - DNA, 20 bp, Chlamydia pneumoniae
cgccttagggtcaaaccttc

SEQ ID NO: 6337 - DNA, 20 bp, Chlamydia pneumoniae
cgggcactttccttcccaga

SEQ ID NO: 6338 - DNA, 20 bp, Chlamydia pneumoniae
ctcgcttctcttcatcagca

SEQ ID NO: 6339 - DNA, 20 bp, Chlamydia pneumoniae
cgtgtttcaggatgtagacc

SEQ ID NO: 6340 - DNA, 20 bp, Chlamydia pneumoniae
gtccaagggacttccctttt

SEQ ID NO: 6341 - DNA, 20 bp, Chlamydia pneumoniae
catcattggttgatgggcac

SEQ ID NO: 6342 - DNA, 20 bp, Chlamydia pneumoniae
gacgctgtttgcaggacatt

SEQ ID NO: 6343 - DNA, 20 bp, Chlamydia pneumoniae
cctactcagcagctactagc

SEQ ID NO: 6344 - DNA, 20 bp, Chlamydia pneumoniae
gcctgcagttttccgacttc

SEQ ID NO: 6345 - DNA, 20 bp, Chlamydia pneumoniae
cctggcgtcctttaccagtg

SEQ ID NO: 6346 - DNA, 20 bp, Chlamydia pneumoniae
cttccttcgtcatggtgtga

SEQ ID NO: 6347 - DNA, 20 bp, Chlamydia pneumoniae
cttctggtacgcgctttaca

SEQ ID NO: 6348 - DNA, 20 bp, Chlamydia pneumoniae
ccggcacgttctgtaaattc

SEQ ID NO: 6349 - DNA, 20 bp, Chlamydia pneumoniae
gagtttgacaatggtcgcta

SEQ ID NO: 6350 - DNA, 20 bp, Chlamydia pneumoniae
gagttctgtgcctgaatgac

SEQ ID NO: 6351 - DNA, 20 bp, Chlamydia pneumoniae
gttgtcgcacttccgttctt

SEQ ID NO: 6352 - DNA, 20 bp, Chlamydia pneumoniae
gagtggatcttcacaaggtc

SEQ ID NO: 6353 - DNA, 20 bp, Chlamydia pneumoniae
cccccgtagaaagcaaagaa

SEQ ID NO: 6354 - DNA, 20 bp, Chlamydia pneumoniae
ccgcggcaccaaagaaataa

SEQ ID NO: 6355 - DNA, 20 bp, Chlamydia pneumoniae
cctgagctcgtatagttcca

SEQ ID NO: 6356 - DNA, 20 bp, Chlamydia pneumoniae
cgatgtggatacgcaacgaa

SEQ ID NO: 6357 - DNA, 20 bp, Chlamydia pneumoniae
cttgaggaaaaggtgtggga

SEQ ID NO: 6358 - DNA, 20 bp, Chlamydia pneumoniae
cagaccaagttgttaagagc

SEQ ID NO: 6359 - DNA, 20 bp, Chlamydia pneumoniae
cgatgtggatacgcaacgaa

SEQ ID NO: 6360 - DNA, 20 bp, Chlamydia pneumoniae
cgactgatcggttcctagaa

SEQ ID NO: 6361 - DNA, 20 bp, Chlamydia pneumoniae
cgaggatccacttcaatagc

SEQ ID NO: 6362 - DNA, 20 bp, Chlamydia pneumoniae
cggtgcaacatacaaggcat

SEQ ID NO: 6363 - DNA, 20 bp, Chlamydia pneumoniae
cagaaactcggagagggagg

SEQ ID NO: 6364 - DNA, 20 bp, Chlamydia pneumoniae
ggggagcagaaaggatgtaa

SEQ ID NO: 6365 - DNA, 20 bp, Chlamydia pneumoniae
gccatccattccatgttcac

SEQ ID NO: 6366 - DNA, 20 bp, Chlamydia pneumoniae
cgcctatgatctgaaaagcg

SEQ ID NO: 6367 - DNA, 20 bp, Chlamydia pneumoniae
tagaggattacgcggaactc

SEQ ID NO: 6368 - DNA, 20 bp, Chlamydia pneumoniae
cacgacgcctgttaaatgag

SEQ ID NO: 6369 - DNA, 20 bp, Chlamydia pneumoniae
cgctactctcattggaaagc

SEQ ID NO: 6370 - DNA, 20 bp, Chlamydia pneumoniae
cgttcgtaatgatcgtccct

SEQ ID NO: 6371 - DNA, 20 bp, Chlamydia pneumoniae
ctctcttcaggattcgcgtt

SEQ ID NO: 6372 - DNA, 20 bp, Chlamydia pneumoniae
gcagggagaaccatgacccc

SEQ ID NO: 6373 - DNA, 20 bp, Chlamydia pneumoniae
ctgcattccggttctccata

SEQ ID NO: 6374 - DNA, 20 bp, Chlamydia pneumoniae
caagggctatggtccctaaa

SEQ ID NO: 6375 - DNA, 20 bp, Chlamydia pneumoniae
cggtcttaagatcccttgag

SEQ ID NO: 6376 - DNA, 20 bp, Chlamydia pneumoniae
gtacgcacgaatgtctgcta

SEQ ID NO: 6377 - DNA, 20 bp, Chlamydia pneumoniae
ggatcgttgctattggcaac

SEQ ID NO: 6378 - DNA, 20 bp, Chlamydia pneumoniae
caggtaatactgtcctcagc

SEQ ID NO: 6379 - DNA, 20 bp, Chlamydia pneumoniae
gtagctcctatcgtattgcc

SEQ ID NO: 6380 - DNA, 20 bp, Chlamydia pneumoniae
ctccttctcaaaagcgactc

SEQ ID NO: 6381 - DNA, 20 bp, Chlamydia pneumoniae
gctgtagctctacaaactcc

SEQ ID NO: 6382 - DNA, 20 bp, Chlamydia pneumoniae
ctgcttaaaaagagaagctc

SEQ ID NO: 6383 - DNA, 20 bp, Chlamydia pneumoniae
tctgatagcgctcttcgaga

SEQ ID NO: 6384 - DNA, 20 bp, Chlamydia pneumoniae
cttgcatccacaagacactg

SEQ ID NO: 6385 - DNA, 20 bp, Chlamydia pneumoniae
ctgtccatgagtttcgtgac

SEQ ID NO: 6386 - DNA, 20 bp, Chlamydia pneumoniae
ctggtttcggtgacagaaga

SEQ ID NO: 6387 - DNA, 20 bp, Chlamydia pneumoniae
gcccaataccctctgtttct

SEQ ID NO: 6388 - DNA, 20 bp, Chlamydia pneumoniae
gtttttggacttcgtcctgt

SEQ ID NO: 6389 - DNA, 20 bp, Chlamydia pneumoniae
ccgctcttctattctcttcc

SEQ ID NO: 6390 - DNA, 20 bp, Chlamydia pneumoniae
cgcaagctctgattgcgatg

SEQ ID NO: 6391 - DNA, 20 bp, Chlamydia pneumoniae
ctgtgttgaaggatcatgga

SEQ ID NO: 6392 - DNA, 20 bp, Chlamydia pneumoniae
acataagcctcacgcacttc

SEQ ID NO: 6393 - DNA, 20 bp, Chlamydia pneumoniae
gcgctcaaaatgacgggcgt

SEQ ID NO: 6394 - DNA, 20 bp, Chlamydia pneumoniae
ctagcgatacgctacctctt

SEQ ID NO: 6395 - DNA, 20 bp, Chlamydia pneumoniae
ggtccgacaaaagactggtt

SEQ ID NO: 6396 - DNA, 20 bp, Chlamydia pneumoniae
gttctagtgcaggtataggg

SEQ ID NO: 6397 - DNA, 20 bp, Chlamydia pneumoniae
gcggaggtagattaatgtca

SEQ ID NO: 6398 - DNA, 20 bp, Chlamydia pneumoniae
cagggaagattagcccagaa

SEQ ID NO: 6399 - DNA, 20 bp, Chlamydia pneumoniae
cggagattcggtatcaacca

SEQ ID NO: 6400 - DNA, 20 bp, Chlamydia pneumoniae
ttcgaacccccgacctattg

SEQ ID NO: 6401 - DNA, 20 bp, Chlamydia pneumoniae
gtacctaagaattcgtgcgt

SEQ ID NO: 6402 - DNA, 20 bp, Chlamydia pneumoniae
gaccttgacttgctccaact

SEQ ID NO: 6403 - DNA, 20 bp, Chlamydia pneumoniae
gggacttgtagctacaacga

SEQ ID NO: 6404 - DNA, 20 bp, Chlamydia pneumoniae
gtcccatgctcgattgagtt

SEQ ID NO: 6405 - DNA, 20 bp, Chlamydia pneumoniae
tacagttcagggagccttag

SEQ ID NO: 6406 - DNA, 20 bp, Chlamydia pneumoniae
cttcagagtacttacggcca

SEQ ID NO: 6407 - DNA, 20 bp, Chlamydia pneumoniae
gtgaactgagtggctcaaca

SEQ ID NO: 6408 - DNA, 20 bp, Chlamydia pneumoniae
gctctttgccgaagagttct

SEQ ID NO: 6409 - DNA, 20 bp, Chlamydia pneumoniae
gatcgtaggtgagggagatg

SEQ ID NO: 6410 - DNA, 20 bp, Chlamydia pneumoniae
gatgagctctgtgctcgatt

SEQ ID NO: 6411 - DNA, 20 bp, Chlamydia pneumoniae
gctcctcttcgtttgacgat

SEQ ID NO: 6412 - DNA, 20 bp, Chlamydia pneumoniae
ccttactccttctactcagg

SEQ ID NO: 6413 - DNA, 20 bp, Chlamydia pneumoniae
gttttgttgtgttggccttt

SEQ ID NO: 6414 - DNA, 20 bp, Chlamydia pneumoniae
ggttctgatcgtgagataga

SEQ ID NO: 6415 - DNA, 20 bp, Chlamydia pneumoniae
gagatgcagaagcgcaatct

SEQ ID NO: 6416 - DNA, 20 bp, Chlamydia pneumoniae
cgatggagatccagagggga

SEQ ID NO: 6417 - DNA, 20 bp, Chlamydia pneumoniae
gaaaaagggttgatcttgtg

SEQ ID NO: 6418 - DNA, 20 bp, Chlamydia pneumoniae
gccatcgtcagaaacaccaa

SEQ ID NO: 6419 - DNA, 20 bp, Chlamydia pneumoniae
aagaagactatgacgggtgg

SEQ ID NO: 6420 - DNA, 20 bp, Chlamydia pneumoniae
gagaagccacaaaatctgcc

SEQ ID NO: 6421 - DNA, 20 bp, Chlamydia pneumoniae
cgttaaatttccgagccagc

SEQ ID NO: 6422 - DNA, 20 bp, Chlamydia pneumoniae
gttgcctgcgtcaaagtttc

SEQ ID NO: 6423 - DNA, 20 bp, Chlamydia pneumoniae
cgcaatctcccagcaatcta

SEQ ID NO: 6424 - DNA, 20 bp, Chlamydia pneumoniae
cgacacttctcatgtcccta

SEQ ID NO: 6425 - DNA, 20 bp, Chlamydia pneumoniae
ccattctttggaatgtaggc

SEQ ID NO: 6426 - DNA, 20 bp, Chlamydia pneumoniae
ctacgtgttctcccgtttgt

SEQ ID NO: 6427 - DNA, 20 bp, Chlamydia pneumoniae
ctcttgctgcggatcttgaa

SEQ ID NO: 6428 - DNA, 20 bp, Chlamydia pneumoniae
acaaggctgcagtcctgcca

SEQ ID NO: 6429 - DNA, 20 bp, Chlamydia pneumoniae
cggtctcttgcgatcttaga

SEQ ID NO: 6430 - DNA, 20 bp, Chlamydia pneumoniae
cgaagtgtggactcttcttc

SEQ ID NO: 6431 - DNA, 20 bp, Chlamydia pneumoniae
ccatgcaagttaacttcacc

SEQ ID NO: 6432 - DNA, 20 bp, Chlamydia pneumoniae
ccttttccccatctatcctc

SEQ ID NO: 6433 - DNA, 20 bp, Chlamydia pneumoniae
gtcctccacaaagtcttacc

SEQ ID NO: 6434 - DNA, 20 bp, Chlamydia pneumoniae
gcttcgactccggaatgtaa

SEQ ID NO: 6435 - DNA, 20 bp, Chlamydia pneumoniae
cagccccaggatgcgatgag

SEQ ID NO: 6436 - DNA, 20 bp, Chlamydia pneumoniae
ctagagtttaagaaccctgg

SEQ ID NO: 6437 - DNA, 20 bp, Chlamydia pneumoniae
cacccgcacgtcttgatgat

SEQ ID NO: 6438 - DNA, 20 bp, Chlamydia pneumoniae
ctgtcgaagagtaggaagac

SEQ ID NO: 6439 - DNA, 20 bp, Chlamydia pneumoniae
aaattctggtgtgggtcgct

SEQ ID NO: 6440 - DNA, 20 bp, Chlamydia pneumoniae
tgatcttcgggtaatggacc

SEQ ID NO: 6441 - DNA, 20 bp, Chlamydia pneumoniae
cgaaattcggaagccacttc

SEQ ID NO: 6442 - DNA, 20 bp, Chlamydia pneumoniae
caccatctcctcgcgaatta

SEQ ID NO: 6443 - DNA, 20 bp, Chlamydia pneumoniae
gtactctccaatcccttcca

SEQ ID NO: 6444 - DNA, 20 bp, Chlamydia pneumoniae
gaaccaggtgtacgagtctt

SEQ ID NO: 6445 - DNA, 20 bp, Chlamydia pneumoniae
tggaaccgttgactcgctat

SEQ ID NO: 6446 - DNA, 20 bp, Chlamydia pneumoniae
gcgcagtgaaacctatgcaa

SEQ ID NO: 6447 - DNA, 20 bp, Chlamydia pneumoniae
cctgacgacctcaaaatctc

SEQ ID NO: 6448 - DNA, 20 bp, Chlamydia pneumoniae
gctccattcttatctgggtg

SEQ ID NO: 6449 - DNA, 20 bp, Chlamydia pneumoniae
tgttgacgccaatcaagccg

SEQ ID NO: 6450 - DNA, 20 bp, Chlamydia pneumoniae
tatccacccagcgttacgcc

SEQ ID NO: 6451 - DNA, 20 bp, Chlamydia pneumoniae
tgtctacacggaacgtccta

SEQ ID NO: 6452 - DNA, 20 bp, Chlamydia pneumoniae
cactgtacttgctggggatt

SEQ ID NO: 6453 - DNA, 20 bp, Chlamydia pneumoniae
ctgtggcagcactgagtttt

SEQ ID NO: 6454 - DNA, 20 bp, Chlamydia pneumoniae
gacatatcctccccaagaag

SEQ ID NO: 6455 - DNA, 20 bp, Chlamydia pneumoniae
acaaagctatcttggcgagc

SEQ ID NO: 6456 - DNA, 20 bp, Chlamydia pneumoniae
cacctttaggagctgtacct

SEQ ID NO: 6457 - DNA, 20 bp, Chlamydia pneumoniae
caccgccattatccgttgaa

SEQ ID NO: 6458 - DNA, 20 bp, Chlamydia pneumoniae
ccagcagcagaacgcaaagc

SEQ ID NO: 6459 - DNA, 20 bp, Chlamydia pneumoniae
aaagagccgatacgctcggg

SEQ ID NO: 6460 - DNA, 20 bp, Chlamydia pneumoniae
gtagaagcccctgtccccca

SEQ ID NO: 6461 - DNA, 20 bp, Chlamydia pneumoniae
gagaggaaaggctagagatg

SEQ ID NO: 6462 - DNA, 20 bp, Chlamydia pneumoniae
ccgagatctgcagaaatgct

SEQ ID NO: 6463 - DNA, 20 bp, Chlamydia pneumoniae
ctccgccatttgtagttgct

SEQ ID NO: 6464 - DNA, 20 bp, Chlamydia pneumoniae
ctcgtagtattgccctcgaa

SEQ ID NO: 6465 - DNA, 20 bp, Chlamydia pneumoniae
ccgctagattgaagaggtct

SEQ ID NO: 6466 - DNA, 20 bp, Chlamydia pneumoniae
cgcgctagaatgacgataac

SEQ ID NO: 6467 - DNA, 20 bp, Chlamydia pneumoniae
cccttaacaggagaatagcc

SEQ ID NO: 6468 - DNA, 20 bp, Chlamydia pneumoniae
cgcgctagaatgacgataac

SEQ ID NO: 6469 - DNA, 20 bp, Chlamydia pneumoniae
agtggttgcggcatggagta

SEQ ID NO: 6470 - DNA, 20 bp, Chlamydia pneumoniae
tgcagcattcccagaagtct

SEQ ID NO: 6471 - DNA, 20 bp, Chlamydia pneumoniae
ggatagcacgctgatcaaca

SEQ ID NO: 6472 - DNA, 20 bp, Chlamydia pneumoniae
gcttatccttacgctatggc

SEQ ID NO: 6473 - DNA, 20 bp, Chlamydia pneumoniae
gattgtttccgtgggtgctc

SEQ ID NO: 6474 - DNA, 20 bp, Chlamydia pneumoniae
gctcttgggatctttgcgaa

SEQ ID NO: 6475 - DNA, 20 bp, Chlamydia pneumoniae
gcatctagcgtgctatcctt

SEQ ID NO: 6476 - DNA, 20 bp, Chlamydia pneumoniae
gttgctgttgctgttgctga

SEQ ID NO: 6477 - DNA, 20 bp, Chlamydia pneumoniae
cactgcctgagattacacac

SEQ ID NO: 6478 - DNA, 20 bp, Chlamydia pneumoniae
taaggtcgttcctgcatcca

SEQ ID NO: 6479 - DNA, 20 bp, Chlamydia pneumoniae
acctccaatccaaatccctg

SEQ ID NO: 6480 - DNA, 20 bp, Chlamydia pneumoniae
gcctcagcaaagaaagcttg

SEQ ID NO: 6481 - DNA, 20 bp, Chlamydia pneumoniae
ggagagtagctggtaaggta

SEQ ID NO: 6482 - DNA, 20 bp, Chlamydia pneumoniae
ggatagacacgttgaccaga

SEQ ID NO: 6483 - DNA, 20 bp, Chlamydia pneumoniae
tgtgaaggcttggtttctcg

SEQ ID NO: 6484 - DNA, 20 bp, Chlamydia pneumoniae
agagcgagttccccagcaga

SEQ ID NO: 6485 - DNA, 20 bp, Chlamydia pneumoniae
ggtccagttgatgcttccta

SEQ ID NO: 6486 - DNA, 20 bp, Chlamydia pneumoniae
gcggtggtaagttcaagaag

SEQ ID NO: 6487 - DNA, 20 bp, Chlamydia pneumoniae
aggttggtaccataggccat

SEQ ID NO: 6488 - DNA, 20 bp, Chlamydia pneumoniae
ggagtttgtgcaagggtatt

SEQ ID NO: 6489 - DNA, 20 bp, Chlamydia pneumoniae
tgccgcagctcctgcattcg

SEQ ID NO: 6490 - DNA, 20 bp, Chlamydia pneumoniae
aatgggagtgacaagagtcg

SEQ ID NO: 6491 - DNA, 20 bp, Chlamydia pneumoniae
ccttcagtctgtgtgaaacc

SEQ ID NO: 6492 - DNA, 20 bp, Chlamydia pneumoniae
gagtcctcgttgctgataga

SEQ ID NO: 6493 - DNA, 20 bp, Chlamydia pneumoniae
ctgtagactgcctggaactt

SEQ ID NO: 6494 - DNA, 20 bp, Chlamydia pneumoniae
gagaaattggtagccgtggc

SEQ ID NO: 6495 - DNA, 20 bp, Chlamydia pneumoniae
gcgcctccattgtcattaga

SEQ ID NO: 6496 - DNA, 20 bp, Chlamydia pneumoniae
cccaccactagtaattgctg

SEQ ID NO: 6497 - DNA, 20 bp, Chlamydia pneumoniae
gcaagagttagaggttgctg

SEQ ID NO: 6498 - DNA, 20 bp, Chlamydia pneumoniae
ggcttaaagcagtgtgtggt

SEQ ID NO: 6499 - DNA, 20 bp, Chlamydia pneumoniae
gcaagttccagagcgcaacc

SEQ ID NO: 6500 - DNA, 20 bp, Chlamydia pneumoniae
ctgcataggcagaagctcta

SEQ ID NO: 6501 - DNA, 20 bp, Chlamydia pneumoniae
gccgagtttttctctagacg

SEQ ID NO: 6502 - DNA, 20 bp, Chlamydia pneumoniae
gagattcccctcaggcagta

SEQ ID NO: 6503 - DNA, 20 bp, Chlamydia pneumoniae
cacgtactctgcctttcttg

SEQ ID NO: 6504 - DNA, 20 bp, Chlamydia pneumoniae
ttcagatcgaggcttctggg

SEQ ID NO: 6505 - DNA, 20 bp, Chlamydia pneumoniae
ggggaaaaacgcaaataccg

SEQ ID NO: 6506 - DNA, 20 bp, Chlamydia pneumoniae
ccaagcgattcaaggtgtca

SEQ ID NO: 6507 - DNA, 20 bp, Chlamydia pneumoniae
tcaggaaaccaagctgtagc

SEQ ID NO: 6508 - DNA, 20 bp, Chlamydia pneumoniae
ctcaataaggctgatgcagg

SEQ ID NO: 6509 - DNA, 20 bp, Chlamydia pneumoniae
cagcctgtaactctaactgc

SEQ ID NO: 6510 - DNA, 20 bp, Chlamydia pneumoniae
ggggaaaaacgcaaataccg

SEQ ID NO: 6511 - DNA, 20 bp, Chlamydia pneumoniae
cggctcctaccctcttctcg

SEQ ID NO: 6512 - DNA, 20 bp, Chlamydia pneumoniae
aagctgtagctaatggcgga

SEQ ID NO: 6513 - DNA, 20 bp, Chlamydia pneumoniae
ccgttgtgctaggagaggaa

SEQ ID NO: 6514 - DNA, 20 bp, Chlamydia pneumoniae
gctcctccctttgttgatga

SEQ ID NO: 6515 - DNA, 20 bp, Chlamydia pneumoniae
gctgcttaagacctaaggag

SEQ ID NO: 6516 - DNA, 20 bp, Chlamydia pneumoniae
ccaagttgccgtggcctctt

SEQ ID NO: 6517 - DNA, 20 bp, Chlamydia pneumoniae
ggggaatttccctagggaat

SEQ ID NO: 6518 - DNA, 20 bp, Chlamydia pneumoniae
tccgatatccccctgcacga

SEQ ID NO: 6519 - DNA, 20 bp, Chlamydia pneumoniae
gatctccgcttttcacggat

SEQ ID NO: 6520 - DNA, 20 bp, Chlamydia pneumoniae
tgtgtgcatagagggaccta

SEQ ID NO: 6521 - DNA, 20 bp, Chlamydia pneumoniae
acgaaggtcctcgagtcgtg

SEQ ID NO: 6522 - DNA, 20 bp, Chlamydia pneumoniae
gcagatggatggagttgtgt

SEQ ID NO: 6523 - DNA, 20 bp, Chlamydia pneumoniae
catagagggacctatctctg

SEQ ID NO: 6524 - DNA, 20 bp, Chlamydia pneumoniae
gtgccatccaaagaatccag

SEQ ID NO: 6525 - DNA, 20 bp, Chlamydia pneumoniae
cgccctattgctaaagcaac

SEQ ID NO: 6526 - DNA, 20 bp, Chlamydia pneumoniae
ccctctaggatcagaaagtg

SEQ ID NO: 6527 - DNA, 20 bp, Chlamydia pneumoniae
tgatcgctgcagatcccgtg

SEQ ID NO: 6528 - DNA, 20 bp, Chlamydia pneumoniae
tagggagattgctgatagcc

SEQ ID NO: 6529 - DNA, 20 bp, Chlamydia pneumoniae
cccatagggagattgctgat

SEQ ID NO: 6530 - DNA, 20 bp, Chlamydia pneumoniae
gctggatgcttgtactagca

SEQ ID NO: 6531 - DNA, 20 bp, Chlamydia pneumoniae
gcctcctgagaagaatctcg

SEQ ID NO: 6532 - DNA, 20 bp, Chlamydia pneumoniae
tgcggcagaaagtagcgcat

SEQ ID NO: 6533 - DNA, 20 bp, Chlamydia pneumoniae
caacacggttcgtagtgaag

SEQ ID NO: 6534 - DNA, 20 bp, Chlamydia pneumoniae
cagatgctggagaataggca

SEQ ID NO: 6535 - DNA, 20 bp, Chlamydia pneumoniae
cgaagttggcaaggttccca

SEQ ID NO: 6536 - DNA, 20 bp, Chlamydia pneumoniae
ttagcacagatggctccgcc

SEQ ID NO: 6537 - DNA, 20 bp, Chlamydia pneumoniae
ctccttgtgcagatagagac

SEQ ID NO: 6538 - DNA, 20 bp, Chlamydia pneumoniae
gccagaggtcttgtaagaag

SEQ ID NO: 6539 - DNA, 20 bp, Chlamydia pneumoniae
gtaacgctcgggatctaaga

SEQ ID NO: 6540 - DNA, 20 bp, Chlamydia pneumoniae
agagcttagcgatgaaggct

SEQ ID NO: 6541 - DNA, 20 bp, Chlamydia pneumoniae
ggtaagctgacctgagccct

SEQ ID NO: 6542 - DNA, 20 bp, Chlamydia pneumoniae
gggatgcaaagcagatcgta

SEQ ID NO: 6543 - DNA, 20 bp, Chlamydia pneumoniae
gagtagcgaagccaagaaca

SEQ ID NO: 6544 - DNA, 20 bp, Chlamydia pneumoniae
gaggcttcagtaacagatgc

SEQ ID NO: 6545 - DNA, 20 bp, Chlamydia pneumoniae
gctctagacgccgtgataaa

SEQ ID NO: 6546 - DNA, 20 bp, Chlamydia pneumoniae
gtttcatctgctgcagactc

SEQ ID NO: 6547 - DNA, 20 bp, Chlamydia pneumoniae
gcccatttctggtaaagacc

SEQ ID NO: 6548 - DNA, 20 bp, Chlamydia pneumoniae
ggagaaagacgtagttgtcg

SEQ ID NO: 6549 - DNA, 20 bp, Chlamydia pneumoniae
aggggtgattaaggccatcc

SEQ ID NO: 6550 - DNA, 20 bp, Chlamydia pneumoniae
ctctattgagagacgggcgt

SEQ ID NO: 6551 - DNA, 20 bp, Chlamydia pneumoniae
cgagggtattcgcacttcaa

SEQ ID NO: 6552 - DNA, 20 bp, Chlamydia pneumoniae
gcccgtctctgtaatgaaac

SEQ ID NO: 6553 - DNA, 20 bp, Chlamydia pneumoniae
agagagtcgctgtggctcct

SEQ ID NO: 6554 - DNA, 20 bp, Chlamydia pneumoniae
gtgagcacttttatcgagcc

SEQ ID NO: 6555 - DNA, 20 bp, Chlamydia pneumoniae
gaagaagccagagaaccagt

SEQ ID NO: 6556 - DNA, 20 bp, Chlamydia pneumoniae
cggccaaaactgcagaagat

SEQ ID NO: 6557 - DNA, 20 bp, Chlamydia pneumoniae
gtaaaacaggcgatctggag

SEQ ID NO: 6558 - DNA, 20 bp, Chlamydia pneumoniae
gatcgttctgaagggaagtc

SEQ ID NO: 6559 - DNA, 20 bp, Chlamydia pneumoniae
acccctttagagcaggctct

SEQ ID NO: 6560 - DNA, 20 bp, Chlamydia pneumoniae
taagccgggagaaagagggg

SEQ ID NO: 6561 - DNA, 20 bp, Chlamydia pneumoniae
agactgagaaggcgttaggt

SEQ ID NO: 6562 - DNA, 20 bp, Chlamydia pneumoniae
ctatctcgtgttctgcacga

SEQ ID NO: 6563 - DNA, 20 bp, Chlamydia pneumoniae
gtcgttcccttctgtcaacg

SEQ ID NO: 6564 - DNA, 20 bp, Chlamydia pneumoniae
gtgcagaatcactatcccca

SEQ ID NO: 6565 - DNA, 20 bp, Chlamydia pneumoniae
gtttactgtcgttcgacagc

SEQ ID NO: 6566 - DNA, 20 bp, Chlamydia pneumoniae
cctatagacctgacgatcct

SEQ ID NO: 6567 - DNA, 20 bp, Chlamydia pneumoniae
gcaccttctgaggagaacaa

SEQ ID NO: 6568 - DNA, 20 bp, Chlamydia pneumoniae
cagctagcgtcagataggat

SEQ ID NO: 6569 - DNA, 20 bp, Chlamydia pneumoniae
ggaagattttgcctctggag

SEQ ID NO: 6570 - DNA, 20 bp, Chlamydia pneumoniae
cgcgttttatggaatccgca

SEQ ID NO: 6571 - DNA, 20 bp, Chlamydia pneumoniae
cacagtgcttgccatctatc

SEQ ID NO: 6572 - DNA, 20 bp, Chlamydia pneumoniae
ctgcacgaaggtttgggaaa

SEQ ID NO: 6573 - DNA, 20 bp, Chlamydia pneumoniae
cgcaacccaagtctgcaaat

SEQ ID NO: 6574 - DNA, 20 bp, Chlamydia pneumoniae
gggatacagacatgcgtagt

SEQ ID NO: 6575 - DNA, 20 bp, Chlamydia pneumoniae
tcagatcgtgcgagtagaac

SEQ ID NO: 6576 - DNA, 20 bp, Chlamydia pneumoniae
ggaagcaacattccgaagca

SEQ ID NO: 6577 - DNA, 20 bp, Chlamydia pneumoniae
gcgcatactcgttcacaaat

SEQ ID NO: 6578 - DNA, 20 bp, Chlamydia pneumoniae
gtgcccgattctgcttgatt

SEQ ID NO: 6579 - DNA, 20 bp, Chlamydia pneumoniae
gcaggccagccccgcaccat

SEQ ID NO: 6580 - DNA, 20 bp, Chlamydia pneumoniae
accagtttgcatagagcagc

SEQ ID NO: 6581 - DNA, 20 bp, Chlamydia pneumoniae
ggtggtagcactataacctg

SEQ ID NO: 6582 - DNA, 20 bp, Chlamydia pneumoniae
ggagtctttgacactagagg

SEQ ID NO: 6583 - DNA, 20 bp, Chlamydia pneumoniae
aggcaggtgctgtcctgtag

SEQ ID NO: 6584 - DNA, 20 bp, Chlamydia pneumoniae
gtgaagtctccattacaggc

SEQ ID NO: 6585 - DNA, 20 bp, Chlamydia pneumoniae
ctccccagtttccttgattg

SEQ ID NO: 6586 - DNA, 20 bp, Chlamydia pneumoniae
tacgaagcgcaccccctcca

SEQ ID NO: 6587 - DNA, 20 bp, Chlamydia pneumoniae
gaaccacggaagctcaacat

SEQ ID NO: 6588 - DNA, 20 bp, Chlamydia pneumoniae
gctgctgctaatgtatggct

SEQ ID NO: 6589 - DNA, 20 bp, Chlamydia pneumoniae
ccatcctcgtagtggtagtt

SEQ ID NO: 6590 - DNA, 20 bp, Chlamydia pneumoniae
ctgggttatatcgtgaccga

SEQ ID NO: 6591 - DNA, 20 bp, Chlamydia pneumoniae
cctccaaagctggaatcttc

SEQ ID NO: 6592 - DNA, 20 bp, Chlamydia pneumoniae
tccatcctcgtagtggtagt

SEQ ID NO: 6593 - DNA, 20 bp, Chlamydia pneumoniae
ctgtgggagctattcctttc

SEQ ID NO: 6594 - DNA, 20 bp, Chlamydia pneumoniae
ctgtgggagctattcctttc

SEQ ID NO: 6595 - DNA, 20 bp, Chlamydia pneumoniae
ggtcctgagagagtgatagt

SEQ ID NO: 6596 - DNA, 20 bp, Chlamydia pneumoniae
ccctgatatccatagtgctc

SEQ ID NO: 6597 - DNA, 20 bp, Chlamydia pneumoniae
cctttcgaggttcagagaga

SEQ ID NO: 6598 - DNA, 20 bp, Chlamydia pneumoniae
gtagtctgcagagaggaaga

SEQ ID NO: 6599 - DNA, 20 bp, Chlamydia pneumoniae
ggctttggacgaccctttta

SEQ ID NO: 6600 - DNA, 20 bp, Chlamydia pneumoniae
gaggaaagatctgtaagggg

SEQ ID NO: 6601 - DNA, 20 bp, Chlamydia pneumoniae
gttgacgaggagacttgagc

SEQ ID NO: 6602 - DNA, 20 bp, Chlamydia pneumoniae
catacatcgcaccagctctt

SEQ ID NO: 6603 - DNA, 20 bp, Chlamydia pneumoniae
gggaccactgtcttgtatag

SEQ ID NO: 6604 - DNA, 20 bp, Chlamydia pneumoniae
cacgagaagtcgatgtatcc

SEQ ID NO: 6605 - DNA, 20 bp, Chlamydia pneumoniae
agttccgaggtgttctggat

SEQ ID NO: 6606 - DNA, 20 bp, Chlamydia pneumoniae
ggaacttctgcgataggttg

SEQ ID NO: 6607 - DNA, 20 bp, Chlamydia pneumoniae
ccaacagagccgggggacgg

SEQ ID NO: 6608 - DNA, 20 bp, Chlamydia pneumoniae
ggagagtcgaatgcttagga

SEQ ID NO: 6609 - DNA, 20 bp, Chlamydia pneumoniae
tgacgttcctagttccccta

SEQ ID NO: 6610 - DNA, 20 bp, Chlamydia pneumoniae
ctttgtcccatgctcgattg

SEQ ID NO: 6611 - DNA, 20 bp, Chlamydia pneumoniae
tgccttagtaggatgggcac

SEQ ID NO: 6612 - DNA, 20 bp, Chlamydia pneumoniae
gcagaagccacagttaccat

SEQ ID NO: 6613 - DNA, 20 bp, Chlamydia pneumoniae
gtcccatgctcgattgagtt

SEQ ID NO: 6614 - DNA, 20 bp, Chlamydia pneumoniae
cagttaaggatctagcgatt

SEQ ID NO: 6615 - DNA, 20 bp, Chlamydia pneumoniae
cgcgttgtctttaaaaagag

SEQ ID NO: 6616 - DNA, 20 bp, Chlamydia pneumoniae
cgcgttgtctttaaaaagag

SEQ ID NO: 6617 - DNA, 20 bp, Chlamydia pneumoniae
gggtaaacccgcctttaatg

SEQ ID NO: 6618 - DNA, 20 bp, Chlamydia pneumoniae
gctagacagcttgcctatga

SEQ ID NO: 6619 - DNA, 20 bp, Chlamydia pneumoniae
gcacgaagcctgacaggata

SEQ ID NO: 6620 - DNA, 20 bp, Chlamydia pneumoniae
ggaactacgaggacaacatc

SEQ ID NO: 6621 - DNA, 20 bp, Chlamydia pneumoniae
gcaagctgctttgtatctcc

SEQ ID NO: 6622 - DNA, 20 bp, Chlamydia pneumoniae
ctgcaggctttagcagatca

SEQ ID NO: 6623 - DNA, 20 bp, Chlamydia pneumoniae
ccgtcgagaagctacacaaa

SEQ ID NO: 6624 - DNA, 20 bp, Chlamydia pneumoniae
gagaagactacagcggaacg

SEQ ID NO: 6625 - DNA, 20 bp, Chlamydia pneumoniae
gcaccgacttttgcacgata

SEQ ID NO: 6626 - DNA, 20 bp, Chlamydia pneumoniae
gaaggaacataggagctgga

SEQ ID NO: 6627 - DNA, 20 bp, Chlamydia pneumoniae
ctgtatcgcaccatttgctg

SEQ ID NO: 6628 - DNA, 20 bp, Chlamydia pneumoniae
cggcttcaacagttccaaca

SEQ ID NO: 6629 - DNA, 20 bp, Chlamydia pneumoniae
gcgcagttgcagccgtatta

SEQ ID NO: 6630 - DNA, 20 bp, Chlamydia pneumoniae
ctcctgttggatagtggtca

SEQ ID NO: 6631 - DNA, 20 bp, Chlamydia pneumoniae
catcatcggctaacctttcg

SEQ ID NO: 6632 - DNA, 20 bp, Chlamydia pneumoniae
ctccacagtttggctatcct

SEQ ID NO: 6633 - DNA, 20 bp, Chlamydia pneumoniae
tgaggaaaccgcaatcgctg

SEQ ID NO: 6634 - DNA, 20 bp, Chlamydia pneumoniae
cagacagatgctacagcgac

SEQ ID NO: 6635 - DNA, 20 bp, Chlamydia pneumoniae
gctccaagcaacaaggaagt

SEQ ID NO: 6636 - DNA, 20 bp, Chlamydia pneumoniae
gcggaagctaagcctaaaga

SEQ ID NO: 6637 - DNA, 20 bp, Chlamydia pneumoniae
agaatagcaggtgcggaagc

SEQ ID NO: 6638 - DNA, 20 bp, Chlamydia pneumoniae
ctttaaaaacaggctcgcat

SEQ ID NO: 6639 - DNA, 20 bp, Chlamydia pneumoniae
ggacgttctggtttaggaga

SEQ ID NO: 6640 - DNA, 20 bp, Chlamydia pneumoniae
ggttccttggatcaatggac

SEQ ID NO: 6641 - DNA, 20 bp, Chlamydia pneumoniae
ggcagtgattttactttccg

SEQ ID NO: 6642 - DNA, 20 bp, Chlamydia pneumoniae
ccggtggttgtatttcagag

SEQ ID NO: 6643 - DNA, 20 bp, Chlamydia pneumoniae
ctggttaggtttccgtactg

SEQ ID NO: 6644 - DNA, 20 bp, Chlamydia pneumoniae
atccataactgcttgggtgc

SEQ ID NO: 6645 - DNA, 20 bp, Chlamydia pneumoniae
ggcgttttttttccgacgct

SEQ ID NO: 6646 - DNA, 20 bp, Chlamydia pneumoniae
ccggaactttctgtagtcgt

SEQ ID NO: 6647 - DNA, 20 bp, Chlamydia pneumoniae
gcatttttgagtccaccagc

SEQ ID NO: 6648 - DNA, 20 bp, Chlamydia pneumoniae
gaaacaacaaaggcatgcag

SEQ ID NO: 6649 - DNA, 20 bp, Chlamydia pneumoniae
gctagcaatagcttcgatgg

SEQ ID NO: 6650 - DNA, 20 bp, Chlamydia pneumoniae
tgcagactctggcaccctat

SEQ ID NO: 6651 - DNA, 20 bp, Chlamydia pneumoniae
ctctcaggaacgggaaaaag

SEQ ID NO: 6652 - DNA, 20 bp, Chlamydia pneumoniae
gttttgctcagctctttgcg

SEQ ID NO: 6653 - DNA, 20 bp, Chlamydia pneumoniae
ccttgcgattcctcttggaa

SEQ ID NO: 6654 - DNA, 20 bp, Chlamydia pneumoniae
cgctcttacctagtagaggt

SEQ ID NO: 6655 - DNA, 20 bp, Chlamydia pneumoniae
gatgctggaactacctacct

SEQ ID NO: 6656 - DNA, 20 bp, Chlamydia pneumoniae
gggaggagctatctatgtga

SEQ ID NO: 6657 - DNA, 20 bp, Chlamydia pneumoniae
cctgctgatactagcaccat

SEQ ID NO: 6658 - DNA, 20 bp, Chlamydia pneumoniae
gtgctgcattttgtcagctc

SEQ ID NO: 6659 - DNA, 20 bp, Chlamydia pneumoniae
gtctatgcacatcaggaagg

SEQ ID NO: 6660 - DNA, 20 bp, Chlamydia pneumoniae
gtgcagggaaccatttttgc

SEQ ID NO: 6661 - DNA, 20 bp, Chlamydia pneumoniae
gcagcttctgggattacgaa

SEQ ID NO: 6662 - DNA, 20 bp, Chlamydia pneumoniae
tgttatcctcaggacgagga

SEQ ID NO: 6663 - DNA, 20 bp, Chlamydia pneumoniae
ctgcaggtgccttagtattg

SEQ ID NO: 6664 - DNA, 20 bp, Chlamydia pneumoniae
cctcatggaccggagcacaa

SEQ ID NO: 6665 - DNA, 20 bp, Chlamydia pneumoniae
gctacgacaaggaccatctt

SEQ ID NO: 6666 - DNA, 20 bp, Chlamydia pneumoniae
gcggttcctgtagggataaa

SEQ ID NO: 6667 - DNA, 20 bp, Chlamydia pneumoniae
caggaaaaggtagcctagtc

SEQ ID NO: 6668 - DNA, 20 bp, Chlamydia pneumoniae
cacaatgcaggatggtggag

SEQ ID NO: 6669 - DNA, 20 bp, Chlamydia pneumoniae
ggagcaagcgataacttacg

SEQ ID NO: 6670 - DNA, 20 bp, Chlamydia pneumoniae
gatcagcgtgctatccaaga

SEQ ID NO: 6671 - DNA, 20 bp, Chlamydia pneumoniae
accgcttgtacaccttctcc

SEQ ID NO: 6672 - DNA, 20 bp, Chlamydia pneumoniae
cacaggaggagcattgagtt

SEQ ID NO: 6673 - DNA, 20 bp, Chlamydia pneumoniae
gactacgacagcagctctct

SEQ ID NO: 6674 - DNA, 20 bp, Chlamydia pneumoniae
gcaaataacccggaaggttg

SEQ ID NO: 6675 - DNA, 20 bp, Chlamydia pneumoniae
gcggtgcgatctatgcgacc

SEQ ID NO: 6676 - DNA, 20 bp, Chlamydia pneumoniae
cgggaggagcgatttattcg

SEQ ID NO: 6677 - DNA, 20 bp, Chlamydia pneumoniae
caaacccaaacacgggaact

SEQ ID NO: 6678 - DNA, 20 bp, Chlamydia pneumoniae
tctatacagcaggagatcgc

SEQ ID NO: 6679 - DNA, 20 bp, Chlamydia pneumoniae
cttaccgggatcaccctcac

SEQ ID NO: 6680 - DNA, 20 bp, Chlamydia pneumoniae
atccgccatccttggggttc

SEQ ID NO: 6681 - DNA, 20 bp, Chlamydia pneumoniae
ggtgtagtttacgctacagg

SEQ ID NO: 6682 - DNA, 20 bp, Chlamydia pneumoniae
gggctatttgttgcactacg

SEQ ID NO: 6683 - DNA, 20 bp, Chlamydia pneumoniae
gccggtcagggaggaggagg

SEQ ID NO: 6684 - DNA, 20 bp, Chlamydia pneumoniae
aggaggaggagcgatcaata

SEQ ID NO: 6685 - DNA, 20 bp, Chlamydia pneumoniae
gctctttgctagagatcgca

SEQ ID NO: 6686 - DNA, 20 bp, Chlamydia pneumoniae
gagctagcctgccttttgtt

SEQ ID NO: 6687 - DNA, 20 bp, Chlamydia pneumoniae
ctgcgaaccatttccaagtg

SEQ ID NO: 6688 - DNA, 20 bp, Chlamydia pneumoniae
gaagctaataacaatggcgg

SEQ ID NO: 6689 - DNA, 20 bp, Chlamydia pneumoniae
tagatctttccgctgctggc

SEQ ID NO: 6690 - DNA, 20 bp, Chlamydia pneumoniae
caagccttcacgcagccttt

SEQ ID NO: 6691 - DNA, 20 bp, Chlamydia pneumoniae
gccagctcttcggtaaagat

SEQ ID NO: 6692 - DNA, 20 bp, Chlamydia pneumoniae
tcttagcaagtgctggaagc

SEQ ID NO: 6693 - DNA, 20 bp, Chlamydia pneumoniae
gcgtttgctgctgttgttga

SEQ ID NO: 6694 - DNA, 20 bp, Chlamydia pneumoniae
ctatcgctaaaccccaacct

SEQ ID NO: 6695 - DNA, 20 bp, Chlamydia pneumoniae
cagctgcgagcctctcaagg

SEQ ID NO: 6696 - DNA, 20 bp, Chlamydia pneumoniae
cctgaccttgcagggaatcc

SEQ ID NO: 6697 - DNA, 20 bp, Chlamydia pneumoniae
agctcgtggtataatgacgg

SEQ ID NO: 6698 - DNA, 20 bp, Chlamydia pneumoniae
ctactgtcatctacgttgcc

SEQ ID NO: 6699 - DNA, 20 bp, Chlamydia pneumoniae
gcgatcttcttccactgttc

SEQ ID NO: 6700 - DNA, 20 bp, Chlamydia pneumoniae
gcacaatcgtccaactgcaa

SEQ ID NO: 6701 - DNA, 20 bp, Chlamydia pneumoniae
gctcgtgtaagactttcagg

SEQ ID NO: 6702 - DNA, 20 bp, Chlamydia pneumoniae
gcaactctaatctttgcagc

SEQ ID NO: 6703 - DNA, 20 bp, Chlamydia pneumoniae
gcatttgggatcattgcgga

SEQ ID NO: 6704 - DNA, 20 bp, Chlamydia pneumoniae
cacctcaggatacgcagtat

SEQ ID NO: 6705 - DNA, 20 bp, Chlamydia pneumoniae
cgctaccaaagagttggcaa

SEQ ID NO: 6706 - DNA, 20 bp, Chlamydia pneumoniae
acaagtttgcgctgcacctc

SEQ ID NO: 6707 - DNA, 20 bp, Chlamydia pneumoniae
cggtatttgcgtttttcccc

SEQ ID NO: 6708 - DNA, 20 bp, Chlamydia pneumoniae
gcacttctctctatgacacc

SEQ ID NO: 6709 - DNA, 20 bp, Chlamydia pneumoniae
gccagtatagaaatggctcc

SEQ ID NO: 6710 - DNA, 20 bp, Chlamydia pneumoniae
ccccaaggttttgcagagtt

SEQ ID NO: 6711 - DNA, 20 bp, Chlamydia pneumoniae
cactaaccaggaaaattgcg

SEQ ID NO: 6712 - DNA, 20 bp, Chlamydia pneumoniae
gttactacaggtcagggaac

SEQ ID NO: 6713 - DNA, 20 bp, Chlamydia pneumoniae
gagtggatctcctgaactga

SEQ ID NO: 6714 - DNA, 20 bp, Chlamydia pneumoniae
gcagccagtctccctatccg

SEQ ID NO: 6715 - DNA, 20 bp, Chlamydia pneumoniae
cattcgctctctgcaacagc

SEQ ID NO: 6716 - DNA, 20 bp, Chlamydia pneumoniae
gggaaattcccctagccttg

SEQ ID NO: 6717 - DNA, 20 bp, Chlamydia pneumoniae
caggcatttttactgagggg

SEQ ID NO: 6718 - DNA, 20 bp, Chlamydia pneumoniae
ccctagttcttctagggagt

SEQ ID NO: 6719 - DNA, 20 bp, Chlamydia pneumoniae
cctgttatccagaaggaact

SEQ ID NO: 6720 - DNA, 20 bp, Chlamydia pneumoniae
caccactctcactctctcta

SEQ ID NO: 6721 - DNA, 20 bp, Chlamydia pneumoniae
gctcctgaaggaaaggaaac

SEQ ID NO: 6722 - DNA, 20 bp, Chlamydia pneumoniae
ggttcagaatctgcacatcc

SEQ ID NO: 6723 - DNA, 20 bp, Chlamydia pneumoniae
cctcacttggaatcctgaga

SEQ ID NO: 6724 - DNA, 20 bp, Chlamydia pneumoniae
ctggtttcatctctacgtgc

SEQ ID NO: 6725 - DNA, 20 bp, Chlamydia pneumoniae
cgcccatgctctttacaaac

SEQ ID NO: 6726 - DNA, 20 bp, Chlamydia pneumoniae
cagcgatcaacctcatcaac

SEQ ID NO: 6727 - DNA, 20 bp, Chlamydia pneumoniae
ggaggagccctctatggcaa

SEQ ID NO: 6728 - DNA, 20 bp, Chlamydia pneumoniae
gctagaacttgaaggcggta

SEQ ID NO: 6729 - DNA, 20 bp, Chlamydia pneumoniae
gtgacaaccacgggatgttt

SEQ ID NO: 6730 - DNA, 20 bp, Chlamydia pneumoniae
tagacacgacaacccatacg

SEQ ID NO: 6731 - DNA, 20 bp, Chlamydia pneumoniae
aaagggcgctgctcttggag

SEQ ID NO: 6732 - DNA, 20 bp, Chlamydia pneumoniae
gaggcatgcctctttctttc

SEQ ID NO: 6733 - DNA, 20 bp, Chlamydia pneumoniae
ggcctcatctacggaaaaga

SEQ ID NO: 6734 - DNA, 20 bp, Chlamydia pneumoniae
cagactcactcactgtcgaa

SEQ ID NO: 6735 - DNA, 20 bp, Chlamydia pneumoniae
ccaactcctgtgtgaacagc

SEQ ID NO: 6736 - DNA, 20 bp, Chlamydia pneumoniae
gcagcgagaaatggcggagc

SEQ ID NO: 6737 - DNA, 20 bp, Chlamydia pneumoniae
cgattttggcttccgaaggt

SEQ ID NO: 6738 - DNA, 20 bp, Chlamydia pneumoniae
ccaaccacaagtccgtctaa

SEQ ID NO: 6739 - DNA, 20 bp, Chlamydia pneumoniae
cgctagtggagaactgaaga

SEQ ID NO: 6740 - DNA, 20 bp, Chlamydia pneumoniae
ggagctctggttcttgatga

SEQ ID NO: 6741 - DNA, 20 bp, Chlamydia pneumoniae
ccagtagcaattcctatcgc

SEQ ID NO: 6742 - DNA, 20 bp, Chlamydia pneumoniae
ctcctagcgcaaatactctc

SEQ ID NO: 6743 - DNA, 20 bp, Chlamydia pneumoniae
cctggaaagcagcttatggt

SEQ ID NO: 6744 - DNA, 20 bp, Chlamydia pneumoniae
gccgccacggtttgtttgta

SEQ ID NO: 6745 - DNA, 20 bp, Chlamydia pneumoniae
atgctcttgagaggtacgga

SEQ ID NO: 6746 - DNA, 20 bp, Chlamydia pneumoniae
actgaggagtaggggcataa

SEQ ID NO: 6747 - DNA, 20 bp, Chlamydia pneumoniae
ctacaatggggatggcctta

SEQ ID NO: 6748 - DNA, 20 bp, Chlamydia pneumoniae
gcctgtaaagcagagtatcc

SEQ ID NO: 6749 - DNA, 20 bp, Chlamydia pneumoniae
ctagattcccctgaggatct

SEQ ID NO: 6750 - DNA, 20 bp, Chlamydia pneumoniae
cgctccaaagttaagacttc

SEQ ID NO: 6751 - DNA, 20 bp, Chlamydia pneumoniae
gtactgctcaactccttagg

SEQ ID NO: 6752 - DNA, 20 bp, Chlamydia pneumoniae
ccccacatgaatccaagggg

SEQ ID NO: 6753 - DNA, 20 bp, Chlamydia pneumoniae
gccctaacgttgcatcttga

SEQ ID NO: 6754 - DNA, 20 bp, Chlamydia pneumoniae
cgagcacaaaacggcaaaga

SEQ ID NO: 6755 - DNA, 20 bp, Chlamydia pneumoniae
tttgtgcactcctggggttt

SEQ ID NO: 6756 - DNA, 20 bp, Chlamydia pneumoniae
ccttctgcagctagctgcaa

SEQ ID NO: 6757 - DNA, 20 bp, Chlamydia pneumoniae
cgctactaagattgccagga

SEQ ID NO: 6758 - DNA, 20 bp, Chlamydia pneumoniae
cactggattctagagtcgag

SEQ ID NO: 6759 - DNA, 20 bp, Chlamydia pneumoniae
ctctttctcccggcttaagt

SEQ ID NO: 6760 - DNA, 20 bp, Chlamydia pneumoniae
cttttgaagtcctagcttgg

SEQ ID NO: 6761 - DNA, 20 bp, Chlamydia pneumoniae
gaagttcttctgtgccacga

SEQ ID NO: 6762 - DNA, 20 bp, Chlamydia pneumoniae
ccctgacagggaattctgaa

SEQ ID NO: 6763 - DNA, 20 bp, Chlamydia pneumoniae
tctaaacctagagctcggag

SEQ ID NO: 6764 - DNA, 20 bp, Chlamydia pneumoniae
ctgtgggtgtgatatctacg

SEQ ID NO: 6765 - DNA, 20 bp, Chlamydia pneumoniae
ggacaagccacagtagaaat

SEQ ID NO: 6766 - DNA, 20 bp, Chlamydia pneumoniae
gcctcgtctaacgtagcaaa

SEQ ID NO: 6767 - DNA, 20 bp, Chlamydia pneumoniae
ctgccctgtcgatgtttcta

SEQ ID NO: 6768 - DNA, 20 bp, Chlamydia pneumoniae
gacccaaaggagagtttcca

SEQ ID NO: 6769 - DNA, 20 bp, Chlamydia pneumoniae
ggggagtcctgtcgcaaaca

SEQ ID NO: 6770 - DNA, 20 bp, Chlamydia pneumoniae
cgtgcagaacatgtggaaac

SEQ ID NO: 6771 - DNA, 20 bp, Chlamydia pneumoniae
gctgatacgtctacagcatc

SEQ ID NO: 6772 - DNA, 20 bp, Chlamydia pneumoniae
cctgctgagatattctgagg

SEQ ID NO: 6773 - DNA, 20 bp, Chlamydia pneumoniae
ccacaacggatgtgcagatt

SEQ ID NO: 6774 - DNA, 20 bp, Chlamydia pneumoniae
gaagcaatgcaatcactccc

SEQ ID NO: 6775 - DNA, 20 bp, Chlamydia pneumoniae
ccaacttcctttggagacct

SEQ ID NO: 6776 - DNA, 20 bp, Chlamydia pneumoniae
ggaggtcttactaccacctt

SEQ ID NO: 6777 - DNA, 20 bp, Chlamydia pneumoniae
ccctcaatcctccatacaga

SEQ ID NO: 6778 - DNA, 20 bp, Chlamydia pneumoniae
cctacgatagtctggatctc

SEQ ID NO: 6779 - DNA, 20 bp, Chlamydia pneumoniae
gctcagttcttctccaaagc

SEQ ID NO: 6780 - DNA, 20 bp, Chlamydia pneumoniae
tccctgcagatctatccctt

SEQ ID NO: 6781 - DNA, 20 bp, Chlamydia pneumoniae
ccacgctgagtcactactta

SEQ ID NO: 6782 - DNA, 20 bp, Chlamydia pneumoniae
gggagctgtgtcctgtaata

SEQ ID NO: 6783 - DNA, 20 bp, Chlamydia pneumoniae
cgaggtcttaacaatgcgag

SEQ ID NO: 6784 - DNA, 20 bp, Chlamydia pneumoniae
gcggaacaaggaaatatcgc

SEQ ID NO: 6785 - DNA, 20 bp, Chlamydia pneumoniae
gtgcgggatggcaattctat

SEQ ID NO: 6786 - DNA, 20 bp, Chlamydia pneumoniae
ctccttattgggtagagacg

SEQ ID NO: 6787 - DNA, 20 bp, Chlamydia pneumoniae
ccaattggactcccttagga

SEQ ID NO: 6788 - DNA, 20 bp, Chlamydia pneumoniae
ccgtatccaatctacagggt

SEQ ID NO: 6789 - DNA, 20 bp, Chlamydia pneumoniae
gaagggacgtgttatagcca

SEQ ID NO: 6790 - DNA, 20 bp, Chlamydia pneumoniae
ccaaacagcgttcgaagaga

SEQ ID NO: 6791 - DNA, 20 bp, Chlamydia pneumoniae
ggtagaggactccctcaaaa

SEQ ID NO: 6792 - DNA, 20 bp, Chlamydia pneumoniae
ggatggaggcattcttgcat

SEQ ID NO: 6793 - DNA, 20 bp, Chlamydia pneumoniae
gccctaggagtcattatctc

SEQ ID NO: 6794 - DNA, 20 bp, Chlamydia pneumoniae
ctcctcaacccggatataga

SEQ ID NO: 6795 - DNA, 20 bp, Chlamydia pneumoniae
gatcagacgacaacagatcc

SEQ ID NO: 6796 - DNA, 20 bp, Chlamydia pneumoniae
atcaccttggcaccgtgttg

SEQ ID NO: 6797 - DNA, 20 bp, Chlamydia pneumoniae
gcccgggaagctccataaat

SEQ ID NO: 6798 - DNA, 20 bp, Chlamydia pneumoniae
gacgcaaaggcttccgaaac

SEQ ID NO: 6799 - DNA, 20 bp, Chlamydia pneumoniae
ggcttccgttctgaatggaa

SEQ ID NO: 6800 - DNA, 20 bp, Chlamydia pneumoniae
gctgagagtcattgcacatt

SEQ ID NO: 6801 - DNA, 20 bp, Chlamydia pneumoniae
ccctactctcatagagcaac

SEQ ID NO: 6802 - DNA, 20 bp, Chlamydia pneumoniae
gcaaaatcttcaggaggagc

SEQ ID NO: 6803 - DNA, 20 bp, Chlamydia pneumoniae
cagaacacctcggaactatc

SEQ ID NO: 6804 - DNA, 20 bp, Chlamydia pneumoniae
cgagaacctagatccctatg

SEQ ID NO: 6805 - DNA, 20 bp, Chlamydia pneumoniae
ggaacaacctcaaacactgc

SEQ ID NO: 6806 - DNA, 20 bp, Chlamydia pneumoniae
ggatcgtcatggctcctatc

SEQ ID NO: 6807 - DNA, 20 bp, Chlamydia pneumoniae
cacagatacgtttcccccat

SEQ ID NO: 6808 - DNA, 20 bp, Chlamydia pneumoniae
tctacaggagaagcggaagc

SEQ ID NO: 6809 - DNA, 20 bp, Chlamydia pneumoniae
acggagaacgtgagcttcca

SEQ ID NO: 6810 - DNA, 20 bp, Chlamydia pneumoniae
accattgtagtacgtatgga

SEQ ID NO: 6811 - DNA, 20 bp, Chlamydia pneumoniae
gaccgagcacaaaaagcttc

SEQ ID NO: 6812 - DNA, 20 bp, Chlamydia pneumoniae
ggttagcctcagttgattcc

SEQ ID NO: 6813 - DNA, 20 bp, Chlamydia pneumoniae
gactgaggtgcatcccaaat

SEQ ID NO: 6814 - DNA, 20 bp, Chlamydia pneumoniae
aagcacttccaagaatcccc

SEQ ID NO: 6815 - DNA, 20 bp, Chlamydia pneumoniae
gggaatcggttatcttgctc

SEQ ID NO: 6816 - DNA, 20 bp, Chlamydia pneumoniae
gatatccagggtagcgcttt

SEQ ID NO: 6817 - DNA, 20 bp, Chlamydia pneumoniae
gccttgattgtagtgagacc

SEQ ID NO: 6818 - DNA, 20 bp, Chlamydia pneumoniae
gtgggaacatacccccatta

SEQ ID NO: 6819 - DNA, 20 bp, Chlamydia pneumoniae
gcccatcaaacagttctgtt

SEQ ID NO: 6820 - DNA, 20 bp, Chlamydia pneumoniae
catcgttccttgatgctggt

SEQ ID NO: 6821 - DNA, 20 bp, Chlamydia pneumoniae
ggatgtctttgaacccttcg

SEQ ID NO: 6822 - DNA, 20 bp, Chlamydia pneumoniae
atagacttcgctactgtcgc

SEQ ID NO: 6823 - DNA, 20 bp, Chlamydia pneumoniae
ctggaccataagtactctgg

SEQ ID NO: 6824 - DNA, 20 bp, Chlamydia pneumoniae
ctagctctccaagagcaccc

SEQ ID NO: 6825 - DNA, 20 bp, Chlamydia pneumoniae
gctgaaatccaagctaagca

SEQ ID NO: 6826 - DNA, 20 bp, Chlamydia pneumoniae
ccctagtcgataagaccacg

SEQ ID NO: 6827 - DNA, 20 bp, Chlamydia pneumoniae
gaggtctcctttgcctttct

SEQ ID NO: 6828 - DNA, 20 bp, Chlamydia pneumoniae
cgtaaatttgctgttgccgc

SEQ ID NO: 6829 - DNA, 20 bp, Chlamydia pneumoniae
ccaactctagctgctttgga

SEQ ID NO: 6830 - DNA, 20 bp, Chlamydia pneumoniae
gaacatctcctaagctgctg

SEQ ID NO: 6831 - DNA, 20 bp, Chlamydia pneumoniae
ggaccttgcaaaccattctc

SEQ ID NO: 6832 - DNA, 20 bp, Chlamydia pneumoniae
cgcatcatttcgtgccctac

SEQ ID NO: 6833 - DNA, 20 bp, Chlamydia pneumoniae
tgttgggcagcttgagaatc

SEQ ID NO: 6834 - DNA, 20 bp, Chlamydia pneumoniae
gcggtctcattttcagcatc

SEQ ID NO: 6835 - DNA, 20 bp, Chlamydia pneumoniae
gcgattgctgctttagctga

SEQ ID NO: 6836 - DNA, 20 bp, Chlamydia pneumoniae
gcatcctggaggctcaccaa

SEQ ID NO: 6837 - DNA, 20 bp, Chlamydia pneumoniae
gacgagctgttactagaagc

SEQ ID NO: 6838 - DNA, 20 bp, Chlamydia pneumoniae
cctagatcaaactttcggaa

SEQ ID NO: 6839 - DNA, 20 bp, Chlamydia pneumoniae
gcatcacgtgttgtctttgc

SEQ ID NO: 6840 - DNA, 20 bp, Chlamydia pneumoniae
ggtgtgagggggtttaagaa

SEQ ID NO: 6841 - DNA, 20 bp, Chlamydia pneumoniae
gaaatgcccgagacgtcttt

SEQ ID NO: 6842 - DNA, 20 bp, Chlamydia pneumoniae
ggccaaagccgtaccgattc

SEQ ID NO: 6843 - DNA, 20 bp, Chlamydia pneumoniae
agagcggaacagcatactgc

SEQ ID NO: 6844 - protein, 78 aa, Chlamydia pneumoniae
SCLPLRDSGTSPWISLRANPSAIAVFPTPGSPISIGLFLVLRESTWMVLRISSSLPITGSSLPSRANAVKFLQYFSKP

SEQ ID NO: 6845 - protein, 106 aa, Chlamydia pneumoniae
MFSMSFKRFLQQIPVRICLLIIYLYQWLISPLLGSCCRFFPSCSHYAEQALKSHGFLMGCWLSIKRIGKCGPWHPGGIDMVPKTALQEVLEPYQEIDGGDSSHFSE

SEQ ID NO: 6846 - protein, 79 aa, Chlamydia pneumoniae
HLSLVSRPLHSESSRPSILSTPYNNRAIRRNSIRFRLHCPCGREQIHFIVFPCDCETLRKLILDNPRDYRPIRGDSCCF

SEQ ID NO: 6847 - protein, 103 aa, Chlamydia pneumoniae
ILRVAVASISYQQCSKEELGCQVEHRKQGKIQKPLHYINAIGGSRSLTLTYTCSSEVVLLPITGRVLQLRCTSLENRMYKLQYRSPLRDSPRDLESVVGLVHC

SEQ ID NO: 6848 - protein, 88 aa, Chlamydia pneumoniae
RLCRPRPYRLAMPPKGRMRILSLSERRFYGKREVRIILETREILVVFERCNCILVLLKKRLCNQPNKGTCILVCILNIVLFSVGPSFW

SEQ ID NO: 6849 - protein, 141 aa, Chlamydia pneumoniae
MNKLLNFVSRTLGGDTALNMINKSSDLILALWMMGVVLMIIIPLPPPIVDLMITINLSISVFLLMVALYIPSALQLSVFPSLLLITTMFRLGIIFPLLDRFSLKRMRVMSFRLRRLRGWRELCGRVHYLPHYYNHSVYRSN

What is claimed is:

1. An isolated, recombinant polynucleotide comprising the nucleotide sequence of an open reading frame (ORF) of a *Chlamydia pneumoniae* genome selected from the group consisting of:
   a) a nucleotide sequence of ORF195, ORF227, ORF234, ORF1145, ORF1160, ORF1162, ORF1255, ORF1256, ORF1257, ORF1258, or the complement of the nucleotide sequence; and b) a nucleotide sequence encoding the amino acid sequence of SEQ ID NO:195, 227, 234, 1145, 1160, 1162, 1255, 1256, 1257, 1258, or the complement of the nucleotide sequence.

2. The isolated, recombinant polynucleotide of claim 1, wherein the nucleotide sequences is selected from the group consisting of the nucleotide sequence of ORF195, ORF227, ORF234, ORF1145, ORF1160, ORF1162, ORF1255, ORF1256, ORF1257, ORF1258, and the complement of the nucleotide sequence.

3. An isolated, recombinant polynucleotide of claim 1, wherein the nucleotide sequence is selected from the group consisting of the nucleotide sequences encoding the amino acid sequences of SEQ ID NO:195, 227, 234, 1145, 1160, 1162, 1255, 1256, 1257, 1258, and the complement of the nucleotide sequence.

4. The isolated, recombinant polynucleotide of claim 1, further comprising elements necessary to direct the expression of said nucleotide sequence in a host cell.

5. A recombinant host cell comprising the polynucleotide of claim 1 or 4.

6. The polynucleotide of claim 1, 2, or 3, that is found in *Chlamydia pneumoniae*, but not in *Chlamydia trachomatis*.

7. A polynucleotide encoding a fusion protein comprising a polynucleotide sequence according to claim 1, 2, or 3, ligated in frame to a polynucleotide encoding a heterologous polypeptide.

8. A recombinant vector containing the polynucleotide of claims 1, 2, 3, or 4.

9. A recombinant vector that contains the polynucleotide of claim 7.

10. A genetically engineered host cell that contains the polynucleotide of claims 1, 2, 3, or 4.

11. A genetically engineered host cell that contains the polynucleotide of claim 7.

12. A method for producing a polypeptide comprising:

(a) culturing the genetically engineered host cell of claim 5 under conditions suitable to produce the polypeptide encoded by the polynucleotide; and (b) recovering the polypeptide from the culture.

13. A method for producing a fusion polypeptide comprising:

(a) culturing the genetically engineered host cell of claim 11 under conditions suitable to produce the polypeptide encoded by the polynucleotide; and (b) recovering the polypeptide from the culture.

* * * * *

UNITED STATES PATENT AND TRADEMARK OFFICE
CERTIFICATE OF CORRECTION

PATENT NO. : 6,559,294 B1
DATED : May 6, 2003
INVENTOR(S) : Rémy Griffais et al.

It is certified that error appears in the above-identified patent and that said Letters Patent is hereby corrected as shown below:

Column 2,
Lines 8-9, "Halberstaeder and on Provaseck" should read -- Halberstaeder and Von Provaseck --.

Column 19,
Line 45,

"ORF799" should read --ORF799; ORF802; ORF803; ORF806; ORF807; ORF808; ORF809; ORF810; ORF811; ORF813; ORF814; ORF815; ORF816; ORF817; ORF819; ORF820; ORF821; ORF823; ORF824; ORF827; ORF829; ORF830; ORF831; ORF833; ORF834; ORF835; ORF837; ORF844; ORF845; ORF846; ORF847; ORF848; ORF849; ORF850; ORF851; ORF852; ORF854; ORF855; ORF856; ORF857; ORF859; ORF860; ORF862; ORF865; ORF866; ORF868; ORF869; ORF870; ORF871; ORF872; ORF874; ORF877; ORF878; ORF879; ORF880; ORF881; ORF882; ORF884; ORF885; ORF888; ORF889; ORF890; ORF891; ORF892; ORF894; ORF895; ORF896; ORF897; ORF899; ORF900; ORF902; ORF903; ORF904; ORF905; ORF909; ORF910; ORF912; ORF913; ORF914; ORF915; ORF917; ORF918; ORF919; ORF921; ORF923; ORF924; ORF926; ORF927; ORF928; ORF929; ORF930; ORF931; ORF937; ORF938; ORF939; ORF941; ORF943; ORF948; ORF951; ORF952; ORF953; ORF958; ORF960; ORF963; ORF964; ORF965; ORF968; ORF970; ORF974; ORF975; ORF977; ORF979; ORF980; ORF981; ORF983; ORF984; ORF985; ORF987; ORF989; ORF992; ORF993; ORF997; ORF998; ORF999; ORF1001; ORF1002; ORF1004; ORF1005; ORF1009; ORF1013; ORF1014; ORF1015; ORF1016; ORF1019; ORF1021; ORF1023; ORF1024; ORF1029; ORF1031; ORF1033; ORF1034; ORF1039; ORF1041; ORF1042; ORF1045; ORF1047; ORF1049; ORF1051; ORF1052; ORF1053; ORF1054; ORF1056; ORF1059; ORF1061; ORF1062; ORF1063; ORF1064; ORF1065; ORF1067; ORF1075; ORF1077; ORF1078; ORF1079; ORF1080; ORF1081; ORF1089; ORF1095; ORF1097; ORF1098; ORF1099; ORF1101; ORF1102; ORF1103; ORF1106; ORF1107; ORF1108; ORF1109; ORF1110; ORF1113; ORF1116; ORF1118; ORF1119; ORF1121; ORF1123; ORF1124; ORF1126; ORF1128; ORF1130; ORF1131; ORF1133; ORF1134; ORF1136; ORF1137 and one of their representative fragments.--

Column 33,
Line 61, "*Chlamydia pneucmoniae*" should read -- *Chlamydia pneumoniae* --.

Column 69,
Line 51, "dTP, dCTP, dGTP and dTTP" should read -- dATP, dCTP, dGTP and dTTP --.

UNITED STATES PATENT AND TRADEMARK OFFICE
CERTIFICATE OF CORRECTION

PATENT NO.    : 6,559,294 B1
DATED         : May 6, 2003
INVENTOR(S)   : Rémy Griffais et al.

It is certified that error appears in the above-identified patent and that said Letters Patent is hereby corrected as shown below:

<u>Column 94,</u>
ORF 417, "Synechocysus sp." should read -- *Synechocystis sp.* --.

<u>Column 98,</u>
ORF 569, "Synechocyslis sp." should read -- *Synechocystis sp.* --.

<u>Column 100,</u>
ORF 608, "Synechocyslis sp." should read -- *Synechocystis sp.* --.

<u>Column 108,</u>
ORF 897, "*Bacillus aereus*" should read -- *Bacillus cereus* --.

<u>Column 113,</u>
ORF 1027, "1699521" should read -- 1099521 --.

<u>Column 121,</u>
Line 63, ORF 93, "i02356" should read -- 102356 --.

<u>Column 126,</u>
Line 59, ORF 473, "51495" should read -- 514965 --.

<u>Column 128,</u>
Line 54, ORF 620, "67799Q" should read -- 677990 --.

<u>Column 165,</u>
Line 47, SEQ ID NO, 2148, "418186" should read -- 418166 --.

<u>Column 218,</u>
Line 53, SEQ ID NO. 6236, "1204512" should read -- 1201512 --.

<u>Column 222,</u>
<u>Line 53,</u>

| "Clone Name | SEQ ID NO (B) | should read | --Clone Name | SEQ ID NO (B) |
|---|---|---|---|---|
| 790293D4# | 6554" | | 790293D4# | 6534-- |

UNITED STATES PATENT AND TRADEMARK OFFICE
CERTIFICATE OF CORRECTION

PATENT NO. : 6,559,294 B1
DATED : May 6, 2003
INVENTOR(S) : Rémy Griffais et al.

It is certified that error appears in the above-identified patent and that said Letters Patent is hereby corrected as shown below:

<u>Column 225,</u>
Line 15, SEQ ID 6513, "516756" should read -- 518756 --.
Line 43, SEQ ID 6546, "S29574" should read -- 529574 --.

<u>Column 227,</u>
Line 43, SEQ ID 6702, "S151O1" should read -- 515101 --.
Line 48, SEQ ID 6707, "S1621S" should read -- 516215 --.

<u>Column 228,</u>
Line 59, SEQ ID 6798, "6796   F   55184" should read -- 6798   F   551854 --.

Signed and Sealed this

Eleventh Day of May, 2004

JON W. DUDAS
*Acting Director of the United States Patent and Trademark Office*